United States Patent 10,696,975 (GENES AND USES FOR PLANT ENHANCEMENT) - sequence listing, part 11

SEQ ID NO: 46525 - protein, 581 aa, Arabidopsis thaliana
MEKVTNSDLKSSVDGGVVDVYGEDSATIEHNITPWSLSVSSGYSLLRDPRYNKGLAFTEKERDTHYLRGLLPPVVLDQKLQEKRLLNNIRQYQFPLQKYMALTELQERNERLFYKLLIDNVEELLPIVYTPTVGEACQKFGSIFRRPQGLFISLKDKGKILDVLKNWPERNIQVIVVTDGERILGLGDLGCQGMGIPVGKLALYSALGGVRPSACLPVTIDVGTNNEKLLNDEFYIGLRQKRATGQEYSELLNEFMSAVKQNYGEKVLIQFEDFANHNAFELLAKYSDTHLVFNDDIQGTASVVLAGLVSAQKLTNSPLAEHTFLFLGAGEAGTGIAELIALYMSKQMNASVEESRKKIWLVDSKGLIVNSRKDSLQDFKKPWAHEHEPVKDLLGAIKAIKPTVLIGSSGVGRSFTKEVIEAMSSINERPLIMALSNPTTQSECTAEEAYTWSKGRAIFASGSPFDPVEYEGKVFVSTQANNAYIFPGFGLGLVISGAIRVHDDMLLAAAEALAGQVSKENYEKGMIYPSFSSIRKISAQIAANVATKAYELGLAGRLPRPKDIVKCAESSMYSPTYRLYR

SEQ ID NO: 46526 - protein, 430 aa, Oryza sativa Japonica Group
LKEEADGQVLDNLRDHNYLPRIAPHFLKWRAQYGEAFLFWYGAKPRICIFDYELARQILSSKSGHFLKNDAPPTLVALMGKGLVLLEGTDWVRHRRVINPAFNMDKLKMMISTMTGCAQSLAKELEDVAAKNKDRVTEAQHELTEITMATLFQVQLPGLNYLPTERNRRKWRLQKNLRDTLMQIIRSRLSSKDGGYGNDLLGLMLGACASDEQGEASSLSMDEIVDECKTFFLAGHETTSLLLTWTVFLLSVYPEWQERLRNEVLRECGTDQCPDANSLGKLKEMTMVLLETLRLYNPALFIQRKPTADITVGSLAIPAGVAVYIPVPIMHRDREVWGHDAGEFNPLRFRDGAARAAAAAGIPHALLSFSIGPRSCIGQGFAMLEAKAAMAAMLRRLSFRVSPGYVHAPVDLITLKPKFGLPVIVRLPDA

SEQ ID NO: 46527 - protein, 479 aa, Sinorhizobium meliloti 1021
MRRNRKVKILATLGPASADEQMIQKLHEAGADLFRINMSHASHEVMRTLIERIRVVEARCGRPIGILADLQGPKLRVGKFAEGKVELKIGQTFTLDNRDVPGDSRRVYLPHPEILEAVKPGHRLLIDDGKLHLRAEKTDGKSIVTTVVSGTRISDRKGVSLPDTLLGVGALTDKDRVDLDAVLATGEVDWVALSFIQRPEDLAEVRKIARGRVGLMSKIEKPQAIERIDEIIELSDALMVARGDLGVEMPLESVPGLQKQLTRACRRAGKPVVVATQMLESMISSPVPTRAEVSDVATAVFEGADAVMLSAESASGEYPVEAVSTMASIASNVERDPHYPGIIYAQRTPPEATGADAISLAAHQIAETLKLAAIVTYTSSGTTGLRAARERPQVPVIALSPIVQTARRLSVVWGLHCVVTEDATDLDDMVNRACRIVSTEGFGKPGDRIIVTAGVPLGTPGATNMLRIAYIGSDGQSGI

SEQ ID NO: 46528 - protein, 567 aa, Arabidopsis thaliana
MQSVLSLSFSQASLPLANRTLCSSNAAPSTPRNLRFCGLRREAFCFSPSKQLTSCRFHIQSRRIEVSAAASSSAGNGAPSKSFDYDLIIIGAGVGGHGAALHAVEKGLKTAIIEGDVVGGTCVNRGCVPSKALLAVSGRMRELQNEHHMKAFGLQVSAAGYDRQGVADHASNLATKIRNNLTNSMKALGVDILTGFGAVLGPQKVKYGDNIITGKDIIIATGSVPFVPKGIEVDGKTVITSDHALKLESVPDWIAIVGSGYIGLEFSDVYTALGSEVTFIEALDQLMPGFDPEISKLAQRVLINTRKIDYHTGVFASKITPAKDGKPVLIELIDAKTKEPKDTLEVDAALIATGRAPFTNGLGLENINVTTQRGFIPVDERMRVIDGNGKLVPHLYCIGDANGKLMLAHAASAQGISVVEQVTGRDHVLNHLSIPAACFTHPEISMVGLTEPQAREKAEKEGFKVSIAKTSFKANTKALAENEGEGLAKMIYRPDNGEILGVHIFGLHAADLIHEASNAIALGTRIQDIKLAVHAHPTLSEVVDELFKAAKVDSPASVTAQSVKVTV

SEQ ID NO: 46529 - protein, 418 aa, Mesorhizobium sp. BNC1
MSAFIGRVGRAAQALRDLFPETPLQKNDYLSRKTGARVFLKREDLTPVRSYKLRGAFNFMRKAIAAGAGADGFVCASAGNHAQGFAYACRHFSRKGVVFMPVTTPQQKIEKTMLFGGEWIEVRLVGDFFEDCYEAAKEFADTNHALMVPPFDHSDIIEGQATVAQELADQLGKGLEGATIILPVGGGGLAAGITAFLQESGIGARYAFAEPAGAPSLALSLSAGKRVKLPQVDNFVDGAAVAEIGREPFKRLKNFSAQDVHKIPENRLCSTILEMLNIEGVVLEPAGALAIDALKDFSRREIRGSTIVAVVSGGNFDFERLPDVKERSLRFEGLKKYFIFRFPQRPGALRDFLDLLGPDDDITRFEYLKKSARNFGSVLIGIETKDPRNFALLGRRFDEAGWGYQDITQDETIANLLI

SEQ ID NO: 46530 - protein, 486 aa, Rhodobacter sphaeroides 2.4.1
MIEKRDFYINGGWTAPAEARDCEVIDPSTEEACAVISLGDQADTDAAVAAAKAAFEGWAATPPAERLRLVKGILAQYEARKEEMAQAISLEMGAPIDLARNSQAPCLPWHLTNFLKAFEEIEWVRPLGPHAPNDRIALEPIGVVGLITPWNWPMNQVTLKVIPALLAGCTCVLKPSEEAPLSSLLFAEFVHDAGLPAGVFNLVNGDGAGVGTQLSSHPDVEMISFTGSTRAGRAISKAAAESLKRVTLELGGKGANLIFADADERAVERGVKHCFNNSGQSCNAPTRMLVERPLYDRAVEIAAEVAAKTRVASAHEEGPHIGPVVNKRQFEQIQSYIQKGIDEGARLVAGGLGRPDGLNRGFFVRPTVFADVTPGMTIEREEIFGPVLSILPFETEEEAVRIANDTPYGLTNYVQSEDGARRNRLARRLRSGMVEMNGKSRGAGAPFGGVKASGRAREGGVWGIEEFLEVKAISGWDPEAEALAAE

SEQ ID NO: 46531 - protein, 218 aa, Zea mays
  misc_feature (200)..(200): Xaa can be any naturally occurring amino acid
  misc_feature (203)..(203): Xaa can be any naturally occurring amino acid
MQGASHMLLEEPFRLASVLSPAKPKVFPSLTKIVGTLGPNSHSVEIIQECLTAGMSVARFDFSWMDAAYHQETLDNLRKAAQNVKKLCPVMLDTLGPEIQVHNSTGEPIELKAGNHVIITPDISKALSAEILPIKFGDLAKAVKKGDTLFMGQYLFTGSETTSVWLENAATLAGPIFTLHASQVHINLPTLSEYDKMSFXNWXSCNSVDIISLSHTRS

SEQ ID NO: 46532 - protein, 234 aa, Triticum aestivum
MSSSFCEWEKTNGIVHLKLTGADGHHYLTDEGLKELCSELAKIREDAASEPCRALITTSSPGSFCDGIDYDDLKRSMNPAEQAKALSDGMAVVIKELLEMPMLTVCAATGDAASLGLALALAHDDLVVLSDASYRLGMVEDGVAVQPHIASLVREKTDRWYTLTTLKSRWRSGNWMRKWYFADCEAGTPDGVLVEAQKLVEEWAGSDGEVHADMRKQLYRESWNAVSVPQLVPE

SEQ ID NO: 46533 - protein, 311 aa, Candidatus Arsenophonus triatominarum
GINGFGRIGRIVFRAAQERKDIEIVAINDLLDANYMAYMLKYDSTHGRFNGTVEVKDGHLVVNGKTIRCTAERDPANLKWNEVGVDVIAEATGIFLTDETARKHIAAGAKKVVLTGPSKDDTAMFVMGVNHSTYSGQDIVSNASCTTNCLAPLAKVINDKFGIEGLMTTVHATTATQKTVDGPSAKDWRGGRGASQNIIPSSTGAAKAVGKVIPELNGKLTGMAFRVPTPSVSVVDLTVRLNKPATYIEICQAIQQAANGELKGILGYTEDDVVSTDFNGDKLTSIFNAKAGIALNDSFVKLVAWYDNESG

SEQ ID NO: 46534 - protein, 460 aa, Mesorhizobium sp. BNC1
MQFAPTHGVERERENRLTKDNILPSGGFADLGISETLLKAAAAAGMTEPKPIQKEAIPPFLAGSDILGVAQTGSGKTAAFSLPILSKIIGLGTKRRPRTARALILVPTRELAVQIEKVVRELAKGAHVSTALVLGGVSRHSQIKRMAQGVDVLIATPGRLTDLVRDGAVVLSETTWLVLDEADRMLDMGFINDVRRIAKATHPARQTALFSATMPREIEALASSLLKEPVRIEVSPQGTTAAEIRQSVIMARTKQKRKLLSEMLADEKMAQVIIFSRTKHGADRVTKDLQHDGFQAAVIHGNKSQNARQRALNDFREGAVRILVATDIAARGIDVPGISHVVNFDLPDEAESYVHRIGRTGRNGAEGEAITLCDPGEVSKLRQVERVIRNRLPIARDITGQPDSAPKPRVPSAIQPLAEGVEGKPQRNAAPKRSGAKPPRHRRNRRGQKGGAQRPTSKAA

SEQ ID NO: 46535 - protein, 530 aa, Arabidopsis thaliana
DGAAKRISFQFQCVTWKLEKALGDLTYDRYDISDEVREQVELARLQLRRAMQRYGSLNSKKFSSGLSEPMEKDASSNRKVIEKLESIPETVHSLSDEKKFESPPPWKSSSVSLAFFLSKDGDDERLEKAVTENSDDSQKSDNLTIPEDFLCPISLELMKDPAIVSTGQTYERSFIQRWIDCGNLSCPKTQQKLENFTLTPNYVLRSLISQWCTKHNIEQPGGYMNGRTKNSDGSFRDLSGDMSAIRALVCKLSSQSIEDRRTAVSEIRSLSKRSTDNRILIAEAGAIPVLVKLLTSDGDTETQENAVTCILNLSIYEHNKELIMLAGAVTSIVLVLRAGSMEARENAAATLFSLSLADENKIIIGASGAIMALVDLLQYGSVRGKKDAATALFNLCIYQGNKGRAVRAGIVKPLVKMLTDSSSERMADEALTILSVLASNQVAKTAILRANAIPPLIDCLQKDQPRNRENAAAILLCLCKRDTEKLISIGRLGAVVPLMELSRDGTERAKRKANSLLELLRKSSRKLGSL

SEQ ID NO: 46536 - protein, 346 aa, Mesorhizobium sp. BNC1
MYQTVIEAIGNTPLIRLKRASEETGCEIYGKAEFMNPGQSVKDRAGLFIIRDAEKRGLLRPGGVIVEGTAGNTGIGLTVVAKALGYRTVIVIPDTQSQEKKDALRILGAELIEVPAVPYKNPNNYVKVSGRLAEQLARTEASGAIWANQFDNVANRDGHIRTTAEEIWRQTGGKVDGFVSAVGTGGTLAGVSAGLKARNPDVKVALADPLGAALFSYYTAGELKSEGSSITEGIGQGRITANLEDFQPDFSFQIPDEEALPIIFSLVQEEGLCLGGSTGINIAGAIRMARELGPGHTIVTILADYGTRYQSKLFNPAFLREKKLPVPAWMEGRSEIPVPFEQVAAS

SEQ ID NO: 46537 - protein, 829 aa, Solanum lycopersicum
MSGRRSSYTLLNQIPNDNFFQPPAPKFSAGAGVLPYGESSSAEKNRGKVFDLDLMDQRMMQSHNRVGSFRVPGSIGSQKQSTEGSFRGSSLSGENYVGTSFGHKNEGCGSSVARNWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLKAVDPSKAPSVEVILIVRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLVNGPFSISIPSPLRFPRYRQVEPTTDFRSLAKQYFLDSQSLNLLFDDSSAGAAADGDAGQSDRSCIDRNNVVSSSSNRDEISQLPPPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLVLMEKIGAGSFGTVHRGDWHGSDVAVKILMEQDFHAERLKEFLREVAIMKRLRHPNIVLFMGAVIQPPNLSIVTEYLSRGSLYRLLHKPGAKKVLDERRPLCLAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKKLDIPSVLNPRVAIIIEACWANEPWKRPSFSTIMDMLRPHLKSPLPPPGHTDMQLLS

SEQ ID NO: 46538 - protein, 452 aa, Glycine max
MATHAALASTRIPSNTRFPSKASHSFPTQCALKRLEVTEFSGLRSTSCVTYANSARESSFFDLVASQLTPKQTNGSTPVRGETVAKLKVAINGFGRIGRNFLRCWHGRKDSPLEVVVVNDSGGVKNASHLLKYDSMLGTFKADVKILDNETITVDGKPIKVVSSRDPLKLPWAELGIDIVIEGTGVFVDGPGAGKHIQAGAKKVIITAPAKGADIPTYVVGVNEGDYTHQISNIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAAKAGSGDPLEEFCETNPADEECKVYE

SEQ ID NO: 46539 - protein, 383 aa, Oryza sativa
MQLLGAPPPVLPSGSAAPTNTPATAAAEEEEEESLLEGHKAAREWAQVHGQHEGRTWAVGSGAAATLGQSNGRDAPARAEDGSFGLVLLLFVPHLLLHARLWLLPPTFASQPQQFSQVTSAAESRRVELDLDATTSFFGVYDGHGGAEVAMYCAKRFHTMLLEDVDYINNLPNAITSDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVWDGMRNNNVVQFVRQELRPGEENLRETCEKLVGHCLHSNDNATAILVKFKPIEDPDEVASARDEHQHNPEGGDEKLDINNDND

SEQ ID NO: 46540 - protein, 332 aa, Arabidopsis thaliana
MATSTTMSHQAIGSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISNIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 46541 - protein, 589 aa, Shewanella sp. ANA-3
MEESSLLTSVLLFLLAAVIFVPLGKRFGAGPILSYLAAGVILGPGGMALVSDPAAVLHFAELGVVLMLFVLGLELNPSKLWELRSAIFGLGSGQLLLSWAAIGGLAWGFGLSIEAALVVGAALSLSSTAFAVQLMSEHRLLTTPLGRDAFGVLLMQDLAVIPMLLLTAYLAPNSAQIEHHAVPWYWTSVALVGFVLVGKYLLPRLLKLVASSGVREVLTAFALLLVMGSAELMEWLGLSAGMGAFLAGIMLANSSYRHQLETDIEPFKGLLLGLFFMAVGMSMDLKLFLTDPLLILAILLGMLLIKTLVLMLLGRLRHHAWRPSIALGLILAEGGEFAFVLLSQAQLSSIVDDKIAQILVLAIGLSMAVTPMIFTLFRATKPKVVDTRLPDTINVTESEVVIAGFGRVGQITGRILASSGIPFVALDKDASHVDVIRKYGGEVYFGDARRLDMLMSAGIARSRLLLLAVDNVEDSIEIAQQVKTHFPHINIVARARDRNHAYRLMSLGVTDVFRETFGSALSASEKILQGLGLSQVQANERVKIFAEHDKKLVIASSAHQHDLAKLLDLSNKGKAELESLMRGDRENVS

SEQ ID NO: 46542 - protein, 342 aa, Gibberella zeae PH-1
MSTTNSGQESEKVNTNIVTLTRFLTEEQAKHPEATGDFTLLCHALQFSFKSIAYYIRRATLVNLTGLAGSSNITGDDQKKLDVISNDLFIEAMRSSGKCALLVSEEEDEIIYFKDASDARYAVACDPIDGSSNLDAGVSVGTIFAIHKLPEGSKGCKEDILKPGTELLAAGFTMYGASAQLVITMRGGTVNGFTLDNGVGEFILSHPNMRLPKSRDIYSCNEGNSLYWDDKTINYFNSLKQAQENGKPYSARYIGSMVADAYRTLLYGGIFAYPADKKSPKGKLRILYECAPMALIFENAGGQAVDSKMNRLLEVVPEHIHDKAGIFMGSYDEVEKVKKFHQ

SEQ ID NO: 46543 - protein, 208 aa, uncultured archaeon GZfos37B2
MILLYDAADREGETDFMIPARSIRPQDIAEMRIYGGGLLCAVIPDTAAERLGLPFAADILRRLPDLAHLAEGDLHYDTRSSFSLWVNHRDTFTGIPDRDRALTIHKLDEIVESALHGDMVDFSSEFRSPGHVAVLRGAKDLLKERKGQTELSIALAELAGINPVLCICEMLDSETGYALTKEDAKKYAMKNDMVFVEGGEVVSGYEKG

SEQ ID NO: 46544 - protein, 337 aa, Sulfitobacter sp. EE-36
MGHRSDLTRAARLSVAPMMDWTDRHCRYMHRLFSKQTLLYTEMVTSPALVRGGALHLLDHDTSEHPVALQLGGSDPDELAEAARIGAQAGYDEINLNVGCPSDRVQSGCFGAVLMEQPALVAKSVAAMRRAVDVDVTVKCRIGVDDQNPAEVLPEFLAQIVGAGCERVTIHARKAWLQGLSPKENRDIPPLDYELVHRMKGLFPNLHISINGGITSLDQAEAFLDAGLDGVMIGRSAYHNPTDILAQADRRIYGTGADTTPEDVVAQMLPYIDAHIDGGGKLNQITRHMMGLFAGRTGARVWRRTLSEQASRPGADRQVLLEALDTMQTLAEAQEAV

SEQ ID NO: 46545 - protein, 540 aa, Burkholderia thailandensis E264
MTLNSLPVWPALQAHYEEIRDAHLRDWFAPANDRAPTRAERFTFEGGGLAADFSKNLITDATLALLVRLAREAGVEARRDAMFAGETVNPTEGRAALHTALRANSPDAPFHAQVAAERAKMARFADAVRAGAWTGYTGKRIRHVVNIGIGGSDLGPKMVVHALHHVATPDIATHFVSNVDGADLARVLERIDPQETLAIIVSKTFTTLETMTNARSLREWFVANGCPEDALAKHFVGVSANPAEVVKFGIAEANVFEMWDWVGGRYSLWSAVGLSIMIAIGPERFAELLAGAHDMDEHFRTAPLERNLPVLQGLVGIWYRNFFGAQSYLVAPYSEALHYLPSYLQQLEMESNGKSAQIDGAFVDYPTSAVTWGEPGTNGQHAFFQMLHQGPTLVPIDFIAVLTPEHPLASHHPKLLANCFAQSEALMLGRTLDEARKIAGPAHPELAPHLTFPGNRPTTTLLVDALTPRTLGALIALYEHKVLVQAAVWNINPFDQWGVELGKILGKVVEADLTAPQVDPAKHDSSTSALIARARKALGE

SEQ ID NO: 46546 - protein, 806 aa, Solanum lycopersicum
MSGRRSSYTLLNQIPNDNFFQPPAPKFSAGAGVLPYGESSSAEKNRGKVFDLDLMDQRMMQSHNRVGSFRVPGSIGSQKQSTEGSFRGSSLSGENYVGTSFGHKNEGCGSSVARNWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLKAVDPSKAPSVEVILIVRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLVNGPFSISIPSPLRFPRYRQVEPTTDFRAAADGDAGQSDRSCIDRNNVVSSSSNRDEISQLPPPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLVLMEKIGAGSFGTVHRGDWHGSDVAVKILMEQDFHAERLKEFLREVAIMKRLRHPNIVLFMGAVIQPPNLSIVTEYLSRGSLYRLLHKPGAKKVLDERRPLCLAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKKLDIPSVLNPRVAIIIEACWANEPWKRPSFSTIMDMLRPHLKSPLPPPGHTDMQLLS

SEQ ID NO: 46547 - protein, 324 aa, Anaplasma phagocytophilum HZ
MRVTVLGAGAFGTALSVALYNSCCSVALWSRNKRVLEELRNTGMNSLYLPGCLVPKEIELIPDVESALKCASVLLLCVPTQELRNLCNDVRNTAALDASVPVLVCSKGIENKSLKFAGEVIEELLPDNPVFVLSGPALAKEMVRGLPCAMVLAGRDESLAASLAEKLSSAVMSIAPSTDYVGVQIGSVLKNIIAIACGIVIGKGLGYNASAMVVVRGIAEIQAVSTAKSESVDLSTIIGLACLGDLVLTCTSASSRNMSFGLAIGKGQDIASRNDSLVEGAESAQSIDRLSNTLGIHLPVCSAIAKLLRGELDTDQVINQLLFA

SEQ ID NO: 46548 - protein, 316 aa, Picrophilus torridus DSM 9790
MQAEILESLREAYGDELARLGSKNRNIVVLDADLSSSTKTEIFWKSFPDRFFNMGISEQSMVTTAAGLALSGKKVFASTFAVFLSRTYEQLRQSICYNNAPVNFVVTHSGISVGEDGPTHQMLEDVGIMSGLPNMHVIVPADSVETRKVIDYLADYGDSPHYVRLTREKFPVIYSNDYEFIEGKASTLNDGNDITIIAYGIMVSFALRAADLLKENNISARVINMSSIKPIDRDVIIKAARETGRIITAEEHSIYNGLGSRVAEIIAENQYARLKRFGMNDTFGKSGKGMELFDYFHIGYKDLFNTAMNMVNGDKR

SEQ ID NO: 46549 - protein, 596 aa, Vitis vinifera
MEGKRLEYRGEEALKELEKFTAKADEVQENILKEIIARNCETEYLKKYMGGSKDVLEFKQSVPVITYKDIHPYIQRIANGEDSSLISGHPITEMLCSSGTSGGEPKMMPSIAEDLNRRTFLYNLIMPIMNQYIPGLDEGKAMFLYFVKAEMSTPCGLPARAVLTSYYKSKNFRCRVRDAFNDFTSPDQAILCTDSNQSMYCQLLAGLVHRHQVLRLGAVFASALLRAISFLERHWVHLCNDIRTGHLDSSITDPECRSSMSTILSSPNPHLADEIEEICSHPSWKGMLSQLWPRAKYIEAVITGSMAQYIPSLEYYSGGKLPLVCTMYASSECYFGVNMKPLCDPADVAFTLLPNMCYFEFIPLGENGTLLMDMDEEKGVPKEKLVDLVHVRLGCYYELVVTTFAGLNRYRIGDVLQVTGFHNRAPQFRFICRRNVVLSIDNDKTNEEDLHRSITMAKKLLEPYNALLVEYTSYADTSSLPGHYVLYWEITHCISTDSPSTPLDSKVLEECCIAVEEELDYIYRRCRTHDKSVGPLEIRLVQPGTFEDLMDLFISQGGSINQYKTPRCIKSSNALKLLNSNVEASFFSPRDPRWIP

SEQ ID NO: 46550 - protein, 461 aa, Populus trichocarpa
MSPTQLLSTSISSSSSAFLAAPIAFKARNQNVSIASKTPSICTCAAAPQEQKTVYKTQVSRNANIAKLQAGYLFPEVARRRNAHMLKYPDAKVISLGIGDTTEPIPEVITSAIAKRAEALSTLEGYGGYGPEQGEKPLRTAIASTFYSGLGIEEDDIFVSDGAKCDISRLQMVFGANVTMAVQDPSYPAYVDSSVIMGQTGQFQKDIEKYGKIEYMRCTPENGFFPDLSKVSRTDIIFFCSPNNPTGSAATREQLTQLVQFAKDNGSIIVYDSAYAMYMSDDNPRSIFEIPGAKEVALETSSFSKYAGFTGVRLGWTVVPKQLLYSDGFPVVKDFNRVVCTSFNGASNICQAGGRACLSPEGLKAMSEVIGFYKENSNIIMDTFNSLGFNVYGGKNAPYVWVHFPGQSSWDVFSEILEKTHVVTTPGSGFGPGGEGFVRVSAFGHRENVLEACRRFKQLYN

SEQ ID NO: 46551 - protein, 171 aa, Picrophilus torridus DSM 9790
MVKIGRNVFIADTAVIIGDVTIGDNVTIMDSCVIRGDQNSIIIGDNTNIQDNATVHTSLRDKTIIGRNVSIGHNAIVHGSTVDDLVLVGMGAILMNGSHIRSGSVIAAGAVVTEGFESPENALVAGLPARVIKTDEKYRKMAEENSREYLILNKRHLNHEFDVVKGKTCRD

SEQ ID NO: 46552 - protein, 145 aa, Cucumis sativus
MADEFQESDLFFSDPRDHCRHLRRDDDDFFNFNFNSNSNSRRGVLAPPRTKYHHRTMRDACVRLSKKEISRSLPVRIPERNLHRTLEEDDDMDEDEIIPPHLVAERRVARKMAFSVCTGNGRTLKGRDLSRVRNSVLRLTGFLET

SEQ ID NO: 46553 - protein, 149 aa, Zea mays
  misc_feature (41)..(41): Xaa can be any naturally occurring amino acid
  misc_feature (54)..(54): Xaa can be any naturally occurring amino acid
  misc_feature (57)..(58): Xaa can be any naturally occurring amino acid
  misc_feature (60)..(61): Xaa can be any naturally occurring amino acid
  misc_feature (63)..(63): Xaa can be any naturally occurring amino acid
  misc_feature (79)..(79): Xaa can be any naturally occurring amino acid
  misc_feature (92)..(92): Xaa can be any naturally occurring amino acid
MANPAPATGGKSFLQAMSTVTEERRCTRVVRWRTGCPEIIXHCEEFAPALVTGXLLXXDXXSXLKVTNCFPFPFGEDDXEPNANGANFHLEXLRAWREGYCQHTPVGGDQPGWLGSFQTLGGVETFLKLSGKLPGEAGGSGEPPLGLLR

SEQ ID NO: 46554 - protein, 221 aa, Glycine max
  misc_feature (205)..(205): Xaa can be any naturally occurring amino acid
MAVDLTPRQPAKAYGGDGGAYYEWSPAELPMLGIASIGAAKLALAAGGMSLPSYSDSAKVAYVLQGKGTVGIVLPEATKEKVVAVKEGDALALPFGVVTWWHNTPESATELVVLFLGDTSKGHRPGQFTNFQLTGASGIFTGFSTEFVGRAWDLKEDDAAKLVSSQPASGIVKLTAGQKLPVPVDADRKDMALNCLEAKLDVDIXTGGRVVVLNTGNPAAG

SEQ ID NO: 46555 - protein, 382 aa, Anaplasma phagocytophilum HZ
MGSNDYYDLLGVSRGASEEEIKKSYRKKVFEYHPDRNPGNKEAEEKFKKISEAYDVLTDSDKRAAYDRYGHSAFANGMGGNQGFTGGFDGGFSTDFSDIFNDFFGGGFGKTSRQSSRENMRGSDLRYDIEVTLEDAFKGVKVPISYVTHVQCSHCSGSGGEGTAKSVKCGTCNGAGRIRTRKGFLTIEELCHTCSGEGEVVKNKCKRCAGSGRVRNEVGILVTVPRGIENGNKVRVNGKGEAGYRGARSGDLYVYVVVKDHKFFTRRGMDLYCNVPIKMTLAALGGEIEMPSIDGTWTKLKIPEGTQSNDKLRMRGKGMPDIQGGERRGDMYVQVTVETPVKLTKKQEELLKQFEDESNANSSPKFSGFFQKIKGIWKDISS

SEQ ID NO: 46556 - protein, 637 aa, Ralstonia metallidurans CH34
MTYTLLNKIDDPADLRKLDRRQLDTLAEELRAYVLESVSQTGGHLSSNLGTVELTIALHYVFDTPNDRVVWDVGHQSYPHKILTGRRDRMSTLRQYGGISGFPRRAESEYDTFGTAHSSTSISAALGMALGARTRGEKRVGIAVIGDGAMTAGMAFEAMNNAGVYKDLPMLVVLNDNDMSISPPVGMLNKHLARLMSGQFYAATKKGIEKVLSVAPPVLEFAKRLEEHAKGMVVPATLFEEFGFDYVGPIDGHDLESLVPTLQNIRQRALEGHGPQFLHVVTKKGQGYKLAEADPILYHGPGKFNPAEGIRPSAKPSRKTYTQVFGEWLCDMAAADKRLIGVTPAMREGSGMVEFEKRFPDRYYDVGIAEQHAVTFAGGLACEGLKPVVAIYSTFLQRGYDQLIHDVALQNLPVVFALDRAGLVGADGATHAGVYDIPFLRCIPNMMVMVPADENECRQLLTTAFQQDCPTAVRYPRGAGVGVATQPELTALPVGKGEIRREGHARAGQRVAIMAFGSMVHPALTAAEQLDATVANMRFVKPLDVELVKQLAANHDFLVTVEEGATMGGAGSAVLEALAEAGIELPTLVLGLPDKFIDHGDPAHLLSLCGLDAAGIERSVRERFSLTAQPVKVASVA

SEQ ID NO: 46557 - protein, 74 aa, Cucumis melo
MDSDQGKLFIGGISWETSEDKLKDYFSNYGEVMHTVVMRDKITSRPRGFGFVVFSDPSVLDRVLQDKHTIDGKT

SEQ ID NO: 46558 - protein, 294 aa, Ralstonia metallidurans CH34
MSDFATWMRAQGARTEAALEAALPSTDTIPYTLHEAMRYAVLGGGKRVRPLLVHAAGEVVGATPEACDAAACAVEMIHAYSLVHDDMPCMDDDDLRRGRPTVHKAYDEATALLVGDALQSQAFIVLAQTPALAAEARLKVVAELAVASGSIGMCGGQAIDLQNVGKAMTREALEGMHRMKTGALLRASVRMGALCGNIDQAGLVALDRYAAAVGLAFQVVDDILDVTADTATLGKTAGKDAANDKPTYVSLLGLDAARELAAQLRTDAHEALEGFGTRAGRLAELADLIVLRSN

SEQ ID NO: 46559 - protein, 572 aa, Staphylococcus aureus subsp. aureus MW2
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDMIIVDGLNGDVIVNPTEDELIAYQDKRERYFADKKELQKLRDADTVTVDGVHAELAANIGTPNDLPGVIENGAQGIGLYRTEFLYMGRDQMPTEEEQFEAYKEVLEAMDGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 46560 - protein, 311 aa, Escherichia coli K12
MALPILLDCDPGHDDAIAIVLALASPELDVKAITSSAGNQTPEKTLRNVLRMLTLLNRTDIPVAGGAVKPLMRELIIADNVHGESGLDGPALPEPTFAPQNCTAVELMAKTLRESAEPVTIVSTGPQTNVALLLNSHPELHSKIARIVIMGGAMGLGNWTPAAEFNIYVDPEAAEIVFQSGIPVVMAGLDVTHKAQIHVEDTERFRAIGNPVSTIVAELLDFFLEYHKDEKWGFVGAPLHDPCTIAWLLKPELFTSVERWVGVETQGKYTQGMTVVDYYYLTGNKPNATVMVDVDRQGFVDLLADRLKFYA

SEQ ID NO: 46561 - protein, 182 aa, Zea mays
  misc_feature (13)..(13): Xaa can be any naturally occurring amino acid
  misc_feature (43)..(43): Xaa can be any naturally occurring amino acid
  misc_feature (157)..(157): Xaa can be any naturally occurring amino acid
MRRTTVIKSSGCXPLRALTTDILGLVKMVEGHVRAVLAFNVDXTWGEPDTSRAIVAGSLVYRVVEPVLLVLRMKAVMDLLNPLNGSALAGVTTSLSAPNDRVAECDDLAILHFFTSQTSDSILGTFLVCTQKGKVSITAITKENADSVSNVGPSPTXDVCNAANVQFCSADHGKSYVIFGGK

SEQ ID NO: 46562 - protein, 78 aa, Photorhabdus luminescens subsp. laumondii TTO1
MSTIEERVKKIIVEQLGVKEEEVVNSASFVDDLGADSLDTVELVMALEEEFDIEIPDEEAEKITTVQAAIDYVQNQSE

SEQ ID NO: 46563 - protein, 314 aa, Zea mays
MAASNIGMMDGAYFVGRNEILAWINTTLHLGLSKVEEAASGAVACQLMDAAHPGAVPMHKVNFDAKTEYDMIQNYKVLQDVFNKLKITKHIEVNKLIKGRPLDNLEFMQWMKRYCDSVNGGFMSSYNASERRESSKGGKGTTRRASVPSHTPAKSASPGPKAQASHGAKRASGQTAGAPQRSAKPSPAASSGGPAYDEQITELKLLVDSLEKGRDFYFSKLRDIEILCQNPEVEHVPVHAIQNILYTSEEDPQQQAPALSPIMEASGGGPKQEAAPKRKSISALDEFGMSSSSRQGLSAFSDGQLWGSPLTSFS

SEQ ID NO: 46564 - protein, 161 aa, Synechococcus sp. RS9916
MQLRIGNGYDMHRLVPGRPLILGGQQLEHPAGLGLDGHSDADVLVHAIMDALLGALSLGDIGKYFPPDDPQWKGADSLVLLEQVVALVAKRGWQVVNVDSVVIAERPKLKPHIEAMRSAIADRIGIEPERVGVKATTNEKLGAEGREEGISCQAVALLQAE

SEQ ID NO: 46565 - protein, 361 aa, uncultured archaeon GZfos37B2
MINMNEFEKELAKRGDLVYEYLASARYQERFAPEVIHDSVYLYLDGRRGKSLRPAVLLFSCGAAGGDEEIAIPAAAATEVFHTWTLVHDDVIDRDCMRRGGYTVHEEFRRRGVDLGYDGDKAAHYGTSLAILAGDVQQGWSVSLLSELAERGVDPAVVLHLIRMMETDVVIMLLSGQIFDVQYSKAPIESLSEAKILGMLWRKTGALYEFAGAAGAMIGLSTTNRENELVRSISQFTGRCGTAFQLQDDILGVVGDTKKLGKTVGSDIREGKRTLIVYHAFTHADEAQKRCMSRILGNKNASDEEISEVVDILSELGSIEYTRALADSYIEEAKEQIETIPGSRYKDLLLAWAEYMVSRES

SEQ ID NO: 46566 - protein, 149 aa, Bacillus subtilis subsp. subtilis str. 168; identical to SEQ ID NO: 1189

SEQ ID NO: 46567 - protein, 402 aa, Synechococcus elongatus PCC 7942
MSKRTLASLTAADLEGKRVLVRVDFNVPLDGNGKITDDTRIRAALPTIRYLSESGAKVILVSHFGRPKGKPVESMRLTPVAERLSELLGRPVVKTTDAVGAGAEAQVAATSNGQVVLLENVRFHAEEEANDAEFAKALASLADIYVNDAFGAAHRAHASTAGVTEYLSPCVAGYLLEKELQYLQAAIDNPQRPLAAIVGGSKVSSKIGVIETLLDKCDKLLIGGGMIFTFYKAQGLSVGGSLVEEDKLDLARSLMAKAQEKGVQLLLPVDVVVADKFAPDANAKTVAIDAIPDGWMGLDIGPESVKQFEEALADCRSVIWNGPMGVFEFDQFAVGTEAIARSLAGLTRKGATTIIGGGDSVAAVEKVGVASEMSHISTGGGASLELLEGKVLPGVAALDDAA

SEQ ID NO: 46568 - protein, 233 aa, Bacillus subtilis subsp. subtilis str. 168
MQDSKEQRVHGVFEKIYKNYDQMNSVISFQQHKKWRDKTMRIMNVKEGAKALDVCCGTADWTIALAKAAGKSGEIKGLDFSENMLSVGEQKVKDGGFSQIELLHGNAMELPFDDDTFDYVTIGFGLRNVPDYLTVLKEMRRVVKPGGQVVCLETSQPEMFGFRQAYFMYFKYIMPFFGKLFAKSYKEYSWLQESARDFPGMKELAGLFEEAGLKNVKYHSFTGGVAATHIGWK

SEQ ID NO: 46569 - protein, 516 aa, Synechococcus elongatus PCC 7942
MSSQSFIAFVSPADSHNQLLIDRVHPQDWINPEPADCYDLVVIGAGTTGLVVAAGATGLGLGLKVALIEKQLMGGDCLNFGCVPSKALIRSSRVIGELQRANTLGIQVAPEAIAVDFAAVMERLRKVRAGMSVHDSAQRFQALGVDVFLGQACFCDRNTIQVGEATLKFRKAVIATGARATYPNIEGLEASGFLTNETVFSLSNCPRRLAVIGGGPIGCELAQAFQRLGSQVTLFQRRSQLLPKEDFEAAEVIQNQLRADGVQVCLSAEITRIERTASGKLITFRQEGRESVLEVDEILVGTGRSPNVQDLNLEAVGVDYDSVHGVKVNDYLQTTNPKIYAAGDVCSPWKFTHAADAAARIVIKNALFSPFGLGKSKVSDLIIPRVTFTDPEVAHVGLSETAARHQGIAIATITIPLDQVDRTVLDGETAGFIRIHHQPNSDKILGATIVAPHAGEMISEVTTAIANQLGMSALSSVIHPYPTQAEGIKKAADNYRRTLLTPMTKQLLKLLMIFSK

SEQ ID NO: 46570 - protein, 320 aa, Streptomyces avermitilis MA-4680
MSPRQITVLGECVADAFTEPANASNELALRVLPGGGPANTAVALARLGTPARFLARLSGDVFGRLFRAHLEESGVDLSYAVAAAEPSTLAVAELDATGQAAFSFHAQNTADWQWTPGELAGVDLSETACVHTGSLALVREPGGAAVEEFLAAAAPRATISIDPNVRPLLVRPEVYRARLAHWCALADILRLSEDDLELLLPGTPPEQACDIWHAAGVRLVVITLGAGGALASLDGERLRVPAVATRVVDTVGAGDSFTAGLLHHLGARGLLGGRLTDLGLDEVAEACRFGARVAALTCSVAGPNPPWRDQLAQLTTAGGA

SEQ ID NO: 46571 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFEVARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 46572 - protein, 153 aa, Staphylococcus epidermidis ATCC 12228
MNFEGKLVGKDLKIAIVVSRFNDFITTRLLEGAKDTLIRHEVEDTNIDVAYVPGAFEIPLVAKKLAQKGEYDAVITLGCVIRGATSHYDYVCNEVAKGVSKANDISDTPVIFGVLTTESIEQAVERAGTKAGNKGSEAAVSAIEMANLIKQIN

SEQ ID NO: 46573 - protein, 323 aa, Pediococcus pentosaceus ATCC 25745
MDLFEGLKSKIKGQNRTVVFPEGEDVRVLAAAIRLADDGLVQSILLGVEADIKATAEKHGLNLENVQIIDPSQYPEADQKEMIDKLVERRKGKNTEEQVIEMLKDVNYFGTMLVYLGKADAMVSGAVHATGDTVRPALQIIKTKPGMRRISGAFIMQRENERYVFGDAAINIDPDAETLAEIAIQSAETARLFDIDPKVAMLSFSTKGSAAGPMVDKVREATKVAQERDPKTPYDGELQFDAAFVPAVGASKAPDSEIAGHANVFIFPELQSGNIGYKIAQRLGGFEAIGPILQGLNAPVSDLSRGASEEDVYKVAIITAAQV

SEQ ID NO: 46574 - protein, 393 aa, Staphylococcus epidermidis ATCC 12228
MQFDTIELAIEALRNGESIIVVDDEDRENEGDLVAVTEWMDDNTINFMAKEGRGLICAPIDKSIAERLKLQSMEQNNTDIYGTHFTVSIDHYKTTTGISAHERTQTARALIDENTNPEDFHRPGHLFPLIAKENGVLTRNGHTEAAVDLARLTGAQPAGVICEIMNDDGTMAKGEDLQSFKERHHLKMITIKSLVAFRKAVELNVNLKAKVKMPTDFGHFDMYGFTTDYSDEEIVAIVKGDLKSNPNVRMHSACLTGDIFHSQRCDCGAQLEASMKYIDEHGGMIIYLPQEGRGIGLINKLRAYELIEKGYDTVTANLALGFDEDLRDYHVAAEILKYFDISEINLLSNNPKKFEGLEDYGIEIVDRIELIVPETQYNHSYMETKKNKMGHLI

SEQ ID NO: 46575 - protein, 295 aa, Sinorhizobium meliloti 1021
MTDKRKVRKAVFPVAGLGTRFLPATKAVPKEMLTVVDKPVIQYVVDEALEAGIEHLIFVTGRSKAVIEDYFDIQVELDQTLRERNKKAEIELLEAMLPKAGTTSFTRQQAPLGLGHAVWCARDLVGNEPFALLLPDMIMKGEKGCLKGMVELYEESGGNVVAVEECAPDQAHKYGIVGVGETVGDGFRITRMVEKPAKGTAPSNFFINGRYILQPEIFPILETQERGAGNEIQLTDGMVKLAEAQPFAAYHFRGDTYDCGAKDGFILANVAFALERGDIRPIVEGPLKTLLQGLK

SEQ ID NO: 46576 - protein, 155 aa, Brassica napus
MKNVMVVIDESNSSYDVLVWVLQNLKAISDSNKLLIFAKQPQSSVTPISLSSSVAFAQLFYPFSPSGEFIRLAQQKNMKIALGILEKAKKICGNHGIKADTFTDVGDPNEPIHKIIQERKVNLLVMSDQQNQSLKKCLHNTYCSLLVVEKGIRIN

SEQ ID NO: 46577 - protein, 203 aa, Cucumis melo
MAGEVAVEGAVAVAAAASEVADSNPQSHKLERKWTFWFDNQSRPKQGAAWGTSLRKVYTFETVEEFWCLYDQLFKPSKLPANADFHLFKTGVEPKWEDPECANGGKWTVTSSRKANLDNMWLETLMALIGEQFEESDEICGVVASVRQRQDKLALWTKTATNEAAQMSIGRKWKEIIDVNDKISFSFHEDLRREKSAKARYSV

SEQ ID NO: 46578 - protein, 555 aa, Methylobacillus flagellatus KT
MTNPTNCPIWHDLSAHYQEVLPLQMRDMFTKDGRRFEKFSLEAEGLLLDYSKHRITDETLPLLFKLARDSKVEEWRDRMFAGEKINFTENRAVLHTALRNRSNTPVYVDGKDVMPDVNRVLAQMRKFSTSIRSGEWKGYSGKRITDVVNIGIGGSDLGPVMVCGALKPYAQAGLNAHFVSNIDGTHLAQTLERCDPETTLFIVASKTFTTQETMTNARSARSWFLQAAKDEAHVAKHFVAISTNADEVGKFGIDAANMFEFWDWVGGRYSLWSAIGLSIAIYIGMDHFEELLQGGYEIDRHFKNAPLEQNIPVIMALLGIWYNNFFGADSLAILPYDQGLARFPAYLQQADMESNGKFVARDGRIVQCTTGPIIWGEAGTNGQHAFYQLIHQGNRLIPCDFMMPLQSHYSMGKNGNEHHLILLANCFAQTSALMQGKTLDEAKAELVAQGLTGEALETLLPHKVFEGNRPSTTILFDKLTPKTLGKLIAIYEHKIFVQGIIWNINSFDQWGVEYGKQIAKKILPQLSEDQASTEYDSSTNGLMNYFKSRTQSSGT

SEQ ID NO: 46579 - protein, 391 aa, Francisella tularensis subsp. holarctica
MHNESLISIFVFVMLGILVVTIVLKKLKQPYVVAYLLTGILLGPYGLRLIQDQENLARLGEIGVILLLFFAGMEVSPRKFAENWQVPTIGTMLQMLITSLIVSIIGVALGWSIAKILLFGAVISLSSTAVVLKLLNDSGSMKTRLGQNVLGILLIQDLAVVPMLILVRLIGGEELSISQIVTQILGGILVISIAAIMAVKKNIKISFISVLGKDEEMRVFAALVICFGMAALTESLELSSALGAFVGGIIVSTLEETEWVGHSLSTVKTIFMALFFISVGMLIDLKLFWNHIFLFMALLLLIYSLNTTINALIFKALRQRTEEALIGGAMLSQIGEFSFVLISMGFASGILSLTIYHYCITLISLSLLFSPLWISGVNLYIKKYIKKKPQN

SEQ ID NO: 46580 - protein, 215 aa, Nostoc sp. PCC 7120
MICHSRAKLCLHLLVLIKSHTLAMFSSPFSEDNDNAPNGSITLTDEKGRSLECYVEHSLSVDEQEYVLLLPVDSPIEIFAWEGEDEDEEAVLVEFDDAIIDEIFPTAQAVLAEQNLVLKQTAYALTVAGDLPPVEESELFTLEIEEEEAADLEPEQLQLLANFYHDEQEYAIYTPLDPLLFFAKITKTGQPVLLSPEEFRKVQPLLEEQLFNEVE

SEQ ID NO: 46581 - protein, 96 aa, Oryza sativa
  misc_feature (23)..(23): Xaa can be any naturally occurring amino acid
  misc_feature (79)..(79): Xaa can be any naturally occurring amino acid
DRRYQQTYERPTIMRPIDNSRRXLLNKLKEYNGHDCEVIHEADYFAGEKTEHEDGDTIPTHSNHVTNTLALDDLFPPSXLANLKSMRKGSGSGRTN

SEQ ID NO: 46582 - protein, 322 aa, Francisella tularensis subsp. holarctica
MSEDLMIFSGNASKKLASEVAKELGATLGNATVDRFKDGEIHVVLNENVRGKDVFVIQSTCPPSDNLMELILLIDALKRSSAERVTAVLPYFGYARQDRRSKSARVPISAKVVANLLQAVGLDRILSVDIHAEQIQGFFDIPFDNAFATKIFLEYVRKNPEKYQNIKIVSPDMGGVVRARSVAKNLGVEIAVVDKRRPKPNVAEVMNIIGEVDGKHCILVDDIMDTGGTMCQAAKALIEKGGAAKVSAFCVHPLLSGDAIKNIEDSAIDELIVTDSIPLKPHAEACSKIKVITLAPLLAQIVEKTNGEESVSDIFRTDGLVD

SEQ ID NO: 46583 - protein, 138 aa, Brassica napus
MATMARSFLQAISKDEAVAPPLRVVQIEGLAVLKIIKHCKEFAPTLVTGQLLGLDVGSVLEVTNCFPFPVRDDDEEIEADGANYQLEMMRCLREVNVDNNTVGWYQSTVLGSYQTVELIETFMNYQENIKRCVCIIYD

SEQ ID NO: 46584 - protein, 299 aa, Ralstonia metallidurans CH34
MENRVTKAVFPVAGLGTRFLPATKASPKEMLPVVDKPLIQYAVEEAMAAGITEMIFVTGRSKRAIEDHFDKAYELEAELEAKNKQALLDVVRSIKPANVECYYVRQPEALGLGHAVLCAAKLVGDTPFAVMLADDLLDGGKDLPVMKQMVDIYNHYNCSVLGVEEIAPEQSRSYGVIDGREWDDRVIKMSAIVEKPAPEKAPSNLGVVGRYILTPRIFDHIRELKPGAGGEIQLTDAIQSMLDQEQVLAYRYKGVRYDCGSKLGYLKATVEFALRHPEVRDEFSAYLSQRCTSPSSVPA

SEQ ID NO: 46585 - protein, 319 aa, Synechococcus sp. RS9916
MTPPTSSIHRMVRRGLSALLVPMLLAGLLLSQPEPSHAASGGRIGGGSFRAPSMPRSGGYSRSYGGGYSRGYGGGGIGVPFIVPFFGFGSMGGLLGLFALMAIVGVIANAFRGNGGGAPSMGGYERPEAISGGPVSLVQLQIGLLASAKALQQDLRQLAASADTSSSTGLQRVLQETTLALLRQPDLWVYANLENGNVPFAAAESTFNRLSMTERSKLREELTTNVGGQRSTATASARGVGDADATNEFIAVTVLVASRRPVTLKAIGSSEGLRESLRILGSTSSTDLMALEVIWQPDGAGEVLSAEELVTAYPNLQHL

SEQ ID NO: 46586 - protein, 72 aa, Zea mays
MSIQKIFARTIFDSRGNPTVEVDLTTSKGLFRAAVPSGASTGIYEALELRDGDKANYHGKSVNKAVSNVNDI

SEQ ID NO: 46587 - protein, 668 aa, Oryza sativa Japonica Group
MWKMVDALLRCSALVALVLHFVVNGCSAVNTEGSALLKFQSRVEEDPHGAMAGWSERDGDPCSWNGVRCVDGRVVILDSDWKCSLPIRSRIIVAKCSRNLKDLSLRGTLGPELGSLSHLRALVLSNNLFDGPIPKEMSDLAMLEILDLSNNNLTGEVPQEIAEMQSIKHLLLSNNNFQWPLIQNSYRNFDQEIDFDVYDERGDVYQRSENGFESDSSSEENTKDNNNLSAHLSSQFAARNPTVQLSRRRLLEDTNLAAASANAPVPAVASVPSTGTGSFSAFKEIKVPPPLSPPSSPPMSSGPPQRSKRWLYAIVISSIALLFIGIACMFLLCRNKSVATIGPWKTGLSGQLQKAFVTGVPKLQRSELEGACEDFSNIVASYPHYTVYKGTLSSGVEIAVVSTVIATNKDWSKHSEGRFRKKIDLLSRINHKNFINLLGYCEEENPFMRMMVLEYAPNGTLYEHLHVEGFDHIDWNGRMRVIMGVAYCIQHMHELNPSITHPDLHSSAILLSEDGAAKVADMSVWQEVISKGKMPKNDDIVDHHEPVSADPAGNVCSFGLLMLEIISGRPPYSEHKGSLANLAMECIKDDRNISCLLDPTLKTHKENELEIICELIQECIQSDPKKRPGMREVTTRLREVLAISPEAATPRLSPLWWAELEILSVEAT

SEQ ID NO: 46588 - protein, 263 aa, Zea mays
VVEIVDRYDDACVPAGVTDKLAYIRNDSIPKSCTRNLTITKDMKQPIFVYYQLDDFYQNHRRYVKSRNDAQLRDKSKASDFTNCDPEAKTVDGKPIVPCGLIAWSLFNDTYKLIHNNVTLRVEKKDISWKSDRDHKFGSDVFPTNFQKGPLKGGKTLDPSIPLSKQEDLIVWMRTAALPTFRKLYGRIYVDLKENDTITVQLENNYNTYSFSGKKKLVLSTATWIGGKNDFLGLAYLTVGGICFVLAFAFTLLYLIKPRLVVF

SEQ ID NO: 46589 - protein, 345 aa, Bacillus subtilis subsp. subtilis str. 168
MKKVTMLGAGSWGTALALVLTDNGNEVCVWAHRADLIHQINELHENKDYLPNVKLSTSIKGTTDMKEAVSDADVIIVAVPTKAIREVLRQAVPFITKKAVFVHVSKGIEPDSLLRISEIMEIELPSDVRKDIVVLSGPSHAEEVGLRHPTTVTASSKSMRAAEEVQDLFINHNFRVYTNPDIIGVEIGGALKNIIALAAGITDGLGYGDNAKAALITRGLAEIARLGTKMGGNPLTFSGLTGVGDLIVTCTSVHSRNWRAGNLLGKGYKLEDVLEEMGMVVEGVRTTKAAYQLSKKYDVKMPITEALHQVLFNGQKVETAVESLMARGKTHEMEDLVNTFENQVK

SEQ ID NO: 46590 - protein, 293 aa, Zea mays
  misc_feature (90)..(90): Xaa can be any naturally occurring amino acid
MDRYHRVERARNQSTIEENEIRITAQGLIRNYVSYATFLLQERRIKEIVLKAMGQAISKSVAVAEIIKKRAPELHQDTNISSVSITDVWXEPIEEGLVPLEMTRHVSMISITLSPRELDKHTPGYQAPAYVEHPRQQQVPPLQRQPRRPSGQQFQQLEYEDSYARGRGRGRGRGRGRGWARGGYGGYGNNQGGYNQGGGYYDNQGGYGGYDDQGGYGGGYGYNQGRYGNYQENGGYNRGRGGGMRGRGNWGYRGGYEGGRGGGYEGGRGGGGPGGRGYGGRGRGRMGGGGRAN

SEQ ID NO: 46591 - protein, 533 aa, Picrophilus torridus DSM 9790
MYGISDSLLALIFIGALLFLAKMGEELFERFKLVPYVAAVFIGIVIGPGVLGLIKILPNITLFISLGINFLLFAGGSLEFKDINTKELLKVKNIIIGILEFIIPFSLISFIVYYIFHNIIVSMVTGIVTGMSSAGPLTRLLSDTGLNRTQDGNSIFRQVVAIEISAVVLFSFLSDVYREKITLIHILIIAAELFVSILLIILFGKYILKGFLEKMDISSKAHETIIAIIISFILILGFVGQYYGFNSAIVALFLGIILRDFINDRPLIAEKVSTVTYGFFEPLFFIGLGLYFVKVSLSLIILGIIIFVLGLLIKPIAGIIFSRFIGIKALRNGLGTSVNGGVDAALLVVALSISIVTRYQYSIIMFAISLLTLAVPLLFNIENPVIPSNNSRYVWNIVEQQFKNLKACDIAKTLQTVSVNKRNPLSFAFKMCMDLNARAVVVIDNNNYVLGQITLSDMISLGEGKLQTLRVYEAGIVPVIRVQCSAPATDLIRIFRDKDPPIVAVVDSNEKFVGTILEREILKYISDVLDTKN

SEQ ID NO: 46592 - protein, 590 aa, Arabidopsis thaliana
MGICEMKSCCSWLLLISLLCSLSNESQAISPDGEALLSFRNAVTRSDSFIHQWRPEDPDPCNWNGVTCDAKTKRVITLNLTYHKIMGPLPPDIGKLDHLRLLMLHNNALYGAIPTALGNCTALEEIHLQSNYFTGPIPAEMGDLPGLQKLDMSSNTLSGPIPASLGQLKKLSNFNVSNNFLVGQIPSDGVLSGFSKNSFIGNLNLCGKHVDVVCQDDSGNPSSHSQSGQNQKKNSGKLLISASATVGALLLVALMCFWGCFLYKKLGKVEIKSLAKDVGGGASIVMFHGDLPYSSKDIIKKLEMLNEEHIIGCGGFGTVYKLAMDDGKVFALKRILKLNEGFDRFFERELEILGSIKHRYLVNLRGYCNSPTSKLLLYDYLPGGSLDEALHERGEQLDWDSRVNIIIGAAKGLSYLHHDCSPRIIHRDIKSSNILLDGNLEARVSDFGLAKLLEDEESHITTIVAGTFGYLAPEYMQSGRATEKTDVYSFGVLVLEVLSGKRPTDASFIEKGLNVVGWLKFLISEKRPRDIVDPNCEGMQMESLDALLSIATQCVSPSPEERPTMHRVVQLLESEVMTPCPSEFYDSSSD

SEQ ID NO: 46593 - protein, 79 aa, Cucumis sativus
MDSDQGKLFIGGISWETSEDKLKDYFSNYGEVMHTVVMRDKITSRPRGFGFVVFSDPSVLDRVLQDKHTIDGKTVGGLG

SEQ ID NO: 46594 - protein, 137 aa, Triticum aestivum
ILSHLTPLLLIFPHTLHTLHCFRGVLVPPTSLAKMSTVTRAYLDQRLAAAKRCSREAAMAGAKAAAVAIVAAAVPTLASVRMLPWARAHLNPTGQALIISTVAGMAYFIVADKTILSMARKHSFKDAPDHLKNTSFN

SEQ ID NO: 46595 - protein, 223 aa, Picrophilus torridus DSM 9790
MIQEAVKSLRSGMPVLIFDSDDREGETDMVYASQFIRPESIRSMRKDGGGLICTTIKMEDALLTRLPYIEDLYKTLDIPNITNADDLKYDKNSTFSITVNSRETFTGIPDIDRAKTVKDISFYIDNLRRKKMDYNDFGRIFRSPGHIHLLIASDGYFKKRRGHTELSTYLVEISGLIPSATIVEMLSDTGRSMTMEEAMAYARNHNYTFITGDEIISHWSGSN

SEQ ID NO: 46596 - protein, 267 aa, Oryza sativa Japonica Group
MAEEQFLAVAVDAAKNAGEIIRKGFYQTKNVEHKGQVDLVTETDKACEDLIFNHLRKHYPDHKFIGEETSAALGATADLTDDPTWIVDPLDGTTNFVHGFPFVCVSIGLTVGKIPTVGVVYNPIMNELFTAVRGKGAFLNGSPIKTSSQNELVKALLVTEVGTKRDKATLDDTTNRINKLLFKIRSIRMCGSLALNMCGVACGRLDLCYEIGFGGPWDVAAGALILREAGGFVFDPSGGEFDLMARRMAGSNSYLKDQFIKELGDTS

SEQ ID NO: 46597 - protein, 136 aa, Picrophilus torridus DSM 9790
MIRIGMVVAEFNYDITMMMLERARSYAEFLGVEVHKILRVPGSFDMPLAIKKLLMDNDIDGVVTIGAVIKGETDHHKIIMDNVSRKITDLSLEYNKPVALGISGPGESRLQAEARIDMAKEAVESCVKMIKLLKSN

SEQ ID NO: 46598 - protein, 203 aa, Cucumis sativus
MAGEVAVEGAVAAAALATEVADSNPQAHKLERKWTFWFDNQSRPKQGAAWGTSLRKVYTFDTVEEFWCLYDQLFKPSKLPANADFHLFKTGVEPKWEDPECANGGKWTVTSSRKANLDNMWLETLMALIGEQFEESDEICGVVASVRQRQDKLALWTKTATNEAAQMSIGRKWKEIIDVTDKISFSFHEDLRREKSAKARYSV

SEQ ID NO: 46599 - protein, 302 aa, Ralstonia metallidurans CH34
MPARFVGSRCRQTQQQERMTLTPTPLAAQDLPAPLSHESPEDDDYHRRFGGVARLYGAEGLARLETANVCVIGIGGVGSWAAEALARNAVGRLTLIDLDHIAASNTNRQIHALGDAYGRSKVDAMAERIVAINPRCRVTAVDDFVTEDNVQALLSGFDYVIDAIDAVKVKTAILGWARREDARVITCGGAGGQLDPTRVRIEDLARTIQDPLLAKVRGNLRRQWGFPRDPKKKFGIQAVYSDEPLRYPEPEQQACEIDEVPPAPRQGPQGLACAGFGSSVAVTAVFGFVAASAVIGAIASGG

SEQ ID NO: 46600 - protein, 371 aa, Yarrowia lipolytica CLIB122
MTSVENTCSGPDCGKIVDGSLKCPVCLKTGVNAFFCDQTCFKRNWALHKSVHSPAGQETTDPFPNYSYSGDLRAVYPLHPRREVKPNIVKPDYAGDGQPISEQKVQRSTQITVLSEDEQNTMRKVSKLAREVLDAGAAAIKPGVTTEEIDAIVHAACMERNAYPSPLNYYNFPKSVCTSVNEVICHGIPDKRPLQDGDIVNLDVTIYKDGFHADLNETYYVGDKAKANKDVVRLVETTRQCLAKAIEAVKPGVMYRSLGEVIENEAKKANLSVIRTYCGHGINQLFHCAPNVPHYARNKAVGVMKPGHTFTIEPMLSLGSFKDQTWPDNWTAVTSDGKWSAQFEHTLLVTETGVEILTARYKNSPGGPVSA

SEQ ID NO: 46601 - protein, 304 aa, Emericella nidulans
MMFSRFFKAVPARPPAFSSPLPVYQARTMATVRNQRPVERATFTIRDGPIFHGKSFGARTTISGEAVFTTSLVGYPESLTDPSYRGQILVFTQPLIGNYGVPSTERDRHGLLKYFESPNLQAAGVVVADVAEQYSHWTAVQSLGEWCAREGVPAISGVDTRAIVTYLREQGSSLARITVGEEYDADQDEAFTDPEQIHLVRQVSTKAPFHVSAADPQCHVAVLDCGVKENILRSLVSRGASITVFPFDYPIHKVAHHFDGVFISNGPGDPTHCQDTTYHLRRLMETSQVPIFGICLGHQLLALA

SEQ ID NO: 46602 - protein, 405 aa, Escherichia coli O157:H7 EDL933
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPCGALYMFPKIDAKRFNIHDDQKMVLDFLLQEKVLLVQGTAFNWPWPDHFRIVTLPRVDDIELSLSKFARFLSGYHQL

SEQ ID NO: 46603 - protein, 493 aa, Photorhabdus luminescens subsp. laumondii TTO1
MSQQQKSVSRKPATQHLRRELKARHLAMIAIGGSIGTGLFVASGATVSQAGPGGALLSYALIGLMVYFLMTSLGELAAYMPVSGSFSTYGSKYVEEGFGFALGWNYWYNWAVTIAVDLVAAQLVMGYWLPDMPGWIWSALFLALIFLLNFISVKGFGEAEYWFSLIKVSTVIVFIVVGLLMIAGIMKGAEGAGWHNWTVGDAPFAGGFSAMIGVAMIVGFSFQGTELIGIAAGESKDPAKNVPSAVRKVFWRILLFYIFAILIISLIIPYTDPSLLRNEVGDISVSPFTLVFENAGLLSAAAMMNAVILTAVLSAGNSGMYASTRMLFTLAKEGKAPRIFGKLSKGGVPRNALYATTVVAALCFLSSMYGNQTVYLWLLNTSGMTGFIAWLGIAISHYRFRRGYVAQGLDLSKLPYRSGFFPVGPIFAFVLCLTITLGQNYQAFLQDKIDWYGVTATYVGIPLFLLIWFGYKLARKTHFIKYSEMKFPDIENQ

SEQ ID NO: 46604 - protein, 549 aa, Oryza sativa Japonica Group
MPLRPPPPPQGFLTAYPSAAFPPVKRPHEDDLGAGDVLTFRFHSLAVLKLFDRIREYRLHDYRYQATRGWYSSGTAPEDALLPCAVARPPRMYGCVIGVQRGRTVEVVDTSDILLDTDPGTLDRDLLKKKLETYKKAFPGLAILGWYSIDTHVTNTDMETNQALMDASGTTFYLLFNPAMNLSLKDLPVTIYEKVHSTNRSPTPLIFVQGKYKTETVEAERISLDHTCPVVSDVSVPPLVGKGQHANIMQTSGFKLMLFEIPSGFAMFEVSQELIARPKDIWARFAYQDDITNVIVTLGSIQIHNKSVARDIIVGPGDELKEFILSFCTHNYLIVQDVELKDVIEKKLNIYCYCNPTVVGELTWGLNYVLHKLLPQEQSLTHEPYLPLSKAMSKQIKEYGFKISPREIDREFLRAMSFLNYLGYMSERYSLLLDHLFGQYRKNNMSDIEFAKSIASHLHSSEGIVPRDERYTRAEIMEFIDFIIAAPENRSRTLSFLRRIEAASIDDSPPPPSLPGGMGVSLLKRLRLDWITVCCLGCAVALYPFYRRV

SEQ ID NO: 46605 - protein, 374 aa, Arabidopsis thaliana
MSNDKDSFNVSDLTSALKDEDRAGLVNALKNKLQNLAGQHSDVLENLTPKIRRRVEVLREIQGKHDEIETKFREERAALEAKYQKLYQPLYNKRYEIVNGATEVEGAPEDAKMDQGDEKTAEEKGVPSFWLTALKNNDVISEEITERDEGALIYLKDIKWCKIEEPKGFKLEFFFDQNPYFKNTLLTKAYHMIDEDEPLLEKAIGTEIDWYPGKCLTQKILKKKPKKGAKNAKPITKTEDCESFFNFFNPPQVPDDDEDIDEERAEELQNLMEQDYDIGSTIREKIIPHAVSWFTGEAIEGEEFEIDNDDEDDIDEDEDEDEEDEDEDEEEDDEDEEEEVSKTKKKFEIILQKGGRPQVTDDQQGERPPECKQQ

SEQ ID NO: 46606 - protein, 194 aa, Brucella melitensis 16M
MQKNHTLSLPNMLTYGRIIAVPLVVLCFFIEGRLESSDFARWTALGLFAIASITDFFDGYLARIWKQTSTIGRMLDPIADKLLVSAILLLLAADGTIAGWTLWAAIIILCREILVSGLREYLAELKVSVPVSRLAKWKTTAQMVALAFLLAGPAGDKIIPYVTQIGIGLLWISAILTLYTGWDYFRAGLKHVMD

SEQ ID NO: 46607 - protein, 497 aa, Zea mays
  misc_feature (140)..(140): Xaa can be any naturally occurring amino acid
  misc_feature (175)..(175): Xaa can be any naturally occurring amino acid
MPSGSAFSGSVNLKHVKLGYQYLVNHFLTLLLVPVMAATALELARLGPGELLSLWRSLELDLVHILCSAFLVVFVGTVYVMSRPRPVYLVDYACYKPPASCRVPFATFMEHTRLISDDDKSVRFQTRILERSGLGEDTCXLPPANHYIPPNPSMGGPRAPEAQLVIFSAIDDLVXRRTGLKPKDIDILVVNCSLFSPTPSLSAMIINKYKLRSNIRSFNLSGMGCSAGLISIDLARDMLQVHPNSNALVVSTEIITPNFYQGSRRDMLLPNCLFRMGAAAILLSNRRREARRAKYRLVHVVRTHKGSDDRAYRCVYEEEDEQGFSGISLSKELMAIAGDALKSNITTIGPLVLPMSEQLLFFFRLVGRKLVNKGWRPYIPDFKLAFEHFCIHAGGRAVIDELQKNLQLSPRHVEASRMTLHRFGNTSSSSLWYELAYIEAKGRMRRGDRVWQIGFGSGFKCNSAVWKCLRSIKTPTNGPWDDCIHRYPVDVPEVVKL

SEQ ID NO: 46608 - protein, 426 aa, Bacillus subtilis subsp. subtilis str. 168
MAADRNTGHTEEDKLDVLKSTQTVIHKALEKLGYPEEVYELLKEPMRLLTVKIPVRMDDGSVKIFTGYRAHNDSVGPTKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNRRIDMRLAAYMVGVRKMAEASRFRGWI

SEQ ID NO: 46609 - protein, 486 aa, Triticum aestivum
  misc_feature (301)..(301): Xaa can be any naturally occurring amino acid
MAAPTPPPAAAPAAAPGPTPPAQVVGNAFVQQYYNILHQSPELVFRFYQEASRIGRPATTGADMDTVTTMEAINEKIMSMDIARAEIRGVDAQESLCGGVTVLVTGHLTGKDDVCREFAQSFFLAPQEKGYFVLNDILRYVGQGEADPSLPPPQQQPPAPELDAVVAPAAALANGTVAPVETVPREQEASPQPELDLSESVPHTNEEEDPKEEVYNPPNDVEVPVVEETPVPEVIDEVPNNVAASIPVSAPPVPHEEAPKKSYASIVKVMKAVLPPNSAVPYRPAPPKPEKQAPAPAPVCXVDAPTFSPNPESSNIQDPEVDALAVYVKNLPLHATPSQLEEEFKRFGTIKHDGIQVRSHKIQGFCYGFIEFEDASSVQSALAASPVTIDDRPCHVEEKRTPGSRGSSRGRFPPGRGGNFRGEGMRGRGSYTGGRGYGRGEYNNYRSDFGGRGGGRGGSGRGGDVGYQRVDHSGTGGRGGARAAAK

SEQ ID NO: 46610 - protein, 453 aa, Oryza sativa Japonica Group
MKEKGSRAAVDERYAQWKSLIPVLYDWFANHNLVWPSLSCRWGPQFEKATYKNRQRLYLSEQTDGTVPNTLVIANCEVVKPRVAAAEHISQFNEEARSPFVKKYKTIIHPGEVNRIRELPQNSKIIATHTDSPDVLIWDVEAQPNRQAQLAQMESRPDLILRGHKDIAEFALAMCPAEPYVLSGGKDKSVVWWSIQDHISALGDSSKTESSPGASGSKGKTANDKDSPKVDPRGIFLGHDSTVEDVQFCPSSAQEFCSVGDDSCLILWDARSGTGPAVKVEKAHGGDVHCVDWNLHDVNYILTGSADNSVRMWDRRNLGSGGAGIPVHKFEGHKAAVLCVQWSPDKASVFGSSAEDGFLNVWDHEKVGNKKNPNAPAGLFFQHAGHRDKIVDFHWNSSDPWTIVSVSDDGESTGGGGTLQIWRMSDLIYRPEDEVLAELENFKTHLASCAPRS

SEQ ID NO: 46611 - protein, 488 aa, Oryza sativa
  misc_feature (306)..(306): Xaa can be any naturally occurring amino acid
MAVQAGTPATPISPQVISGAFVQQYYHILHETPDQVYKFYQDASIVGRPDSNGVMKYVSTTADINKIILSMDFSNYLTEIETADAQLSHQDGVLIVVTGSLTSEGICRRFTQSFFLAPQESGGYVVLNDIFRFIVERPPVAISQVSQENENNQNTATLPETDPNPAGDGMISEPVAVENNVAEGEVTNSTVDGTSIENNATAAVEPPVQMTKEEPRKISVAAPPPPAQKDVTKKSYASIVKVMKEVSLTPVVKPKPAPKHVVKTVEASEKPSVKSSQTVEITPNDNNDAENNTSNDEQGYSVFVEXLPHNVTVQTVEEEFKKFGAIKPGGIQVRNNKIDRFCFGFIEFESQQSMQAAIEASPIHMGGKEVFVEEKRTTTRVVNGVVITRGDNGNAGGGGRYQSGRGGYRGDNFRGRGGGYANSGNYRGGDNFSRRNDLRNRNEFSGRGRGPPPGNGYQNNGFHPARPFQNGNGRFTRVNGPRQTPVAA

SEQ ID NO: 46612 - protein, 140 aa, Brucella melitensis 16M
MAIERTFSMIKPDATRRNLTGAIIAKLEEAGLRVVASKRVWMSRREAEGFYAVHKDRPFFGELVEFMSSGPTVVQVLEGENAIAKNREVMGATNPANADEGTIRKAFALSIGENSVHGSDAPETAAEEIAYWFSGTEIVG

SEQ ID NO: 46613 - protein, 278 aa, Staphylococcus epidermidis ATCC 12228
METVQFYNGRTMPKIGLGTYRVKDGDECRESVKYAIERGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNKLRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFDGK

SEQ ID NO: 46614 - protein, 134 aa, Sinorhizobium meliloti 1021
MKKTHKGSCHCGRIRFEVDIDLEAGTSRCNCSYCSKLRYWGASVKPEDFRLMCEEAGIGDYQFGTMSGHHRFCTACGVTPYGHGYVEEIGGAFVSINVACLDGVDPAEFAALPIQYMDGLHNNWWNAPAETRHM

SEQ ID NO: 46615 - protein, 269 aa, Frankia sp. CcI3
MGRDGVGRRRQGERGEGPSPLPAEPVSAPVVPAAPVVNVANLLTITRLVLVPVFVVFLFAGPDGHTWRYAAFGAYAVAAMTDQIDGSIARRWHLVTDFGILVDPIADKALTGAALISLSVLGELPWPVTALILLREVGVTLLRLWVIRFGVIAASRGGKAKTLLLNVAIGLYVLPLAGVAATSRAVILAAGVVVAMVTGIDYVCRALTLRRRASRDSGGVTPPRGAPSTGLSPGTGPSVRHRMAGPAGSDPSTAAGPTIRKTEGRTDAR

SEQ ID NO: 46616 - protein, 180 aa, Populus trichocarpa
MTSNFWTSRIAAAKQQYASQHHHQSSHQDRFNIDDFEVEEEVRPDFPCPYCYEDFDIGSLCSHLEDEHSYESKVAVCPICSVKVAQDMLSHITLQHGHLFKLQRRRRLRRVAIPNSQALSLLGRDLREAHLQVLLGGGGYRSNNTNANVSNASTDPFLSSFILNFHTSEAEEISKSVERV

SEQ ID NO: 46617 - protein, 658 aa, Pediococcus pentosaceus ATCC 25745
MSIVFFVLILIIATVFSNALDTKIKFLPRAIIQIMMGLALSFIPNFNHFNLNPEVFMLAIIAPLMFYDGMNTNIVKLKRTLSNTFSLAIGLAVVTIILVGYLGYALLPHIPIALAFALAAIITPTDAVAVSSVTENLDLPNEAMLSLKNESLFNDASGIVMFDLALTAFHTGHFSPVLSIFNYLYVFFGGLIVGWIVGWLFVRLQLLLIETDIDNPNIIVPINFIKPFAIYLLAEMFDTSGILAVVAAGLIQSTQAQSLRLTSTKTQMVSKTTYEIFTNLMNGFVFILLGVSFPTVIYDITNEGRQVSSLGYLILVGIILYIVMIIIRYLWVTLKLANIRIRPADKVLNHFLIAINGIHGTITLSMAFSIPIVLHGKIFPFRNDIIFIAATVIILSLLVPSIILPLMLPAKSYSYSLEDISTYRQKMIEYAIKRVHDADEDPVETQAVIATLRSQQSILQRPKRNATYKILQKCFNLEEKLLQEMVDNGEISVKQQTFYERMSLFQSFQLHQSFIQHFMYRARFYFIKLSHRFKRRIKRVDPLVVTKKFNNARDELAQVENEISPQIFAYLKEHLNADNRAEIHWIEEYYRERHRRFQNNTRANEIQEELFINAFQNEYNFIQEQLGKKNISRELASLLYEQVSNDEWVYMQNDSIYA

SEQ ID NO: 46618 - protein, 319 aa, Pediococcus pentosaceus ATCC 25745
MATKKMILDLDTGIDDAMAIAYALAAPDVDLIGIVSTYGNVLTPDAGTNSLKILELLGRTDIPVFLGEEHSQTTESFEVMPISAQIHGKNGIGEVELPAPSRAIETQPGVDFIIEAAHKYNSDLILVPTGPLTNLALALKKDPEVADLIGNVTIMGGALTVPGNVSPVAEANINQDPHAANDVFTSHVNLTMVGLDVTLRTLLTKKETQLWRDLDTTAGSKFADIVDYYIDVYKITSPHLGGCALHDPLAVGIALDASFSKTMDLNMFVDTTDEMWGRTIGDPGRLNEENPNVSVALNVDADFYLKRFMDYLTKLFAKN

SEQ ID NO: 46619 - protein, 170 aa, Zea mays
  misc_feature (67)..(67): Xaa can be any naturally occurring amino acid
  misc_feature (162)..(162): Xaa can be any naturally occurring amino acid
KVSNNGSSLLRHFAPSGGSILAFGLDMGLIDALSQQYDRAYLMSIEAPPDVYVALIVSGWCEMYNAXVVFGRWQDVLVEFEESGCDGIFLDPYGESPEESWEVHQTLPKRKKWNRMNFTVNGSRASKAFFHLVYCNPLTLEIDTSGLITQQFSVPGEDCLGXDEVWEGDQ

SEQ ID NO: 46620 - protein, 444 aa, Vibrio vulnificus CMCP6
MSVYYTLCFLSAAAMLIAFVNSKIGKMQTTIAITAGSMVLSLLILIAGQNNWFHLTEIATQTMSSIDFEDFLLKGILGFLLFAGGLGIKLPNLKDQKWEITVLALGATLFSTFFIGFALYGICQLIGIQFDLIYCLLFGALISPTDPIAVLAIVKKLKAPRRISTQIEGESLFNDGFGLVIFVTLFTIAFGHETPTVGSVTMLFIQEAIGGILYGFALGLLFHYLICATDDHSMELLLTIGIPTAGYAFAEVLHVSGPLAMVVSGIMIGNWTRFIGFSKESEDHLDHFWELVDEFLNGVLFLLIGMSMLLFKFHQEDWILMAIAIPLVLIARYLSVFLSYIGFKRFRQYNPWSIKILTWGGLRGGLALAMALSIPSGIWVISDKLIDVKEIILVMTYAVVVFSILVQGSTITPMIEKAKKSEAEFEAKQSSVTVPEGKTESITS

SEQ ID NO: 46621 - protein, 318 aa, Vitis vinifera
MARFRNNKKKGFVKPVGKKQPGVDHVTGEKIPHSIVFSRGKLPGSLKQLQMDLRKLMLPYTAVNLKEKRRNNLKDFLNIAGPLGVTHFLMLSKTETAPYLKVARTPQGPTLTFKIHEYSLAVDVAQSQLRPRCPQDLFKNSPLIVLSGFGSGEQHLKLTTVMFQNIFPAIDVNTVKLSSCQRIVLLNYNKDTKLIDFRHYSIRLQPVGVSKRVRKFVQNHQVPDLKNLQDVSDFITKAGYGSESEVDDEAATVTLASDLGRINKASSKSAVKLQEIGPRMTLQLIKIEEGLCSGGVIFNAYGIFILHNILLSFIIYSF

SEQ ID NO: 46622 - protein, 370 aa, Magnetospirillum magnetotacticum MS-1
MTRSLDTTPKPEALATPSLVAVDRAIAELRRGGLVLVGHAEGAALMMAAEAVSDESLAQLAAAAGSPTLLALTGRRAGVLGLGDTESGVFRVSSGHGFDGETIAWLADPGARSLPMPVFSGLDARRAGGLDEACVALAKLARLLPAAVLALVVSAAPEAVRVEAAQITGYQENAARSLRQVSAARVPLENAENARIVAFRPSDGGIEHLAIVIGDPDPDQPVLARLHSECFTGDLLGSLRCDCGDQLRGAIAEIAQTGSGVLLYLAQEGRGIGLVNKLRAYELQDSGFDTLDANLQLGFDDDERIYLPAAQMLRLLGISRVRLLTNNPLKVDALARHGIEVTERVPHVFPSNDHNQGYLRTKATRSGHLF

SEQ ID NO: 46623 - protein, 714 aa, Escherichia coli O157:H7 EDL933
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIDSLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 46624 - protein, 439 aa, Escherichia coli K12
MSQAKSNKMGVVQLTILTMVNMMGSGIIMLPTKLAEVGTISIISWLVTAVGSMALAWAFAKCGMFSRKSGGMGGYAEYAFGKSGNFMANYTYGVSLLIANVAIAISAVGYGTELLGASLSPVQIGLATIGVLWICTVANFGGARITGQISSITVWGVIIPVVGLCIIGWFWFSPTLYVDSWNPHHAPFFSAVGSSIAMTLWAFLGLESACANTDVVENPERNVPIAVLGGTLGAAVIYIVSTNVIAGIVPNMELANSTAPFGLAFAQMFTPEVGKVIMALMVMSCCGSLLGWQFTIAQVFKSSSDEGYFPKIFSRVTKVDAPVQGMLTIVIIQSGLALMTISPSLNSQFNVLVNLAVVTNIIPYILSMAALVIIQKVANVPPSKAKVANFVAFVGAMYSFYALYSSGEEAMLYGSIVTFLGWTLYGLVSPRFELKNKHG

SEQ ID NO: 46625 - protein, 371 aa, Debaryomyces hansenii CBS767
MSAICAASNCGKETTSSLKCPVCLKEGTTKVFCNQLCFRSNWGNHKATHKNEDGTNESYNPFPSFNYSGDLRPSYPLSPRRAIPKHIKVPDYAQNGRPISEIKNDRVGKITILSEKEIEKVRKVGILSREILDITASHIKPGITSDELDAILHKECIKRNAYPSPLNYYNFPKSICTSINEVICHGIPDQRKLEDGDIINLDVTIYYLGFHSDLNETYYVGDKAKCNPEIVNLVETTRECLDLAIQQVKPGLIFRDLGNVIEEHATKNNCSVVRTYCGHGINQLFHCQPNIPHYAKNKAVGVAKPGMVFTIEPMLCQGSYRDMNWPDNWTAVTQDGKYSAQFEQMLLVTEDGVEILTARNDQSPGGAIPRI

SEQ ID NO: 46626 - protein, 190 aa, Magnetospirillum magnetotacticum MS-1
MAVSKTHSAEAVAQALAAGQRVFGENRVQEAKAKFPDLRGGYPDLELHLIGPLQTNKVRDAIALFDVIETVDRPKLARALADEMERTGRRPRILIQVNTGREAQKAGVDPDQLDAMVAICRNEYKLPLAGLMCIPPAEDDPAPHFRLLADMARRHGLDVISMGMSGDFETAITEGATHVRVGSAIFGHRV

SEQ ID NO: 46627 - protein, 324 aa, Silicibacter sp. TM1040
MGLLVDGKWEDVWYDTKSHGGAFKRSEAQFRNWLTADGSPGPDGQTGFKAENGRYHLYVSYACPWAHRTLIFRKLKGLEDHISVSVVHPDMLDKGWEFKTDADGATGDALFGFDYMHQIYTKADPSYSGRVTVPVLWDKQENTIVSNESAEIIRMFNSAFDEITGNTLDFWPEELREPIETVNKRIYDTVNNGVYKSGFATSQEAYDAAVVPLFDSLDWLEDILSQHRYLMGEHLTEADWRLFTTLVRFDPVYHLHFKCNRRRIIDYPNLWAYTRELYQMPGVAETVVMPHIVRHYHYSHDTINPNRILPINPVLDWEAPHGRG

SEQ ID NO: 46628 - protein, 646 aa, Brucella melitensis 16M
MRKKRKPCKSPLTMLILDDISVRIAGRLLIDHASVTLPAGSKTGFVGRNGTGKSTLFRVITGDLAPETGSISFPKNTRIGQVAQEAPGTEEPLIEIVMKADKERAALLEEAATATDPHRIAEIHTRLADIDAHSAEARAGAILSGLGFDAQAQRQPASAFSGGWRMRVALAAVLFAEPDLLLLDEPTNYLDLEGVLWLVDYVKRYPHTVIIISHDRDLLNSATSSIMHLDQKKISFWRGNYDQFERQRHEMLELQQKAHARQEAHRKHMESFVERFRAKATKARQAQSRLKALQKLKPIELYVESHVQPFRFPDAEKKAASPIIALDGADVGYVPGKPVLRNVTLRIDNDDRIALLGSNGNGKSTLAKLIAGRLAPEKGTLTISPNLKVAFFAQHQLDDLVPEDNAIEHVRKLMPAEPEARVRARVAQMGLSTEKMLTPAKDLSGGEKARLLMGLATFHGPNLLILDEPTNHLDIDSREELVHALNAFNGAVILIAHDRHLIEATMERLWLVREGGVKPFEGDLDEYRQIVLADAKGEPAADRDEGPKVNKAEQRKLAAQKREALAPLQKKIKETESLIQKLQKQIQDFSMQLEDPALYEKEPQKAIRINKDMSDAKSTLAEAEDKWLELSAEYEEAMAELIRASP

SEQ ID NO: 46629 - protein, 367 aa, Physcomitrella patens subsp. patens
MFERSSGLLVPSRNSTPNYLKLSTDMWAGDVIKMVEINCGPTAADDCHDKVASTHLKVVAIAVILSTSALGVLIPFFGRRSRLFRTDGNPFMVVKAFAAGVILATAFVHMLPAAHRVLSNPCLPEDPWGKFAWAGFITMLAALGTLVMDSAATEFYMNRPEHHHGHHHDSAKIEDSEHKNDVEKQPSCAVITHPHTHEDVNDDGHFTNIRHVVVAQVFEFGIVAHSIIIGITVGVSNSPCTIKPLFAALTFHQFFEGFALGGCVAQAEFSNLSTLIMGIFFAITTPLGIGTGMGALATYNPNSAKALIIQGVFDSISGGILVYMALVDLIAADFLSKRMRSSRRLQIASFVALFCGAGCMSLVGIWA

SEQ ID NO: 46630 - protein, 209 aa, Stevia rebaudiana
MASASLFKPSPATVLDKSDWVKGQTLRQVPVSVVRFNAAAPSALTVRASSYADELVKTAKTIASPGRGILAMDESNATCGKRLASIGLENTEANRQAYRTLLVSAPGLGNYISGAILFEETLYQSTIDGKKIVDVLAEQGIVPGIKTDKGLVPLAGSNDESWCQGLDGLASRSAAYYQQGARFAKWRTVVSIPNGPSALATKEAWESLK

SEQ ID NO: 46631 - protein, 526 aa, Arabidopsis thaliana
MGTASSKSNINLSQVLNTEEPYSSVMLAVAALLAVVCYLWIQGKSKSKKEPPLPPGPWPLPIVGNLPFLNSDVLHTQFQALTLKYGPLMKIHLGSKLAIVVSSPDMAREVLKTHDITFANHDLPEVGKINTYGGEDILWSPYGTHWRRLRKLCVMKMFTTPSLEASYSTRREETRQTIVHMSEMAREGSPVNLGEQIFLSIFNVVTRMMWGATVEGDERTSLGNELKTLISDISDIEGIQNYSDFFPLFSRFDFQGLVKQMKGHVKKLDLLFDRVMESHVKMVGKKSEEEEDFLQYLLRVKDDDEKAPLSMTHVKSLLMDMVLGGVDTSVNASEFAMAEIVSRPEVLNKIRLELDQVVGKDNIVEESHLPKLPYLQAVMKETLRLHPTLPLLVPHRNSETSVVAGYTVPKDSKIFINVWAIHRDPKNWDEPNEFKPERFLENSLDFNGGDFKYLPFGSGRRICAAINMAERLVLFNIASLLHSFDWKAPQGQKFEVEEKFGLVLKLKSPLVAIPVPRLSDPKLYTA

SEQ ID NO: 46632 - protein, 571 aa, Physcomitrella patens subsp. patens
AFWDYQFLYKSQRNEVDSISLTLVEGSIPPQLSGVYYLCGPGIRTDDHGSQVHPLDGHGYLRKFVIDGSNPVIYSAKYVNSEARKEEYDDESKTWRFQYRGPFSQLRGGDRFGNVKVMKNVANTSVLKWAGKLMCMYEGGNPYEMDSKTLQTLGLFNAIKDTCTNLDGLVGSAKRAAVELVGMLIQPVLKGVFEMPKERMLSHVKMDVKRQRLVVMTCRREDMVLPKSTFTVYEMDLSMQVVQRKSFTLDEQLMIHDWGLTNNHYVLLANKVKLNSPANLLESVAGMQPMINCLALDDALPYTPMYLLPREINVTNSSKRNWRTPVKVPERLWFVHTANSFEETDDHGNLRITLDGTACSYDWFSLSNMFGYKWQKKWLDPTMMNKMNGGASHSMKNPVQLIRVSTLLSTEGDEIETKYEKFENNTCACEFPAIHPELYGSKNEYTYLVGASGRRKALPYFPFDTVLKISGDAPDGKIQSWWAGPRNFVGEPTFIPRAGSAPPGSPDFVEDDGYLIVVQYSAEEEVCYLVILDARNIGSENPVVARLQLPAKYAFPYGFHGLWTDVDIKRT

SEQ ID NO: 46633 - protein, 600 aa, Sulfitobacter sp. EE-36
MATETLGALNPVTAIALVGAIGVGSQWIAWRLRMPAIVLMLVAGILIGPVLGIFDPARDIGPLMGPMISIAVAIILFEGGLSLNFHTLQDAVGGVRRLVYIGAPLGWLMSALSLHYVAGLSWSSSAVFGGIMIVTGPTVIAPLLRTARLSRRPATLLQWEAILNDPIGALAAVLAFEVVIALNTATTASEAMLELFIGAAVATAAGVAAGIGLSRAFKRGWVPEYMKVPVLFALLLGVFAASDAVLHESGLLAVTIMGIVIANSKLPSYEEMRRFKEHATVLLVSGVFILLAAGLDVEALGNLDWRAAAFVAVVVLVARPVTVFISLIGSGIPFREKLLVALTGPRGVVLVAVAGLFGERLLSLGFEDAALIAPLAFALVAVTVVVNGFTLAPFARLLGLTGADTPGVVIIGGSDWTTQLAEVLKKAKIPVLMTDPNFIRLRKARAAGIDTFSGDILSEAAEQRVELVSYATLIAATDNDAYNTLVTTDLAPEFGRENVFQVMREKSESSRHQLPRTLGGRPLGLEATHAELRDLIAQGWRFRSTRLSEEFTLEDWRAESPEARLLAQITTSGEIKFMRKNEEFKGGDGIHVIALRPPEK

SEQ ID NO: 46634 - protein, 288 aa, Populus trichocarpa
MEGKEEDVKLGANKFSERQPIGTSAQTDKDYKEAPPAPLFEPGELKSWSFYRAGIAEFIATFLFLYITVLTVMGVTKPGTSKCSTVGIQGIAWAFGGMIFALVYCTAGISGGHINPAVTFGLFLARKLSLTRAVFYIIMQCLGAICGAGVVKGLQGSHNYELQGGGANVVNHGYTKGDGLGAEIVGTFVLVYTVFSATDAKRNARDSHVPILAPLPIGFAVFLVHLATIPITGTGINPARSLGAAIIFNKDHAWDDHWIFWVGPFIGAALAAVYHQIVIRAIPFKSRA

SEQ ID NO: 46635 - protein, 373 aa, Vibrio vulnificus CMCP6
MSIQSFIPPRRILMGPGPSDISPQVLQALSRPTVGHLDPLFIQMMDELKQLLKYAFQTKNDFTIAVSAPGSAGMEACFVNLIEPGDKVIVCRNGVFGERMRENVIRAGGEAILVDDEWGTPVSIEKVEQALTQHPDTKILAFVHAETSTGARSDAETLGKLAKQYGVLTIVDTVTSLGGIPLKVDEWQLDAVYSGSQKCLSCVPGLAPVTFSSAAIEKIQSRKIPVQSWFLDQSLVLGYWSGEGKRSYHHTAPVNSLYSLHEALLMLKNEGLENAWARHEKMHNKLKVGLEKLGFQFVVDEAYRLPQLNAIYVPEGIDEAKVRSHLLETYNLEIGAGLGALAGKAWRIGLMGYGAREENVALCLRALEESLTQ

SEQ ID NO: 46636 - protein, 547 aa, Frankia sp. CcI3
MRRSLMSSSDSLDDAAAPGTGPRPRLTVIGTGYLGATHAVCMAELGFEVLAVDVDHSKIERLSAGEIPFFEPDLADLLRANLRTGRLRFTTSFEEIAEFGDVHFVCVGTPQRADGYGADLSHLHAAIERLAPLLTRPCLVVGKSTVPAGTAAGLARTIAQLAPANRPVAGETAPGAAGADGLGRVEVGHDGLGHDEVDEPAADISSDLAGVQLAWNPEFLREGFAVADTLRPDRLVFGVASPAAEGALRAAFAPVIAQGVPVIVTDYATAELVKTAANSFLATKISFINAMAEVCEAVDADVLTLAEALSHDVRIGGNFLRPGVGFGGGCLPKDIRAFQARADELGVGAALRFLREIDEINNRRRDRVVDLVTAALDGTLVGRRLVVLGAAFKPNSDDVRDSPALAVAGLLAETGAGVTVVDPVATHNARQALPGLAYSDSVEAVVEGADALVLLTEWRQFADLDPARLGAVVRRKVVVDARHALDADQWRQAGWVYLAPGRPTGVIPSSLPEQRHRGDGAPPAPVEQCGETGARLAEVEARAGHPV

SEQ ID NO: 46637 - protein, 355 aa, Frankia sp. CcI3
MTSTSRAETVLVTGATGFIGSHTWVDLLAAGHRVVGVDNFVNSSPRVLDRLRKVVDGDIDFVRLDVRDRAALGDVFRRWKIDSVIHFAALKAVGESVDIPLEYYDTNVNATLGLVRVMAEHGVRRLVFSSSCAIYGAADKVPIAEDTPARPTNPYARTKWMCEQILADLCARDPSWHVTSLRYFNPAGAHESGLLGEDPRGVPNNVMPYLAQVAVARRPELSIFGDDYPTPDGTGVRDYIHVVDLAEGHRLALDHLDDQAGHRVINLGTGAGTSVRELLAAFSAACARDLPSRVVARRPGDVAALVADAALARTALGWSARRDVADMCRDAWEFQRLNPGGYDDEEEPDELVGQP

SEQ ID NO: 46638 - protein, 109 aa, Pediococcus pentosaceus ATCC 25745
MAVTINQDNLTDVTQSGLTIVDFWAPWCGPCKMMEPALESLEKTYGDQIQFAKMNVDNNQAVAESFKIMSIPALVLFKDGKAIEKVTGYYPEAKLAKYLEKKISENEPK

SEQ ID NO: 46639 - protein, 290 aa, Vibrio vulnificus CMCP6
MIKKCLFPAAGYGTRFLPATKSMPKEMMPVVNKPLIEYGVEEAIQAGMDGMCIVTGRGKHSIMDHFDKNYELEHQISGTNKEALLEDVRALIDSANFTYIRQREMKGLGHAILTGRELVGDQPFAVVLADDLCVNEEQGVLAQMVALFKQFRCSIVAVQEVPENETHKYGVISGEMIKDDLFRVDNMVEKPEPGTAPSNLAIIGRYILTPDIFDLIEQTEPGKGGEIQITDALLKQAKAGCVLAYKFKGRRFDCGSVEGYIEATNYCYQNLYLKDEKTSELGKFSTQKEK

SEQ ID NO: 46640 - protein, 293 aa, Populus trichocarpa
MLRRDIRLRREYLYRKSLEGKERLLYEKKRKIKEALAEGKPIPTELRNEEAALRQEIDLEDENTAIPRSHIDDEYAKATERDPKILLTTSRDPSAPLTQFVKELKFVFPNAERINRGGQVISEIIESCRAHDYTDVILVHEHRGVPDGLVICHIPFGPTAYFELLNVVTRHDIKDKKAIGTMPEAHPHLILNNFKSKLGERTANILKHLFPMPKPDTKRIITFANQSDYISFRHHIYEKHGGPKSVELKEIGPRFEMRLYQIKLGTVDQTEAQNEWVLRPYMNTTKKRKFIGD

SEQ ID NO: 46641 - protein, 260 aa, Pediococcus pentosaceus ATCC 25745
MITLKSEREIEGMRKAGAVLAGMHIGLRDIIKPGISSWEIEKFALKYLDKNGAVPEEKGFEGYEYATCVSVNNEVCHGFPRKGLILKEGDLVKVDTVVSVDGYMSDSCWAFAVGEVSDEVKKLMEVTKKALYLGIDQAVEGNRIGDIGHAIQSYVEDEMGYGDVREFVGHGIQPTMHEDPMVPGYGEAGHGPRLKNGMTITIEPMVNVGGWQCDTSAPDGWTVTTMDGSLSCQYEHTLVITPDGPKILTSQDPVEDAKYL

SEQ ID NO: 46642 - protein, 420 aa, Sinorhizobium meliloti 1021
MVEKRTQPLARDAMAYVLAGGRGSRLKELTDRRAKPAVYFGGKARIIDFALSNALNSGIRRIGVATQYKAHSLIRHLQRGWNFFRPERNESFDILPASQRVSETQWYEGTADAVYQNIDIIEDHGVEYMVILAGDHVYKMDYELMLQQHVDSGADVTVGCLEVPRMEATGFGVMHVDNADRIIAFVEKPADPPGIPGNPDMALASMGIYVFHTKFLMDMLRRDAADPKSSRDFGKDIIPYIVEHGKAVAHRFTHSCVRSDFEREAYWRDVGTIDAYWQANIDLTHITPELDIYDSTWPIWTFSEIKPPAKFVHDDENRRGSATSSLVSGDCIISGAALNRSLLFTGVRVNSYSRLENAVVLPDVTIGRHSILRNVVIDSRVVIPEGLVVGDDPELDAKRFRRTESGVCLITQTMIDKLGM

SEQ ID NO: 46643 - protein, 467 aa, Frankia sp. CcI3
MSDTPTPDLTCSAGTAGAPRNKPVPGARAAHLLAAGGVSGESLLDGTARRTVLPGGLRVITERVPGVRSVAIGVWVAVGSRDETPVTAGCSHYLEHLLFKGTPSRDALTISASVEAVGGDINAFTGKEYTCYYVRVLDSDLAMAVNVIADMVTNSLVTADDVEAERGVILEEIAMYEDDPGDLVHDVFAAAMLGSSVLGRPVLGTTESIEGLGRETIADYYRSRYVPPAMVVSIAGNLAHDRALALVAEAFADRLTVSAEPFEVRGGSYDYPPPPGIVVTDRPTEQAHLVLGTRGLSRHDPRRYTLGVLSTALGGGMSSRLFQEIREKRGLAYSVGSFASHFADAGLFGVYAGCAPKRADVVLELAREQVRQIAEHGISAEELDRARGQNRGSMILGLEDTGSRMSRLGKSELVHGEVLSVDEIIARVDAVTLDDVTAIARELLDQSWALGVIGPFDDHDFSAAVAR

SEQ ID NO: 46644 - protein, 392 aa, Bacillus cereus G9241
MKLFKPSEIVTSLPTQFFASLVAKVNKVVAAGHDVINLGQGNPDQPTPQHIVKALQDAAEKTIHHKYPPFRGHESLKEAVATFYQREYDVVVNPKTEVAILFGGKAGLVELPICFTNPGDTILVPDPGYPDYLSGVALAKAQFETMPLIAENKFLPDYTKIDDSIADRAKLMFLNYPNNPTGATASKDFFDETIQFANKHNILVVHDFAYGAIGFDGQKPVSFLQADGAKDTGIEIYTLSKTFNMAGWRIAFAVGNESVIETINLLQDHMYVSIFGAVQDAAREALLSSQSCVIDLVNSYESRRNALISACHSIGWNVDIPTGSFFAWLPVPKGYTSEQFSDILLEKAHVAVAPGVGFGEHGEGYVRVGLLHTEDRLREAINRIDKLNFFKK

SEQ ID NO: 46645 - protein, 418 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFGFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRS

SEQ ID NO: 46646 - protein, 486 aa, Magnaporthe grisea 70-15
MWTFLILCAILFCGALLILLPSRYLHSSSKIGSKTDVSVQVLVLGDIGRSPRVQYHAMSIAKHGGRVDLIGYQETPLHPELLKYPKVSVRSLDPPPRVLRSKSIPFIISGPLKVIWQVFTLIHVLGYETPPAQWLLIQNPPSIPTMAVATVISRCRNTRLLIDWHNYGWTILSGTRGARHPFVRISKLYECLFGRFGSANLTVTHAMARQLKRAPYGIKSPIVPMHDRPAAIFKPLNDPMAKLDILSRILESRDLAAAIVDRRTRLIVSSTSWTPDEDFNLLLSALVQYANSMQDDSQIIVPVVAVITGKGPQKAMYEAKIKKMAEDGLVPNVTIRTAFLSFEDYAALLASADLGVCLHMSSSGVDLPMKVVDMFGAGLPVVAYSAYESFSELVREGENGRGFETAGELTAELTRLLSVEGQEELKHLRQGAVLEGSRRWDEEWDASVARILGLSSIFKNATLKRELFSQRREISILNKVTEPTKP

SEQ ID NO: 46647 - protein, 1499 aa, Ustilago maydis 521
MGSISAVGAVARIAVLTSATLVNVAPSGKASTSSFSSVADKASELNAQLDVEHLNQHVELGSVLSQLKPAGNGLISVLSHAHQPTFTRLVPHLPKLVHTPLVFHVASAGEHSDIMALRQSGLVLLHSSTAAQAHDHALLATKIATSAKRAVLHFFEDASGPVEEVTNVDLASFIGSVAASTSTDAAAPKINGLNGHANGINGHVNGVNGANGNANGYASAVASEAGFDDLESAIDAAYEDVAELVGHAVEPFQLVGASDAQNLAVVLGAGSETLQDYTAPHNDLAVLDIRLVRPSLPQRLLDTIPAGIKRIAVLEQSVRRTTKLGPLFVDVASAFQGSERTLPSVFVSAILGHIDNGDNAAKELIKALQAPKPKHAFIVGDLKKLSARAQASPATAATTAPVQVPKHEEAYNLMLEQVFADRLALVNSANEESDDHPAARSPEYAFGQVLAQLEQRDELIRAVNDVLRDGGVSTELHEALSQWLVAKQDVKKNVASSNKVASLLQSSTSGAALQNIKSLSEHLLLKSRWIVGSDAWAYDAGMGGVHHVIASGRNVNMLIFDSVPYTKRDAQAAHKRKKDVALYAMNYGNVYVASTAIYADYTQVLHALMEADKFDGPSVVLAYVPYRTEDAPALDVLRETKLAVDSGYWPLFRWDPSAEARGSDVFRLDGVRLREQLQQFLDRQNLFTTLINSRPELSYDIAASQGNALRELQRRKAKEAYEKMLGSLDGPPLLILVASDGGNAEKVAKKLAVRAKARGVAARLLTMDDFPVTEELKDEKNVVFLTSTAGQGEAPQNGRFTYKALHAMADAALPDTLNFTVFAMGDSHYWPRPEDAHYYNKPGKDIDVRLEQLGATRMTPIGLGDDQDADGYQTGYKIWEPLLWKALGVDTVEVKEAEPEPITNEHMKIASNYLRGTIKEALVDTSTGAIPETDGQLTKFHGTYMQYDRDTLEERKAAGLEPAYSFMIRARIPGGVVTPAQWVQLDDVAEKYGNQTIKITTRQTIQYHCVIKSNLKAAMQGINKSMLDTIAACGDVNRNVMCSPNPNLSELHEDVYEFSKSISEHLLPRMNAYHEIWLDKETDSSKQLLIGGVLQDYEPLYGPYYLPRKFKIAIAVPPRNDTDCFAHDIGLIAIADPVTKRLAGFNLAVGGGMGVTHSMKATYPRLGNVIGFVTPEQTLDACRIVMLIQRDTGNRANRKQARLKYTIDKHWGGADNFKAEVERRLGYKLAEPKSYKFETNTDLYGWTQDYKGNYHCTLWLENGRVKDEPGAPFRTGLRELCKIHKGAFRLTPNQHIIVSDIKPEDKDTIDAHLRKYKMNNWEHSGVKLSASACVAFPTCGLAMAESERYLPLLMDKIESIFEANGLRSTDTVFRMSGCANGCSRPWMAEAGFVGKAPGQYVMTLGGSHNGTRLSKIYRESVDEKEILEIMNKLVPLYAENRIEGESFGDYVIRAGIIKPTTEGKAFYEDMCPSDVVPPSAAAKKGPAQATEHYDRASSA

SEQ ID NO: 46648 - protein, 90 aa, Glycine max
MAEKKEMIPKQYDIDAKWDACIDLTVRRFVYSASAGAFGGLLFFRSPVTRWASIAFGAGVGIGSAYAECSRLFDGPPTNLPLPKNVPDSE

SEQ ID NO: 46649 - protein, 274 aa, Debaryomyces hansenii CBS767
MSRVGVLALGPAGVGKSTFCNSIITHMQSIGRRAHIVNLDPAAEPSEYEFTIDIRDLISLQDVMEEMDLGPNGALIYCFEFLMNNLDWLDEEIGDFNDEYLIFDCPGQIELYTHIPVLPTIVRHLQTLLNFNLCATYLLEAPFVIDRSKFFSGALSAMSAMILLELPHINILSKIDLIKNEVSKKELKKFLNPDPLLLNASLDNESNPKFAKLNKAIANLVDDFGMVQFLPLDCNKDSDSVATILSYIDDVTQWSESQEPKEPVEEIEEEVDFE

SEQ ID NO: 46650 - protein, 374 aa, Arabidopsis thaliana
MSNDKDSFNVSDLTSALKDEDRAGLVNALKNKLQNLAGQHSDVLENLTPKIRRRVEVLREIQGKHDEIETKFREERAALEAKYQKLYQPLYNKRYEIVNGATEVEGAPEDAKMDQGDEKTAEEKGVPSFWLTALKNNDVISEEITERDEGALIYLKDIKWCKIEEPKGFKLEFFFDQNPYFKNTLLTKAYHMIDEDEPLLEKAIGTEIDWYPGKCLTQKILKKKPKKGAKNAKPITKTEDCESFFNFFNPPQVPDDDEDIDEERAEELQNLMEQDYDIGSTIREKIIPHAVSWFTGEAIEGEEFEIDNDDEDDIDEDEDEDEEDEDEDEEEDDEDEEEEVSKTKKKPSVLHKKGGRPQVTDDQQGERPPECKQQ

SEQ ID NO: 46651 - protein, 391 aa, Pseudomonas aeruginosa
MDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEAAVGKLLVLSQVVLSLQLPFALWPLIRFSSDRGLMGEFVNPRWVSALAWSLFGLISAANLTLLYFWFG

SEQ ID NO: 46652 - protein, 340 aa, Leptospira interrogans serovar Lai str. 56601
MQRTIALVQKKGSLENISLETEALPEPNENEVQIEVHSIGLNFADLFAIQGLYSATPQGAFIPGLEYSGVVISTGKKVKNVKKKDKIMGVTRFGGYSSHLNIDSRYVFKLPSKWNFDQGAGFLVQGLTAYYALAALGDLKKGQTVLIHSAAGGVGILANRIAKKLGAFTIGTVGTSSKIDLLKKEGYDKQIVRSSRFKNDLQESLSGTDLNLVLECIGGKIFQESYEVMAPMGRMIVYGAAEMMGEGSSVNWARIAYKYFSRPKLDPMKMVSDNKAVMGFNLIWLYEKVEILTKHLNALVKLNISPPLIGKTFEFDNLNEALKYFQSGTSMGKVVLKVKS

SEQ ID NO: 46653 - protein, 173 aa, Burkholderia cepacia
WATDIQAGSQFGYSLLWVVAFSSLAAIFLQMLAARLGLVAGKDLAQASYERYGRFGRVVQWITAEVSIIACDIAEVLGCALAFKLLLGVPLAWGVVLTALDTVIVLGLQGKGFRQIEAIVLGLIATMAFCFVAQVAITPPDWHAVVGGLVPGDPGHDRKDAIVLALGIVGATI

SEQ ID NO: 46654 - protein, 332 aa, Leptospira interrogans serovar Lai str. 56601
MVCRTLLYNWKFSFSFGVRVNSSSFSKIFHSYKSTFENFLNSQTLSILSKQSAPELFEAMKYSLVAGGKRLRPVLALAAFGGLQNETQNVLLLGASLECIHTYSLIHDDLPSMDNDDFRRGLPTLHKKFSESTAILAGDALNSFAFYFISWIRVENGDHFLHRNLLEILHAGCGAPGMVSGQVYDLQMERENVKENDSTNQSDKIEMLQLTHRLKTGALIKSALLLGNRLRKDWKKRETSLSQYGEDLGLLFQITDDILDVEGTQESLGKTPGKDQKSGKITYPMLFGMDRCKKMVEELQKNLIFTSSDFVSTEEEQTFFQELPIYIGQRKN

SEQ ID NO: 46655 - protein, 140 aa, Brassica napus
  misc_feature (30)..(31): Xaa can be any naturally occurring amino acid
  misc_feature (46)..(46): Xaa can be any naturally occurring amino acid
MSLPLTKEKAAFSPSDPAMQRHVASGRPSXXDGSDFSYRMVVESRXQRVAEGRSRLARLILVQALHLVAGGLLLLLSLSKGAAVNKFAVLSMAAGFLAIVVGELGRLRIMAVLLRLYTSLSSIAVAFSVTCIIRSELFLK

SEQ ID NO: 46656 - protein, 516 aa, Pediococcus pentosaceus ATCC 25745
MSLLSVEHLSHGFADKELYEDANFELNKEDHMGIVGQNGAGKSTLIKILTGETLPDKGRIIWQNKVTYGYLDQYADIPKEDTLYEFLTTAYAELFRQRDLMEKYYADYAENLDDKLLEKAGRIQENLDANNFYDIDTEINRVMTGLGLDDIGKDHIVSEMSGGQRSKIILAKLLLQNPDVLILDEPTNYLDTAHISWLADYLNGFEGAFMVISHDYDFLQKVTNCICDVSFNKITKYRGDFQSAMRQKDARKEAQLKAFEKQQVVIEKAENFIRKNKAGQRSTMAKSREKMLNRMEKIDPPSENLKGHFDFPYLDTGSQNAVAVNKLAVGYGKKQLLEPVTFSMSAGEKVAFSGFNGAGKSTLIKSILGVIPALGGEAHFSPSAKVNYFTQELIWDNPKLTPLETIQNQYPKMLPKTIRTKLAKCGINAADTMKPMKQLSGGEQTKVKLALMELIDSNFLIMDEPTNHLDDETKRALSEALQRFKGNLIVVSHEDSFYSQWIDKEINVEKLRLDRE

SEQ ID NO: 46657 - protein, 406 aa, Glycine max
  misc_feature (373)..(373): Xaa can be any naturally occurring amino acid
MYRAVASRLTLPKGNGRTLGASRGLFNWLTGESSNPLPPLDTPLRGVSLPPSLPDYVEPSKTKITTLPNGLKIASETSPNPAASIGLYVDCGSLYETPLSSGASHLLEKMSFKSTANRSHFRVVREVEAVGGNVGASASREQMGYTFDALKTYVPQMIELLVDCVRNPAFLDWEVNEELRKVKSELGELSNNPQGLLLEAVHSAGYSGALANPLLASETALNRLNSSLLEEFVAENYTASRMVLAASGVEHEELLSVAEPLLSDLPSVPRPEEPKSNYVGGDFRRQGESGVARVAIAFEVPGGWKKEKEAIALTILQMLMGGGGSFSAGGPGKGMHSRLFLRVLNEHQQIHSFSAFNSLFNNTGLFGIYASTXSDFVPKAVDLAARELIAIASPGQVTQVPRPRPR

SEQ ID NO: 46658 - protein, 283 aa, Pediococcus pentosaceus ATCC 25745
MNNLTDTYTLNNGVKIPVVGFGTWQSKDGDEAYNAVKAALEAGYRHIDTAAAYGNEESVGKAIKDSGIDRKELFITSKLWNRDHGYESAKKALDTSLAKLGTDYLDLYLIHWPNPVQFRDEWQQRNADSWRAMEEALDAGKVRAIGVSNFRAHHLDELLKTAKVTPAVNQIFLNPSDTEDEVVAYNKEHGILSEAYSPLGTGKIFTIPELKDIAAKYNKSVAQVVLRWSLQHGFLPLPKSVHADRIKQNTEIFDFELSDDDIKKIDGFHGVAGLAQDPDATDF

SEQ ID NO: 46659 - protein, 93 aa, Triticum aestivum
  misc_feature (7)..(7): Xaa can be any naturally occurring amino acid
SGGQSEXSATAHLNAINQVKALKPWALSFSYGRALQASVLKAWKGKPENVAAAKDALMHRAKMNSLAAVGKYEASMETSAADAGSLHVANHQY

SEQ ID NO: 46660 - protein, 107 aa, Glycine max
  misc_feature (11)..(11): Xaa can be any naturally occurring amino acid
MAKRNVVANSXLERSTLASLDQKLAMAKHCSHEGVMAGAKAAVVATIATAIPTLASVRTIPWARANLNPTAQALIISTVAGAAYFIVADKTVLATARKNSFNPPSNA

SEQ ID NO: 46661 - protein, 462 aa, Pediococcus pentosaceus ATCC 25745
MKIIDKILRKESLDNYLKTDSKFEKTIGPKDLLALGIGAVIGTGIFILPGTVAALKAGPSITISFVIAAIVCALAGMCYAEFAASIPVAGSAYSYGTIIYGELPGWVLGWALILEYVLAVAAVSTGWSAYFGSLLGGFGIHIPTAISGSFNPSHGTYINLFAIIIVLLIGFLLNRGFQSSIRINNFMVFVKIAIILIFILVGIFYVKPTNWKPYFPFGVHGTLAGASTVFFAYLGFDTVSASAAEVKNPSKTMPIGIIGTLIIATIFYVAVSLVLTGMVPYTKLNVANPVALALQLVHQNWVAGLLSLGALAGMTTMMISMIYGSSRLVYATGRDGLLPKVLGNLVGEHHSPRNAMVVVTIFIAFLGGFVPLDQLTNLVNMGTLLAFALVSLGIIPLRHRQDIPNTGFKVPGYPFIPIISALACIYLITTLSVETWIGSAIWFGIGLIIYFSYGIHHSKLAQ

SEQ ID NO: 46662 - protein, 571 aa, Oryza sativa Japonica Group
MELTTLLLLALISFFFLVELIARYASPSGRESALRLPPGPSQLPLIGSLHHLLLSRYGDLPHRAMRELSLTYGPLMLLRLGAVPTLVVSSAEAAAEVMRAHDAAFAGRHLSATIDILSCGGKDIIFGPYTERWRELRKVCALELFNHRRVLSFRPVREDEVGRLLRSVSAASAEGGAACFNLSERICRMTNDSVVRAAFGARCDHRDEFLHELDKAVRLTGGINLADLYPSSRLVRRLSAATRDMARCQRNIYRIAESIIRDRDGAPPPERDEEDLLSVLLRLQRSGGLKFALTTEIISTVIFDIFSAGSETSSTTLDWTMSELMKNPRILRKAQSEVRETFKGQDKLTEDDVAKLSYLQLVIKETLRLHPPAPLLIPRECRETCQVMGYDVPKGTKVFVNVWKIGREGEYWGDGEIFRPERFENSTVDFRGADFEFIPFGAGRRMCPGIALGLANMELALASLLYHFDWELPDGIKSEELDMTEVFGITLQGVHGGTETGGWPTVVRGDGRAVGTGTGSGHIVALVDGCAVTCGEVEGWGRERSMGKGRRWRWKGRGGGWRRPWTGRQTT

SEQ ID NO: 46663 - protein, 149 aa, Physcomitrella patens subsp. patens
QYHVLAVDDSMVDQRVIEKLLKPLHAVTTVDSAVRALDVLGLSETRPSSSKVLHFNSFVQIKKLDINLIMTDYFMPEMTGYDLLKRVKAKSSALKEIPVVLMSSENDSHRIRRCLAEGADAFLTKPVQLADVKRLRGYIRRQSSPSSSS

SEQ ID NO: 46664 - protein, 280 aa, Physcomitrella patens subsp. patens
MAERGGERGGFGRGFGRGDRGDRGGRGDRGRGDRRGGRRGAKRDEEEKWVPVTKLGRLVKEGKIKSLEQIYLFSLPIKEHQIVEFFLGSALKDEVMKIMPVQKQTRAGQRTRFKAFVVVGDNNGHVGLGVKCSKEVATAIRGAIILAKLSVIPVRRGYWGNKIGKPHTVPCKVTGKCGSVTVRLVPAPRGSGIVAARVPKKVLQFAGIEDVFTSSRGSTKTLGNFVKATFECLLKTYGFLTPDLWRETRFSKSPFQEFTDFLAKPHKISVVEDVEKTPVY

SEQ ID NO: 46665 - protein, 526 aa, Prochlorococcus marinus str. MIT 9303
MINRSEPSLIKQWLGNPPKDLLSGLVVAFAMIPEAIAFSGIAGVDPQVGLFGAFCLSVTIAIVGGRMGMITSATGSTALLMTGIVATGNAVGEGLGLSYLMAAGLLTGLLQILWGYLRLAYQMRFVPQGVLSGFVNALALLIFQAQFPQLGLNLHYGEDVVVDHATQVLPTAGQIPLVWGLVILGLVIIYGLPRITRLLPSQLVAIIVLTMISIGFNLDIPTVESLGSLPDGLPSFTLPFGSLADGKVPFNLETFGLVLPTALAVSLVGLIETFLTQDIVDDLTDTTSNKNVEARGQGIANVVSSLFGGMAGCALVGQSVMNTENGGRSRLSTLFSGVSLLLMILLGQGWLKQIPMAALVAVMIAIAVSTADIRGLRQLKKIPRSDTAVMLMTFAVTMLTTPHNLALGVLAGVALAGVLFSRKVAKVIRVSVIQVNPDELRYEVSGQLFFVSKVYFLQGFDIHEHPAKVTVDMSRAHIWDQSGVAALDQVIRKLRLGGSEVEVVGLNKESLDLFERIGGNQEPAHI

SEQ ID NO: 46666 - protein, 385 aa, Arabidopsis thaliana
  misc_feature (299)..(299): Xaa can be any naturally occurring amino acid
MKEGKDGFVRADQIDLKSLDEQLERHLSRALTLEKNKKKDEEDTTAVAIGGSASSSPVTLNGGGFVGKRKQRLEWEIDPSKLIIKTVLARGTFGTVHRGIYDGQDVAVKLLDWGEEGHRSEAEIVSLRADFAQEVAVWHKLDHPNVTKFIGATMGASGLQLQTESGPLAMPNNICCVVVEYLPGGALKSYLIKNRRRKLTFKIVVQLALDLARGLSYLHSQKIVHRDVKTENMLLDKTRTVKIADFGVARVEASNPNDMTGETGTLGYMAPEVLNGNPYNRKCDVYSFGICLWEIYCCXMPYPDLTFSEVTSAVVRQNLRPDIPRCCPSALAAVMKRCWDANPDKRPEMDEVVPMLESIDTTKGGGMIPNDQQQGCLCFRRKRGP

SEQ ID NO: 46667 - protein, 640 aa, Cryphonectria parasitica
MHRTVLLTLLSPSPELKKTHLSSPLSSFGRSPSQSTITDKDAKAQPQSGPSGTAPSPTPPDNNIASSEALTQTPVEFAPKPGILVVTLHEGRGFALPEPHKNIFSSHSTSASQGGGASIAGSVRTAPNGHRPNTSGGFGNVPTNHGRVSGKYMPYALLDFDKVQVFVNSVEGNPENPLWAGSNTQYKFDVSRVTDVTVHLYIRNPTAPPSVGRANDIFLGVVQIKPRFEEKHQFVEDPKANKKDREKAATEFAEKEKALGHSGVQWVPVGYGQGELKIGIEYVENRAGKLTIDDFDLLTVVGKGSFGKVIQVRKKDTSRIYALKTIRKAHIISRSEVTHTLAERSVLAQINNPFIVPLKFTFQSPEKLYFVLAFVNGGELFHHLQKEQRFDVNRSRFYTAELLCALECLHGFNVIYRDLKPENILLDYQGHIALCDFGLCKLDMKDEDRTNTFCGTPEYLAPELLMGQGYNKTVDWWTLGVLLYEMLTGLPPFYDENTNEMYRKILGEPLHFPSHDIVPPAAKDLLTKLLNRDPAQRLGANGSAEIKAHPFFHAIDWRKLLQRKYEPTFKPNVAGAMDTDNFDPEFTREAPQDSYVGGVPLSETMQNQFQGFSYNRPIAGLADGGGSVKDPSFIGSVTGR

SEQ ID NO: 46668 - protein, 652 aa, Zea mays
MASVSVVLLQRSSSRVRGYIRLQRIASSSVTLVLEGEGHWWWSNSRGRDERFGARTVHHMAGSVEGKTAACRWGGQVAMAPGVVTGGVEDAYGEDRATEDQTVTPWAVCIASGHSLLRDPRHNKGLSFTEKERDTHYLRGLLPPVVLSQDLQEKRMLQNVRQFQVPLQRYTALMDLQERNERLFYKLLIDNVEELLPVVYTPTVGEACQKYGSIFRRPQGLYISLKEKGRILEVLRNWTEKSIQVIVVTDGERILGLGDLGCQGMGIPVGKLALYTALGGVRPSACLPITIDVGTNNEDLLKDEFYIGLKQRRATGQEYSEFLDEFMAAVRQNYGQKVLVQFEDFANHNAFTLLEKYRTNHLVFNDDIQGTAAVVLAGIIAALKSVGGTLADHTFLFFGAGEAGTGIAELVALEISRQANVSVEEARKKIWLVDSKGLIVASREETLQPFKKRYAHEHEPVKDLLGAVKAIRPTALIGSAGVGQSFTKEVIEVMSSINERPIVLALSNPTSQSECTAEQAYTWSQGRAIFGSGSPFDPVKYNDKLFVPAQANNAYIFPGFGLGVVISGAVRVSDDMVLAAAEALAEQVTPEHIEKGLIYPPFSIIRKISANIAAHVAAKAYDLGMATQLPRPKDLVKYAESCMYSPVYRSYR

SEQ ID NO: 46669 - protein, 385 aa, Brassica napus
MKDRSAKRKVVVRHLPPSLSEPDLLSQIDSRFGDSYSWFSFRPGKSNYKTQKHSRAYFGFKSPEDVYEFAAFFNGHVFVNEKGAQFKAIVEYAPSQRVPKPCDKKDPREGSITKDPDYLEFLKLIAPPVENLPSAEVQLERREAEQSGASNPAPIVTPLMEFIRQKRATVIGSQGSLDVRRGGRRSRAVSANKPSSRPSKRISEKKKYVEKDTSKSVRSSKQDNSSTASVMDSSLPGISLTMESGKKKILLLKKDRDTPVNSPPQPEQQMETILSSTSRQNQKIGDVGGRLIKGMLVRKEPRPSQSSTLVQPEPRVEPSEAENYKRPPRADGIYAGKDYHVSGTNTEKQERRPRNRDRPDRVVWAPLRRADGSNNSEDQLSSSAA

SEQ ID NO: 46670 - protein, 634 aa, Oryza sativa
MAIPGAYAHAVQALATGILFVVVSLVLDHVEGRHHKCPSFSCGHLKGVSAPFRRAADPPGCGSKSYELVCSDTNATILIDNATYHVNEINYDYRRFWVVDANIAGSTCPLPQWNHLLDQYKRKVSGHRIEIELAPGAYNHAYFVRCSREVKDNGIYRPVTCASSNYSFIYVLLSSDSDNPGYIESLEPSCGYLAMTLLGDWRSTTVPRNASYEDVKKFMRGGFTVRFPVNYGAGNINECLMDSISLSRLLLTPVRCMYYAVLCRFVLVPLAILTFLAHKYWKTRLAIDAVEKFLQMQQVLGPTRYAYTDLTAVTSHFRDKLGQGGYGSVYKGVLLSGDVHVAVKMLNGTSTYDGEEFISEVSTIGRIHHVNVVRLVGFCSEELRRALVYEYMPQGSLDKYIFSSERSFSWDKLNEIAIGIARGINYLHQGCDMQILHFDIKPHNILLDDNFVPKVADFGLAKLYPRNKSFVSDRALRGTVGYIAPEMVSRSFGVISSKCDVYSFGMLLLEMAGGRRNADPNTNPNASQSYYPSWVYGQLTGEQVGETSGAADMHELQKKLCLVGLWCIQMKSHDRPTMSETIEMLEGDVNALQVPPRPFFCDGDFMPNVMDSYLHSSELTAISEDDGAIEFASN

SEQ ID NO: 46671 - protein, 154 aa, Bacillus subtilis subsp. subtilis str. 168
MNIIQGNLVGTGLKIGIVVGRFNDFITSKLLSGAEDALLRHGVDTNDIDVAWVPGAFEIPFAAKKMAETKKYDAIITLGTVIRGATTHYDYVCNEAAKGIAQAANTTGVPVIFGIVTTENIEQAIERAGTKAGNKGVDCAVSAIEMANLNRSFE

SEQ ID NO: 46672 - protein, 398 aa, Bacillus subtilis subsp. subtilis str. 168
MFHPIEEALDALKKGEVIIVVDDEDRENEGDFVALAEHATPEVINFMATHGRGLICTPLSEEIADRLDLHPMVEHNTDSHHTAFTVSIDHRETKTGISAQERSFTVQALLDSKSVPSDFQRPGHIFPLIAKKGGVLKRAGHTEAAVDLAEACGSPGAGVICEIMNEDGTMARVPELIEIAKKHQLKMITIKDLIQYRYNLTTLVEREVDITLPTDFGTFKVYGYTNEVDGKEHVAFVMGDVPFGEEPVLVRVHSECLTGDVFGSHRCDCGPQLHAALNQIAAEGRGVLLYLRQEGRGIGLINKLKAYKLQEQGYDTVEANEALGFLPDLRNYGIGAQILRDLGVRNMKLLTNNPRKIAGLEGYGLSISERVPLQMEAKEHNKKYLQTKMNKLGHLLHF

SEQ ID NO: 46673 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGSCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 46674 - protein, 506 aa, Lactococcus lactis subsp. lactis Il1403
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 46675 - protein, 312 aa, Hevea brasiliensis
METFPVIDLSKLSDEERKPTMEMIHDACENWGFFELVNHGMSPELMDTVEILTKEHYRKCMEQRFKEMVARKGLEAVQSEINDLDWESTLFLSHLPVSNTAEIPDLDEEYRKTMNEFAAELEKLAEQLLDLLCENLGLEKGYLKKAFCGSKGPTFGTKVSNYPPCPKPDLIKGLRAHTDAGGIILLFQDDVVSGLQLLKDGQWIDVPPMKRSIVINLGDQLEVITNGKYKSVMHRVIAQTDGTRMSIASFYNPGSDAVIYPAPALVEKEAEKTPGYPKFVFEDYMKLYAGLKFQAKEPRFEAMKAMDPIATA

SEQ ID NO: 46676 - protein, 318 aa, Hevea brasiliensis
MEFPVINLGKLNGEERAATMAKIKDACENWGFFELLNHGIEPEFMDTVERMTKGHYRKCMEQRFKEMVASKGLEGVQTEIKDMDWESTFFLRHLPESNIAQVPDLDDEYRKVMKDFAAKLEKLAEELLDLLCENLGLEKGYLKKAFYGSRGPNFGTKVSNYPPCPKPDLIKGLRAHTDAGGIILLFQDDKVSGLQLLKDGQWIDVPPMRHSIVINLGDKLEVITNGKYKSVEHRVVAQTDGTRMSIASFYNPGNDAVIYPAPALVEKEAEEKKQVYPKFVFEDYMKLYAGLKFQPKEPRFEAMKAVESNVNLGPIATA

SEQ ID NO: 46677 - protein, 121 aa, Vibrio angustum S14
MSITNEQILDAVAEMSVMQVVELIEAMEEKFGVTAAAAVVAGGAAADAAEEQTEFDVVLTAVGANKVAVIKAVRGATGLGLKEAKAVVDGAPAPLKEGIEKAEAEALKAQLEEAGASVEIK

SEQ ID NO: 46678 - protein, 570 aa, Bacillus cereus G9241
MTLNIQGIAASSGIAIAKAFRLENPEFNIEKKSITNEAAEIARLEAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTISEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSDSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLGLDEFSMSATSILPARTQLSKLSKAEMETLAEKALMMSTAEEVVELVKSI

SEQ ID NO: 46679 - protein, 505 aa, Cicer arietinum
DKVPHSSSSSKVANKAIQQSNLSFSSSHLSGDKIVTLSGAGRGRCTRKHVIVTPKAVSDSQNSQTCLDPDASRSVLGIILGGGAGTRLYPLTKKRAKPAVPLGANYRLIDIPVSNCLNSNISKIYVLTQFNSASLNRHLSRAYASNLGGYKNEGFVEVLAAQQSPENPNWFQGTADAVRQYLWLFEEHNVLEFLILAGDHLYRMDYEKFIQAHRETDADITVAALPMDEKRATAFGLMKIDEEGRIIEFAEKPKGDQLNAMKVDTTILGLDDERAKEMPFIASMGIYVISKNVMLDLLSDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIFHSVIGLRSCISEGAIIEDTLLMGADYYETDADKRFLAAKGSVPIGIGRNSHIKRAIVDKNARIGENVKIINSDNVQEAARETDGYFIKSGIVTVIKDALIPSGTVI

SEQ ID NO: 46680 - protein, 463 aa, Magnaporthe grisea 70-15
MATAASSVAPVVTLYHADQAAHFPSNSTFPITEIHKDDLESQLNENKRSVSVNIGINPAQSQEVTPTGPIPPPEITDTIEIDENVVKAFPDKGAKVLGAVGYGKSLWGITARIEVELPDGRKRKYFMKALKQGELSRVICEGELRSLQEIYKTSPGFCPEPYGWGRFASDPEMYFLLVEFRDIGASLPLTTHHSNHQPAEPSKLAASLARLHSNSQSPTGKFGFGMRTCHTLIDQAVDFWSDSWAAVYGSHLRHVVELAKPFVKWPEFDIVADLTVDKVVPRLLLPLQAGVRTLKPCLVHGDCWDGNTAMDGKTGEAFIFDVCSFYAHNEYDTGNWRTPRHRLSNPAYIKAYKKLIRPSEPAEEWEARNILYSLPFNLGNVMFVPGSTQRQVVYQDMTNLCKMFCPQDLELRMASLGLANESSNDRGGENKVKGTGPCACEEDEEEEEEEEEEEEEEKYERRL

SEQ ID NO: 46681 - protein, 352 aa, Arabidopsis thaliana
MAVFQLPSLSPEIPFRFTPTPLKFSNRRRINFFRPLSATDDSRSGAPDPESPNQMFILGMGFVGGFFAQQLKESDWVVSGTCRSDSKKKEWEKRGINLHPFSADSPEWSLLDSVKDYTHLLISIPPLADIGDPMLRNVELVRDKLSSGNLRWLCYLSSTSVYGDCGGAWVNENHLPNPKTQSAKVRLAAEQGWLSLGRDLGVSTQILRLGGIYGPGRSAIDTLLKQERLSEGQKRRASRKFTSRVHVEDICQVLKAATEKPASGEIYNIVDDDPAAREEVFEYALELIEKRWPGNITTKPFPFLYESREESSLRGEKRVCNERMKDKLGVKLLYPSYKSGLQSIVENMDNRF

SEQ ID NO: 46682 - protein, 463 aa, Ustilago maydis 521
MSSAPPPTRPATGRKRAPSFSEAIAQVPQNANAQDETADPVVADRIAAADAAAAAAAIKDPVAASTSTATATATKKGKYSFQDDEIYRSQGLIKDLTTFRWMTAPASSFQLAAIFVLAYFNWNFFIGTPDNNPIAPFLMLSHRVPQSQVVLDSLPPKDGVQRALQNLIPRSAESLEARYQKGYNDLFFLVFYVIVFSFVRQSTTLYIFKPFAKWWGIKSESKQARFTEQGYAVLYWGSAAALGLYVMSFQDSWWYNLEHLWLKYPHWQMRSELKLYYLLQFSFWLQQALVMLLRLEAPRKDYYELIAHHLVTLWLIGWSYLINLTMIGTTVFVCMDIPDTWLGFSKALNYMGLDNITVVIFALFMVIWTYFRIYLSAATLHSVWYQFDLIPRYAREWEPEKGWWLVWWMKYQIFAPLFLLLLLNLFWYVLMWRIMFRAIKGNVADEREDGEYDDDEDHEKKTQ

SEQ ID NO: 46683 - protein, 876 aa, Vitis vinifera
  misc_feature (378)..(378): Xaa can be any naturally occurring amino acid
  misc_feature (538)..(538): Xaa can be any naturally occurring amino acid
  misc_feature (560)..(561): Xaa can be any naturally occurring amino acid
  misc_feature (564)..(564): Xaa can be any naturally occurring amino acid
  misc_feature (619)..(619): Xaa can be any naturally occurring amino acid
  misc_feature (712)..(712): Xaa can be any naturally occurring amino acid
  misc_feature (747)..(747): Xaa can be any naturally occurring amino acid
  misc_feature (771)..(771): Xaa can be any naturally occurring amino acid
  misc_feature (773)..(774): Xaa can be any naturally occurring amino acid
  misc_feature (797)..(797): Xaa can be any naturally occurring amino acid
  misc_feature (804)..(804): Xaa can be any naturally occurring amino acid
MDASPIYRLPQDTLHYIFSTLPLRQIIICRSVCKFFYQTLTAPAFMELISTQPPLNLIALRPPHHHHHHHHHHHNRDVSSHNALHVFDPSSNQWVRFPLSFLPFRSPTPVASSLGLVYLWADSLNSLESNKSLIVCNPLTRSFQVLPQLGSAWSRHGSVLVGSPNRVLVLTELATLYFSGSDQWLKFSSNLPSKPRSPILVSDSVLALCDVGSPWRSQWKLFACTLNHLQKSQPWTRLDRHEWGDVFDILKTTPFGERAWEPNSNGWWIEIFVFIECCVFYNFDFEVGFGLTGVGRVGSNAPGNRRGREIGGGSMGCLEMEMACFGVLCSRLGSLHCLDRRVSPKAVNIIDHICAVLRMGRAALRLATTNIVKKENRXEEARWYSLIFPKRRGLLKGWPVLAEKLCLLGVVTKEESKKGVSTANGHQISMVALENGSFVEAVKKELGKVGVVELRCRASRVWSLKRGLKLSILEVALFLFDFEDRSEGEGVLARSQRRFKENVLDLERWNPENAGEDDEKTSHAIVGVSLEKPVEQLXWGCMLLPEGRGNKASKGIVPSXXTSXAQVLQLRGGVRGFVEGDNLGKEKGMKEDFGLLAHDVGKSGLLRLGQASILFGKGXIEATGPSAIGDLVAHLAMGCSSKEHPLVARRGSVRGTWHSQSDEEEHKSSLPTDNNQSTKVDQRGSKAMRESESEHVSDDDEGVTDMEKRRYXICISKGRGDKGGWASMVESLRNMGFWFDKKENKQXERATGRSYVEVAKGPRSRDSTRVXVXXWQDWGKGRVLLEFEFVEEARNVXASGKRSXGGLQMGLERWSPKSRCSTEVEARNEAWEGNMLSLAVAEGPTVSGKGCWDLVEVNCAAIEVQNPKWNSARAES

SEQ ID NO: 46684 - protein, 417 aa, Photobacterium sp. SKA34
MDSKVVVPVEGQKITLDSDGKLVVPNNPVIPYIEGDGIGVDVSPAMIKVVDAAVKKAYAGDRKIEWMEIYTGEKSTQIYGEDAWLPQETLDFIRDYKVAIKGPLTTPVGGGIRSLNVALRQELDLYICARPVRYFDGVPSPLKQPELTDMVIYRENSEDIYAGVEFQAGTAEADKVIKFLQEEMGATKIRFPQQCGVGIKPVSEEGTKRLVRAAIQYTIDNDRDSLTLVHKGNIMKFTEGAFKDWGYEVALQEFGAELLDGGPWMTLKNPNTGKEIVVKDCIADAFLQQILLRPAEYDVIATMNLNGDYVSDALAAQVGGIGIAPGANIGDGIALFEATHGTAPKYAGQDKVNPGSLILSAEMMLRHLGWVEAADLIISSMEAAISNKTVTYDFERLMDGATLRKCSEFADDMIEQM

SEQ ID NO: 46685 - protein, 361 aa, Frankia sp. EAN1pec
MRIFVVGSGVVGTATGRGLLDAGHRVTFIDVSPERVAFLNEIGLDARPEIDLRSEGDSLVFLTLPTPNAGSRYDLAAFVAGTRGLGRALCETSAVHTVVVRSTVDPGTTEGLVGPLLEQESGLRQGSGFLLASNPEFLRASSAAEDFRWPWMTVIGARNRRVQERLAELFAPFGGTMRIFGDPTTAEFVKCAHNIFNATKISFWNEMHVVAERLQIDLGAVSETVSRSAEASFNPAYGTRGGAPYGGVCLPKDTMAFLGFAAGVGVDMPILRSVIEMNSRFVDRVAADGAVSGERVAELVGGRAADSLGDRSGNGFGDGFGGGATEPGAGLASARALWSPDRLPRQPRDSRGVEATEGAPR

SEQ ID NO: 46686 - protein, 412 aa, Thermotoga maritima MSB8
MERHTVNEIEIFTIPFDKARTISCAFLIKKGSAHEPEELAGISHFIEHMAFRGTKSYDHFSLKYTVEVVGGTLNAFTDKLATAYYAKVPEFHFGKTLNVLKEITFYPIFSPEDTEIERKIILEEYKMSQDDPTSKLFDTLVETVWPGPYGRPIIGRKETIEKISSEDLREYHRKNYNLPDTKIILAGKVNDDYLSLLEKELSELERNKPGDPLPPPPSFEHTEPRYIVRNDLEQVHIAMARPICGRISEDIYPLYALNTALGSGMSSILFHEIREKEGFVYDVFSQIYALKETGIIIVYAALSPEKIDEFFSKMKDVLSNESLFMKNFEYGKMRYLGKLDMVTDNPAGMMSFVIDDLSNDSLETIEERVERIKNVSKEDYRRAYERFIAGNWSVFGIGPESGKIIEKHEMIV

SEQ ID NO: 46687 - protein, 482 aa, Thermotoga maritima MSB8
MKEALTFDDVLLVPQYSEVLPKDVKIDTRLTRQIRINIPLVSAAMDTVTEAALAKALAREGGIGIIHKNLTPDEQARQVSIVKKTENGIIYDPITVTPDMTVKEAIDLMAEYKIGGLPVVDEEGRLVGLLTNRDVRFEKNLSKKIKDLMTPREKLIVAPPDISLEKAKEILHQHRIEKLPLVSKDNKLVGLITIKDIMSVIEHPNAARDEKGRLLVGAAVGTSPETMERVEKLVKAGVDVIVIDTAHGHSRRVIETLEMIKADYPDLPVVAGNVATPEGTEALIKAGADAVKVGVGPGSICTTRVVAGVGVPQLTAVMECSEVARKYDVPIIADGGIRYSGDIVKALAAGAESVMVGSIFAGTEEAPGETILYQGRKYKAYRGMGSLGAMRSGSADRYGQEGENKFVPEGIEGMVPYKGTVKDVVHQLVGGLRSGMGYIGARTIKELQEKAVFVKITPAGVKESHPHDIIITKESPNYWVQA

SEQ ID NO: 46688 - protein, 266 aa, Prochlorococcus marinus str. MIT 9303
METPFRNVTPNTPGGAASLLIALLFSGLILITQALFVVPAGQVAVVTTLGKVSGGSRLPGLNLKIPFIQAVAPFDVRTQVRPEKFASLTKDLQVIEATATVKYAVRPNEAGRVYSTIASNDREIYPRIIQPSLLKALKSVFSQYELVTIASKWSDISELVERAVADELDKFDYVEVRGLDLTGLVIAEEYRAAIEQKQIAEQQLLRAQTEVKIAEQEAQRYETLNRTLDDKVLFKLFLDKWDGSTKVVPALPGTKGGGTPVIVGGR

SEQ ID NO: 46689 - protein, 152 aa, Brassica napus
MALGALARLLRLAPTPRLARPFAAKVRASRPQEPELPSEDDNDFAGGKLTAPTEGIGKPLAEVLKELGKRVPDSLVKTRVENNGFAIKYIPWHIVNKILNIHAPEWSGEVRSIVYSFDGKTVSVVYRVTLHGIDAEIYREATRTASVDDTSY

SEQ ID NO: 46690 - protein, 371 aa, Gibberella zeae PH-1
MFRPTARRLAASAAKAAAAPTSHTLNVARAQGVSRGLTGAIGNTPLIRLNRLSDETGCEVLGKAEFMNPGGSVKDRAALYVVKDAEERGLLKPGGTVVEGTAGNTGIGLAHVCRSRGYKLVIYMPNTQSQGKIDLLRLLGAEVYPVPAVAFDNPENYNHQARRHAERLDNAVWTNQFDNTANRRAHIETTGPEIWAQTDGKVDAFTCATGTAGTLAGITRYLKDVSNGRVKSFLADPPGSVLHSYVSSGGKLNERTGSSITEGIGQGRITDNLQPDIGLVDGSLHISDEKSIKMVYRCLDEEGLYLGASSSLNVVAAKEVAEKLGKGHTVVTVLCDGAYRYADRLFSRKWLTDKKLLGAIPKHLEKYIVLP

SEQ ID NO: 46691 - protein, 221 aa, Cryptococcus neoformans var. neoformans JEC21
MSNEANRELARLWRVSRTVHEMVRDRGYLLADYEINVSFEEFKDRHGATGSVEWMKCPQADKSSSRSNMSFDAIHENDNTDKIFVYFCADKNVSKASMKTFIGSMDKMGARRGIIIWSEKMSPAAKKTLQEMQSEYHLEDFPESDLLVNITKHFLVPKHTVMKPEEKSALIKRYRLKETQLPRIMITDPVAKYYGLKRGQVMKIERASETAGRYITYRICM

SEQ ID NO: 46692 - protein, 122 aa, Glycine max
MRESRIHEFACGGFIVQQAEIGLIGLGVMGSNLALNIAEKGNRIAVFNRTPARTDEFLGEAGDLADRIIGCHTIEEFVAAIRPPRPIIIMIKAGEAVDQQMAALLPHLAKNDIMIDAGNANF

SEQ ID NO: 46693 - protein, 113 aa, Staphylococcus aureus
MSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 46694 - protein, 411 aa, Arabidopsis thaliana
MTSIIGAALPYKSPEKAIASSSYSAENDSSPVDAVIFAGTSLVLGTACRYLFNGTRVPYTVVLLVIGIFLGSLEYGTKHNLGKLGHGIRIWNGINPDLLLAVFLPVLLFESSFSMDVHQIKRCMGQMVLLAGPGVLISTFCLGALIKLTFPYNWDWKTSLLLGGLLGATDPVAVVALLKELGASKKMTTLIDGESLMNDGVSVVVFQLFFKMVMGHNSDWGSIIKFLVQNSFGAVGIGLAFGIASVFWLKFIFNDTVAQITVTLSASYFAYYTAQEWAGVSGILTVMILGMFFAAFARTAFKGDSHQSLHHFWEMAAYIANTLVFMLSGVIIAESVLSGQTISYKGNSWSFLFLLYLYVQLSRCVVVGVLYPLLCRSGYGLDWKESIILTWSGLRGAVSLSLALSVKLSVI

SEQ ID NO: 46695 - protein, 116 aa, Nostoc punctiforme PCC 73102
MATWQCVKQCGACCNLDPADRPDLDEYLSPPELELYLSMVGEGGWCVNFDHTTRECRIYSDRPRFCRVESEVFQDMYGVEPEEVNDFAIDCCRQQIEGVYGDRSLEILRFDKAIGL

SEQ ID NO: 46696 - protein, 517 aa, Lactobacillus johnsonii NCC 533
MAKTNLNDFDKIIVLDFGSQYNQLITRRIRDFGIYSELLPHDLSIEKIKEMAPKGIIFSGGPNSVYDKGALKVDPEIFKLGIPILGICYGMQLMSYDLGGKVEKADNSEYGRADIEVIDPNAVLFEGLPREQYVWMSHGDLVTKAPEGFTITAKSKNCPISAIANDEKKFYGIQFHAEVRNSEYGLDILKNFAFKVCGAKANWTMDDFIEMQVDEIRKKVGDKKVILGLSGGVDSSVTATLLHKAIGDQLTAIFVDHGMLRKDEGDQVMQALNKDLGVNIIRVNAQERFLNKLKGVTDPEQKRKIIGKEFIEVFNEEAKKLKDVDFLAQGTLYTDVIESGTNTAQTIKSHHNVGGLPEDMHFELIEPLRKLFKDEVRELGEKLGIPHDLVWRQPFPGPGLGIRVIGEVTEDKLKIVRESDAILREEIKNAGLQEDIWQYFTVLPGIRSVGVMGDGRTYDYTIGIRAVTSIDGMTADFAQIPWDVLSKISTRIVDECDHINRVVYDITSKPPSTIEWE

SEQ ID NO: 46697 - protein, 292 aa, Arabidopsis thaliana
MTSIIGAALPYKSPEKAIASSSYSAENDSSPVDAVIFAGTSLVLGTACRYLFNGTRVPYTVVLLVIGIFLGSLEYGTKHNLGKLGHGIRIWNGINPDLLLAVFLPVLLFESSFSMDVHQIKRCMGQMVLLAGPGVLISTFCLGALIKLTFPYNWDWKTSLLLGGLLGATDPVAVVALLKELGASKKMTTLIDGESLMNDGVSVVVFQLFFKMVMGHNSDWGSIIKFLVQNSFGAVGIGLAFGIASVFWLKFIFNDTVAQITVTLSASYFAYYTAQEWAGVSGILTVMILGIF

SEQ ID NO: 46698 - protein, 282 aa, Bacillus thuringiensis serovar kurstaki
MFKKIGIVGAGTMGIGMAVDLVLHGLETVLIDVTEEQLEIAEEKILETVRFAPLINKAFPRMHKEEVLSLISSSTNLDEVAECDYIVENVPENWQIKEPIYRRLDEICKKDTIFGVNTSCISITKVGGVTKRPDKIIGMHFMNPVYMKPSIEVIRGYLTSDETVEKAQSFLKQLDKDAIVVNDQTGFVSNRISHLFMNESAWVVMDGVATPKQVDDIFKKCFGHTMGPLETADLIGLDTVLHSLNVLYEEYQDPKFRCCPLLKKMVDAGECGRKSGKGFYAY

SEQ ID NO: 46699 - protein, 122 aa, Populus trichocarpa
MASKLTQLQSKACQASKFVSKHGSAYYKQLLEQNKQYIQDPPSVEKCNLLSKQLFYTRLASIPVRSEAFWKELDYVKHLWKHRQELKVEDAGIAALFGLECFAWFCAGEIVGRGFTFTGYYV

SEQ ID NO: 46700 - protein, 497 aa, Myxococcus xanthus DK 1622
MGSDDAFMQTMQSSAEAPVSDAGPRASDEELQEGSTLGNYQLEQLLGEGSMGRVFQARHTRLGRQVALKVLRPEHARDGGFVRRFFQEARTVNQINHEHIVEIFDFVDESAMGGHVYCVMELLRGQSLSSLAQAEPLTLARIQRFVVQVCAALGAAHQVGVVHRDVKPDNLFVIHRAGQPDFVKVLDFGVAKLLTAEGSTTGTVDGTIIGTPAYMAPEQAAGLPVDARSDIYAVGNILYELISGKPPFQAPAFGHLVVQIITQPPPPLPSHLPSGEPVPPQLAELVMRCLSKEPEARPQSLTEVTTSLLLLPASAQALTPAPAELALEASERPTHKVQVAVTGRWHRRAVVTVGTAALVVVAAVVTWSGMQPEPAPAEAPVAQVADVVGRPAAAPQLLPPVTLTVRSFPEGAQVLRLDTGELLGVTPLVKQVSGEAAPLRLRVELAGYAPLERMVDLDKHAELEVPLVKALPSPRQKPAAGTQRDTGKKSRERPVAQ

SEQ ID NO: 46701 - protein, 221 aa, Arabidopsis thaliana
MNYSNNYIEHQNKKKTIIIFFRQFKKQKPMLRMGVHLVGKTKKIFVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLNREAHRKYNTSKFFHAARSEPAGFLL

SEQ ID NO: 46702 - protein, 501 aa, Debaryomyces hansenii CBS767
MSSSKERVPQVRNPTLPSQTTPEQRYWRGFSNPQLVKENYPITSIDFNPVSPNDFAVTSSTRIQVFSSKTRQVIKTFSRFKDTVYSGQYRYDGKLLVAADASGLVTIFDSYQPRSLLVSLNPSSHPTHVAKFHPTIGNQLITGSDDRIVRLYDISQTTKGPITEFNDSYHGDYIRSANFIPGNPNLITTGCYDGIVRIFDTRQQQVVAKFNQGNPVEDLLALSPTTLVSAGGPQVKIWDLTRGSQINELNNFTKTATTLHNTGDRGLLVGSLDGHVKIFDSSSSNWDVKFGWKFGSGGVLSCGVSPSPNHKHFVTGLTSGLISIRTRKTEPKVKQGVKEYKSNAYNKMMRGSDYLGEEEHRIINSATTQTKKLKQFEKHLNAFRWSEALDSAFATGLPKEQTVTVLNELKKRGKIRISLYGRDEISLLPILQWFIKNLEDVRSINLICDFIGVMLEMYGTLIDKSAVLEESFATLLKRINIEIKKCKEANEIGGMLELLTV

SEQ ID NO: 46703 - protein, 498 aa, Glycine max
MSFFSSSNLATAKTVLSAAASVAATAMVVRSVASDLLPSELRSYITNGIHSMFWRFSSEITLVIDEFDGLLNNQIYEAAETYLGAKISPNTRRLKVSKPETDTTFALTMERNESLTDVFRSMKFNWVLVCRQVESRGFHNPRDLNATMKSEVRSLELTFNKKHKDMVLQTYLPYILNEAKSMKQATKALKIFTVDYQNMYGNISDAWVGMKLDHPATFDTLAMERGAKEFVMRDLERFVKRKEYYRRVGKAWKRGYLLYGPPGTGKSSLIAAMANYLKFDVYDLELTELNANSELRRLLIAMANRSILVVEDIDCTVEFHDRRAEARAASGHNNDRQVTLSGLLNFIDGLWSSCGDERIIVFTTNHKDKLDPALLRPGRMDVHIHMSYCTPCGFRQLASNYLGIKEHSLFEKIEEEMQKTQVTPAEVAEQLLKSSHIETSLEQLIDFMRKKKETQKLEAKKKEQEAKEEQQRKEIDDGGKGEKVDSDDNNNEKKSTTT

SEQ ID NO: 46704 - protein, 473 aa, Oryza sativa
MAAPPATASAPSLRPSAASPRAAAARSVAVPSGPRTVVPRRDGGRFLGVRAAKAVSGVQSGTVVDDGVQRPWKLSDARLVLEDGSVWKAKSFGASGTQVGEVVFNTSLTGYQEILTDPSYAGQFVLMTNPHIGNTGVNPDDEESNRCFLAGLIIRNLSICTSNWRCTETLEEYLMKRNIMGIYDVDTRAITRRLREDGSLIGVLSTDQSRTDDELLEMAKNWKIVGVDLISGVTCDAPYEWSDKTDSEWEFKKGQSTESFHVVAYDFGIKHNILRRLTSYGCKITVVPANWPASEVLNLKPDGVFFSNGPGDPAAVPYAVKTVQEIIGKVPVFGICMGHQLIGQALGGKTFKMKFGHHGGNHPVCDLRSGRVDISAQAFRITGVGRGAGLLAVTLPDENLELLRNHNYAVDPESLPEGVKVTHINLNDNSCAGLQYPKMKLLSLQYHPESSPGPHDSDLAFGEFIEMMKNNRL

SEQ ID NO: 46705 - protein, 325 aa, Frankia sp. EuIK1
MIATRRSSPPASGPSAASRPPDRVGPVDARGRSETAVPATALAPTGLAPAPAPAPVPVAVPAPAQRSGGASLPGRYDRQLGLPGFGPAAQERLRGATVLVAGIGGVGGAAATYLAAAGVGRLVLVHPGALEEADLNRQTLMRPEWIGGSRVACAEQTLRAHHPGVEIVALDRELSQLPELGRLVAEADVVVDARHNFPDRYLLNDVCVATRTPAVVAAMNATEGNMLVVRPGSPCLRCVFAEGDPSWQPLGFTVLGAVSGMVGCLAATEAIKIISGFGEPAAGRLLQFDLWDLDFQVLRARRDPHCPTCGGPSGSSPRPGPGEPQ

SEQ ID NO: 46706 - protein, 181 aa, Pyrococcus woesei
MVDMSKVKLRIENIVASVDLFAQLDLEKVLDLCPNSKYNPEEFPGIICHLDDPKVALLIFSSGKLVVTGAKSVQDIERAVAKLAQKLKSIGVKFKRAPQIDVQNMVFSGDIGREFNLDVVALTLPNCEYEPEQFPGVIYRVKEPKSVILLFSSGKIVCSGAKSEADAWEAVRKLLRELDKY

SEQ ID NO: 46707 - protein, 441 aa, Frankia sp. EAN1pec
MRITRMRAVTAGVLGAAMTAAAVPAWAVPTPTATANPSADIAEGILGSPDPTASAGSGITVNLDPSASPSAAPGATPSVGPSPSPGTGPGVIISSPSATPTGTGDATLDQFLSLLPFRLPFDREINGIDDFETNPLRLSYTCTGAGPAWRVSNQSDVAFGFGWFDTSQGSGISALGPRQSLELPSHAMAVIASPWNETTGNLLVTVPAVGVSTCAGTPAPTVIPGGGGVGATPTVGAGVGAGAGGGTGGGGTGGGGVPGSGTGGGGTGTGGGGVPGGGTGGGAPTGGGGAPAGGGTGGGGGTGTGTGGGGGGGTGTGTGGGGGGGGGTGTGGGGGGGTGTGTGGGGGTGGGGGTGTGTGTGGGGGGGGGGGTGTGTGTAGGGGGGGGGGGAPAGGGGGGGGGTPSGGGGGGGTPAGGGGGGLPIAAPAAPTAVSAVPYYTG

SEQ ID NO: 46708 - protein, 714 aa, Escherichia coli O157:H7 EDL933
MEMTSAFTLNVRLDNIAIITIDVPGEKMNTLKAEFASQVRAIIKQLRENKELRGVVFVSAKPDNFIAGADINMIGNCKTAQEAEALARQGQQLMAEIHALPIPVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKKDRPSSRPLPVRERILAGPLGRAQLFKMVGKKTEHKTQGNYPATERILEVVETGLAQGTSSGYDAEARAFGELAMTPQSQALRSIFFASTEVKKDPGSDAPPAPLNSVGILGGGLMGGGIAYVTACKAGIPVRIKDINPQGINHALKYSWDQLEGKVRRRHLKASERDKQLALISGTTDYRGFAHRDLIIEAVFENLELKQQMVAEVEQNCAAHTIFASNTSSLPIGDIAAHATRPEQVIGLHFFSPVEKMPLVEIIPHAGTSAQTIATTVKLAKKQGKTPIVVRDKAGFYVNRILAPYINEAIRMLTEGERVAHIDAALVKFGFPVGPIQLLDEVGIDTGTKIIPVLEAAYGERFSAPANVVSSILNDDRKGRKNGRGFYLYGQKGRKSKKQVDPAIYPLIGAQGQGRLSAPQVAERCVMLMLNEAVRCVDEQVIRSVRDGDIGAVFGIGFPPFLGGPFRYIDSLGAGEVVAIMQRLATQYGSRFTPCERLVEMGARGESFWKTTATDLQ

SEQ ID NO: 46709 - protein, 239 aa, Ginkgo biloba
MAAAFSALVLPKWTDDSSLKSAISWVHNHQLRPINFSTHICVSRAPTLRRGNQFKRPVCQSANPAVEIKKQSAVAKSAPVLPFRVGHGFDLHRLEPGLPLIIGGIDIPHDRGCDAHSDGDVLLHCVVDAILGALGLPDIGQLFPDNDPKWRGAASSVFLKEAVRLMHEAGYELGNLDATLILQRPKLSPHKEAIRTNLCELLGSDPSVINLKAKTHEKVDSLGENRSIAAHTIVLLMKK

SEQ ID NO: 46710 - protein, 575 aa, Physcomitrella patens subsp. patens
SGLISNTDAWRDLQDHVDEIFGMHLKDLMQDRERCKSMIKEFNGIVLDYSRQRATQCTFQKLLALAKEANVKEKIEAMFSGVHINKTENRPVLHIALRAPRGVEIMCDGKDVMREVWEVLDKIRSFSDQVRTGTWVGETGKVLTDVVAIGIGGSYLGPLFAYTALQTDPEAAKLAKGRRLRFLANVDPVDVAIAINGLNPETTLVVIVSKTFTTGETILNSKTMRSWLIAPSCVAKHMVAVSTNLKLVKEFGLNPDNSFGFWDWVGGRFSVCSAVGILPLALQYGFAKVQEFLEGAWSVDCHFKTAPLEDNFPVLLGLISVWNVSFLRCPARAILPYSQALQKLAPHIQQLSMESNGKAVAMDGTPLNYHAGEIDFGEPGTNGQHSFYQLIHQGRLIPCDFIGVIKSQQAVNLQAGELVSNHDELMCNFFAQPDALAYGKTRVEACKEGIPEELVPHKMFTGNRPSLSILLPTLDAYTAGQATLYEHRIAVQGFVWGINSFDQWGVELGKSLATKVRQTMHNFRTKGESVCDYNYSTTFMLNRFLQVYGLSCLQNLLTVPSSSRTGWWLIATNPM

SEQ ID NO: 46711 - protein, 409 aa, Aspergillus nidulans FGSC A4
MFNKLSGQPESYEKKSLYRFGRTLGAGTYGIVREADCSSGKVAVKIILKRNVRGNERMVYDELDLLQKLNHPHIVHFVDWFESKDKFYIVTQLATGGELFDRICEYGKFTEKDASQTIRQVLDAVNYLHQRNIVHRDLKPENLLYLTRDLDSQLVLADFGIAKMLDNPAEVLTSMAGSFGYAAPEVMLKQGHGKAVDIWSLGVITYTLLCGYSPFRSENLTDLIEECRSGRVVFHERYWKDVSKDAKDFILSLLQVDPAQRPTSEEALKHPWLKGESASDRDLLPEIRAYIARSRLKRGIEIIKLANRIEALKMQEEDEEDIPSAVDVQASEASDKSGLSPFPALSTENSNTHPASTGNGESGGTKKRSLSKIARGAIFREVVLAKVREMKENEEREKVEREARERAHS

SEQ ID NO: 46712 - protein, 123 aa, Triticum aestivum
RSSLLANSLLVPPTSLAKMSTVTRAYLDQRLAAAKRCSKEAAMAGAKAAAVATVAAAVPTLASVRMLPWAKAHLNPTGQALIISTVAGMAYFIVADKTILSMAMARRHSFEDAPEHLKNTSFH

SEQ ID NO: 46713 - protein, 96 aa, Triticum aestivum
YVIKRPLVIKEGKTKQHFKAPKIQRLITPVRLQRKRHNLALKKKRCLKRKEQATEYAKLLAHRQKEKLAKKRAEQSRKRTMSQSSVSSSGTKSSKK

SEQ ID NO: 46714 - protein, 336 aa, Thermosynechococcus elongatus BP-1
MVSCPSRLGGSSAHRRLQCLAGHPLRQRSHSSPMRGIILAGGSGTRLYPLTQVISKQLMPIYDKPMIYYPLSVLMLAGIREILIISTPEHLYLFEKLLGDGHQWGLSLSYCVQPQPNGLAEAFILGREFLQGEPVCLTLGDNLLYGHDLSEKLQRAAQLTAGAMIFGYRVANPQQYGVLEFDASGRVLGIEEKPAVPKSNYAVPGIYFYDHQVCDLAAQLQPSARGELEITDLNRLYLEKGQLRVELLGRGYAWLDTGTHDLLQQASSFIRTLEERQGLKIGCLEEIALHRGYITPQQLYELAQPLRKSSYGQYLLQVWAEVTGGMHGQGTTAGDR

SEQ ID NO: 46715 - protein, 185 aa, Aspergillus nidulans FGSC A4
MFASKRLSKELIKIREQLPPGISLHKADDLQSWEMDIQVLDDNPLYRGETYRLRFTFSSKYPIEPPEVQFITDSQSQPQFTRSSAPSSTAGEHQPSNAEHQTSTAAVKRPIPIHPHIYSNGIICLDLLSSAGWSPVQTVESVCMSIQSMLTANTRNERPPGDSEFVSYNRRRPRDINFMYDDDNV

SEQ ID NO: 46716 - protein, 449 aa, Staphylococcus aureus
MMTKKYDLIVIGTGSAGSITAAKCNKAGWNVAMVDDRPFGGTCALRGCDPKKVLHGAAELIDWNKRMVKNGVPSEVSINWKDLMNFKRTFTDDVPEKKEEALNKQGIDTYHGNASFVSEDKLEVNKEVLEGSHFLIASGAKPTPLPIKGEEHLTYSDEFLELDELPQRIVFVGGGYISFEFAHIAARAGSEVHIIHRGQRPLENFDIDLVDILLEKSKEIGIQVHLQHSVESIEKEQGKFHVYARKKEDITRFEADIVIHGAGRVPALDMNLEKGNIERKKHGVHVNEYLQSVSNPNVYAAGDAAATDGLPLTPVASADSHVVASNLLKGNSKKIEYPVIPSAVFTVPKMASVGMSEEEAKNSGRNIKVKQKNISDWFTYKRTNEDFAAFKVLIDEDSDQVVGAHLISNEADELINHFATAIRFGISTKELKQMIFAYPTAASDIAHML

SEQ ID NO: 46717 - protein, 353 aa, Trichoderma atroviride
MGCGMSTEDKEGKARNEEIENQLKRDKMMQRNEIKMLLLGAGESGKSTILKQMKLIHEGGYSRDERESFKEIIFSNTVQSMRVILEAMESLELPLQDQRMEYHVQTIFIQPAQIEGDVLPPEVGGAIEALWKDHGVQECFKRSREYQLNDSARYYFDNIVRIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 46718 - protein, 233 aa, Brassica napus
  misc_feature (222)..(222): Xaa can be any naturally occurring amino acid
MPEIEIVADDGDNRNNNALFGKYELGKLLGCGAFAKVFHARDRRSGQSVAVKILNKKKLLANPALANNIKREISIMRRLSHPNIVGLHEVMATKTRIFFAMEFVKGGELFNKISKHGRLSEDLSRRYFQQPIAAVGYCHARGVYHRDLKPENLLIDESGNLKVSDFGLSALTDHVRPDGLLHTLCGTPAYVAPEILSKKGYDGAKFDVWSCGIVLFVLAAGXLPFNDPNLMNM

SEQ ID NO: 46719 - protein, 535 aa, Pseudomonas syringae pv. tomato str. DC3000
MAILHTRINVRSTEFALNHDALLKQVEELRSLLGKVRQGGGAKAQERHTSRGKLLPRERINRLLDSGSPFLEIGQLAAHEVYGEDVPAAGVIAGIGRVEGVECMIIANDATVKGGSYYPLTVKKHLRAQTIAQQNRLPCIYLVDSGGANLPRQDEVFPDREHFGRIFFNQANMSAQGIPQIAVVMGSCTAGGAYVPAMADEAIMVRQQATIFLAGPPLVKAATGEVVSAEDLGGADVHCRTSGVADHYADSDEHALGLARRSIANLNWRKQGQLNAIAPIAPLYAGEELYGIIPADTKQPFDVREVIARLVDGSTLDEFKALFGTTLVCGFARLHGYPIAILANNGILFAEAAQKGAHFIELACQRGIPLLFLQNITGFMVGQKYEAGGIAKHGAKLVTAVACAKVPKFTVIIGGSFGAGNYGMCGRAYDPRFLWMWPNARIGVMGGEQAAGVLVQVKCEQAERAGQAFSAQQQAELKQPILDQYEHQGHPYYSSARLWDDGVIDPAQTREILALALCASLNAPIEPTTFGLFRM

SEQ ID NO: 46720 - protein, 399 aa, Haemophilus somnus 2336
MIFDPTLFRRQFPFFHQKNGITYLDSAATTLKPQVLLDATQHFYASAGSVHRSQYDAKQTALFEQARKQVQKLINAESEETVIWTSGTTQSINIVAYGLMAQLSPNDEIIISEAEHHANFVTWQQIAKKCGATLIILPLQDNLLIDQQILQKSLNKKTKLVALNVISNVTGTQQPLTQLIPIIREKSSALILLDCAQAINHQTIDLQRLDADFIVFSAHKIYGPTGLGVLSGKRSALERLQPSFFGGKMVEQVSKQETVFASLPYRLESGTPNIAGVIGFGAVLNWLEQWDIIQGEQFAVQLAEKTKERLKNYPHCRLFNSPHPSTFVCFTFTTIATSDIATLLAEQHIALRSGEHCATPYLQRLGQKSTLRLSFAPYNNQEDIELFFSALDKSLELLA

SEQ ID NO: 46721 - protein, 165 aa, Triticum aestivum
  misc_feature (70)..(70): Xaa can be any naturally occurring amino acid
  misc_feature (98)..(98): Xaa can be any naturally occurring amino acid
  misc_feature (110)..(110): Xaa can be any naturally occurring amino acid
  misc_feature (126)..(126): Xaa can be any naturally occurring amino acid
MKLNIANPTTGCQKKVEIDDDQKLRNLYDKRISQEVVGDLLGEEFKGYIFKIMGGCDKQGFPMKQGVLTXGRVRLLLHRGTPCFRGFGKRNGERKREXSSVGCIVSPDLXSVSNWALGRKGENYLXPAFLNLGKPRVGGAPKGASETKKLFHPWERGEKFPAVFL

SEQ ID NO: 46722 - protein, 137 aa, Zea mays
MQARVVVFPVKGRAWCFALPRASAAAPAADGALPRPTLRDLWRGISSGSRTAPEKAEAVVDFVADKMNRAWVGFGSAPEGSMKSRIHSFGLKLLSRVRPSEVLLKSVTKDVSALEIVHPARFLPNLSCYLLEQWPLP

SEQ ID NO: 46723 - protein, 334 aa, Vibrio vulnificus CMCP6
MAFNLRNRNFLKLLDFSTKEIQFLIDLSADLKKAKYAGTEQKKLLGKNIALIFEKASTRTRCAFEVAAFDQGAQVTYIGPSGSQIGDKESMKDTARVLGRMYDGIQYRGFGQAIVEELGAFAGVPVWNGLTDEFHPTQILADFLTMLEHSQGKALADIQFAYLGDARNNVGNSLMVGAAKMGMDIRLVGPQAYWPDEELVAACQAIAKQTGGKITLTENVAEGVQGCDFLYTDVWVSMGESPEAWDERVALMKPYQVNMNVLKQTGNPNVKFMHCLPAFHNDETTIGKQVADKFGMKGLEVTEEVFESEHSIVFDEAENRMHTIKAVMVATLGS

SEQ ID NO: 46724 - protein, 405 aa, Zea mays
  misc_feature (56)..(56): Xaa can be any naturally occurring amino acid
  misc_feature (77)..(77): Xaa can be any naturally occurring amino acid
  misc_feature (159)..(159): Xaa can be any naturally occurring amino acid
  misc_feature (217)..(217): Xaa can be any naturally occurring amino acid
  misc_feature (263)..(263): Xaa can be any naturally occurring amino acid
MATKRSVGTLGEADLKGKKVFVRADLNVPLDDAQKITDDTRIRASVPTIKFLLEKXGAKVILASHLGRPKGVTPKYXLKPLVPRLSELLGVEVVMANDCIGEEVEKLAAALPEGGVLLLENVRFYKEEEKNEPEFAKKLASVADLYVNDAFGTAHRAHXASTEGVTKYLKPAVAGFLMQKELDYLVGAVANPKKPFAAIVGGSKVSSKIGVIESLLXAKVDILILGGGMIYTFYKAQGYSVGKSLVEEDKLELATSLIEKAKXRGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADKMSHISTGGGASLELLEGKTLPGVLALDDA

SEQ ID NO: 46725 - protein, 447 aa, Oryza sativa Japonica Group
MGAKDSKPSYSYSSSYDHGNSSSGYNSRYPAYPANASSSQNTRYAPSMENYVQPETHARLQRKYSRIGDDYRSLNQVTEALAQAGLESSNLIVGIDFTKSNEWTGKLSFNRRCLHDIGNTPNPYEQAISIIGRTLSAFDEDNLIPCFGFGDASTHDQEVFSFYPENRPCNGFEEALERYREIVPTLRLAGPTSFAPMIETAIGIVDSTGGQYHVLLIIADGQVTRSVDTQSGQLSPQERDTIDAIVKASQFPLSIVLVGVGDGPWDMMHQFDDNIPARSFDNFQFVNFTDIMSKSIAADRKEAEFALSALMEIPTQYKATLDLQLLGRRQRIQPRIPLPPPMRNAYSRSTSFDQHSGVYSRSSSFGPQTSGFQQSESFKQRQPVATTAPDTYTSESSLEGRLLCAICMDKSKDLAFGCGHQTCYECGKNLVRCPMCQQHITTRIRLY

SEQ ID NO: 46726 - protein, 563 aa, Vibrio angustum S14
MTDQKLSDNERLKRESNFLRGTIEQDLGDRMTGGFTADNFQLIRFHGMYQQDDRDIRAERAKQKLEPLHNVMLRARMPGGIITPKQWLEIDKFADEHTSYGSIRLTTRQTFQFHGVLKPNIKLMHQTLNSIGIDSIATAGDVNRNVLCTTNPVESELHQEAYEWAKKISEHLLPKTRAYAEIWLDGEKVETTDEEPILGSNYLPRKFKTTVVIPPQNDVDVHANDLNFVAIADNGKLVGFNVLVGGGLAMTHGDHSTYPRRADDFGFIPLEKTLDVAAAVVTTQRDWGNRSNRKNAKTKYTLDRVGSDVFKAEVEKRAGIQFEDSRPYEFTDRGDRIGWVEGIDGKHHLALFIENGRLLDYPNKPLKTGVAEIAKVHGGDFRMTANQNLIVAGVLAKDKDKIEKIARDHGLIDDGVSEQRKNSMACVSLPTCPLAMAEAERFLPEFVTDVEGILEKHGLDDDENIILRVTGCPNGCGRAMLAEIGLVGKAPGRYNLHLGGNRNGTRVPKMYRENITVAQIMDEIDSLVGRWSTERQESEDFGDFTIRAGIIDEVKVSKRDFYG

SEQ ID NO: 46727 - protein, 736 aa, Oryza sativa
MSGGGPPKKRNFKIELFKHRVELDPKYAERTWKVLEHAIHEIYNHNASGLSFEELYRSAYNMVLHKYGEKLYDGLERTMTWRLKEISKSIEAAQGGLFLEELNAKWMDHNKALQMIRDILMYMDRTYVPQSRRTPVHELGLNLWRDHIIHSPMIHSRLLDTLLDLIHRERMGEMINRGLMRSITKMLMDLGAAVYQDDFEKPFLDVTASFYSGESQEFIECCDCGNYLKKSERRLNEEMERVSHYLDAGTEAKITSVVEKEMIANHMHRLVHMENSGLVNMLVDDKYDDLARMYNLFRRVFDGLSTIRDVMTSYLRETGKQLVTDPERLKDPVEFVQRLLNEKDKHDKIINVAFGNDKTFQNALNSSFEYFINLNNRSPEFISLYVDDKLRKGLKGATEEDVEVILDKVMMLFRYLQERDVFEKYYKQHLAKRLLSGKTVSDDAERSMIVKLKTECGYQFTSKLEGMFTDMKTSQDTMIDFYAKKSEELGDGPTLDVHILTTGSWPTQPCPPCNLPTEILAICDKFRTYYLGTHSGRRLTWQTNMGTADIKATFGKGQKHELNVSTYQMCVLMLFNSTDGLTYKDIEQDTAIPASDLKRCLQSLACVKGKNVLRKEPMSKDISEDDTFYFNDKFTSKLVKVKIGTVVAQKESEPEKQETRQRVEEDRKPQIEAAIVRIMKSRRVLDHNSIVAEVTKQLQARFMPNPVVIKKRIESLIEREFLERDKADRKLYRYLA

SEQ ID NO: 46728 - protein, 597 aa, Magnetospirillum magnetotacticum MS-1
MSETPAPTPYRVLARKYRPTDFAGLIGQEAMVRTLSNAIKTGRLAHAFVLTGVRGVGKTTTARIIARALNCVGTDGKGGPTIDPCGVCEHCRAIAEDRHVDILEMDAASRTGVNDIREIIEGVRYRPTSARFKVYIIDEVHMLSTAAFNALLKTLEEPPEHVKFIFATTEIRKIPVTVLSRCQRFDLRRVEMEVLSRHFEAIAAKEGAEIEPAALKLIARAADGSVRDGLSLLDQAISHGAGAVTETQVRDMLGLADRARVFDLLDAVMKGDVPTALDQITDQYAAGADPAVVLQDMLELVHWLTRLKVTPDAADQLGAPETERVKGAEMAKTLSLAALTRAWQMLLKGLTETRNAPNPLQAAEMAVVRLAYAAELPTPAELVEQLRANPPPPPAPRGPGGGGGGSGFGGGGGADAVSVHHVGGGPVHGPATALKLQPAPMAETVVLPAMPADFAAMVALFSERREGLIAVQLRTQVNPVSFAPGRIEWRQNSSVGSDLAPKVARMLSEWTGRRWTVSVNSTDPAQPTLAEQEANAELRRRADAAEHPLVKAVLAAFPGATIEAVRDLGAEDLPEAPPIEDPENIPDDEMLPGEEDL

SEQ ID NO: 46729 - protein, 251 aa, Salmonella enterica
AGIKEIVLVTHASKNAVENHFDTSYELESLLEQRVKRQLLAEVQSICPPGVTIMNVRQAQPLGLGHSILCARPVVGDNPFIVVLPDIIIDDATADPLRYNLAAMVARFNETGRSQVLAKRMKGDLSEYSVIQTKEPLDNEGKVSRIVEFIEKPDQPQTLDSDLMAVGRYVLSADIWAELERTEPGAWGRIQLTDAIAELAKKQSVDAMLMTGDSYDCGKKMGYMQAFVKYGLRNLKEGAKFRKSIEQLLHE

SEQ ID NO: 46730 - protein, 394 aa, Silicibacter sp. TM1040
MFENLKPQPADKILALMQMYREDPRDQKVDLGVGVYKNAEGVTPVMRAVKAAEQRIIDEQTTKAYTGLAGDPAYADAMIDLILGTSVERSKIAAVATPGGTGAVRQAFELIKMANPEARVFVSDPTWPNHVSILKYVGIETVVYRYFDTETRAVNFDGMIEDLKGAKTGDVVLLHGCCHNPTGANLNISQWQAVVELLNERGLIPMIDIAYQGFGDGLEEDAAGVRLVASSVPECLIAASCSKNFGIYRERTGLLMAISQKGDEAGLNQKTLAYLNRQNYSFPPDHGARVVTTILNDPELRADWQKELEETRLGMLALRQQLADELQRLSGSDRFGFIAEHRGMFSLLGTTPELVEKMRVDAGIYMVGDSRLNIAGLNAQTVPILAKAIIDAGV

SEQ ID NO: 46731 - protein, 568 aa, Triticum turgidum
MASWFETYHHPSKPPRERETAAFFGCRLGIRENNCELTCASCRSFLPPVKILIRSIRLGCCCSWVRGSCACCCSWIRGLCGRKKREAGKETSTPETKKTKRKWRRNFCGWTSHEAEEPLTSETKKKREAGQEASTSETKKTKRKWGRSFCGWTSHEAEEPLTSETKKKRKNGASSSEPDKKRWFKNKIWRKKKAKNKQLATLVKEISLPNSPKARAAAGEILRIGNHNIPSRVFAYSQLSDATNSFSQENLLGEGGFGRVYKGYISETMEVIAVKQLDKDGLQGNREFLVEVLMLSLLHHPHLVTLLGYCTECDQKILVYEYMPLGSLQDHLLDLTPKSQPLSWNTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPKLDSKYPLKGLYQALAISSMCLQEEASSRPLISDVVTALTFLADPNYDPPDDIEPLPITVPDFDRGISLSEPEEVKEKFEGKQVEDS

SEQ ID NO: 46732 - protein, 655 aa, Aspergillus nidulans FGSC A4
MAPFPGSDADNIKDKARKGLLNLLEGVRGKKNLVISQGLAGPVGLFVKFSQLQEYGVDRVFLLENGNVDSSQRNVVFLAYAEKIRQVRAVAEQIQRLQRNSSIDHEFSIFWVPRRTLVSNNILESAGIIGDVSIAELPLYFFPLEQDVLSLELDDSFADLYLHKDPGCIFHSAKALMAIQQRHGYFPRIVGKGDHARRLADLLLRMRKEIDAEESSGLTGLSFRGLLPSSSIESLIIIDREVDFGTPLLTQLTYEGLIDELVGIKHNQADIDTTIAGASSTPQAQESSKASQQAKQGQKRKIQLDSSDQLFSQLRDANFAIVGDILNKVARRLETDYESRHTAKTTTELREFVNKLPSYQLEHQSLRVHTNLAEEIMKNTRSDTFRKILEVQQNDAAGADPTYQHPLIEELIARDIPLKTILRLLCLESCMSGGLRPKDLESFKRQVVHAYGHQHLLTFSALEKMELLQPRSSATTMLIPGTGTQTGSKTNYAYFRKNLRLVVEEVSEKEPEDIAYVYSGFAPLSIRLVQCVLQKSYVMSLMKGGPAAHANTASPGWLGYEDVVKSARGSTFSIVQKGDDKAVRARQTLSGNNAAKTVYVFFLGGITFTEIAALRFIAAQEAPRRNIVICTTGIINGDRMMDAALEKGGFALTES

SEQ ID NO: 46733 - protein, 765 aa, Oryza sativa
  misc_feature (483)..(483): Xaa can be any naturally occurring amino acid
  misc_feature (508)..(508): Xaa can be any naturally occurring amino acid
MGRDAARALRLSGRGMGLQRTRGDAGPDGRRAVARGGALRRREGRHGAGARRKVGGQGEGLGRSRGGPRKVAAPGIKERREADGRGGTAEVAERGSSESGDATRGREGRPAAETAAWGGREGTQERRWLEESPRGRPTAALDCAWRRKQSTRDASYASAGTAEKGGEELTDGRRHRVTVGVPGKGTEACGGALGRGGGDAPGLAARRRPRLREEAAEDGPCDGEMSPDMELDATARSSHGGRAPPLGGGTKQGREEAQGVGFIETEWERQGRFEVAAVFLALGWCSWAPRERATARMQRVVEAVDRVVGNRTASTGGLARGERVRSRWGRRGAAAASAALPFEQEAKEWRQGARYPGGEKAKGGGGGKGALLLPFWEERDENEPRLTVLDACGMGRRAREDDAGDDCKRTGTVVDLAKELISMFTAREMGKVFFTNSGSEANDSQVKIVWYYNNALGRPKKKNIISRTQSYHGTTFISASLSXDFDLPGRFVLHTDCPHYWRFHLPEXFFDEINDFCGRQIAAFIAEPVIGAGGVILPPKTYFEKIQAVVKKYDILFIVDEVITGFGRLGTMFGSDLYNIKPDLVSLAKALSSAYAPIGAILVSPEISDVIHSHSNKLGTFAHGFTYSGHPVSCAVALEALKIYRERDIPGHVTHVAQRFQEGIKAFAAGSPIVGETRGVGLLIATEFTDNKSPYELFPFEWGVGEIFGQECKKRGMMVKVLGNLIAMSPPLIITREEIDKLVSIYGEALKATEERVAELKSKKN

SEQ ID NO: 46734 - protein, 189 aa, Gossypium hirsutum
NTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPFIVGIFFGVETLSGVLAGSLVSGVQVAISASNTGGAWDNAKKYIEAGASEHAKTLGPKGSDPHKAAVIG

SEQ ID NO: 46735 - protein, 236 aa, Haemophilus somnus 2336
MSKLSLIQQLKQQKLSVGILSANWLQLNEEVTTLLEKQINVLHFDIADGQFSSLFTVGAIGIKYFPTHCFKDVHLMVRNQLEVAKAVVANGANLVTLQLEQYHDFALTIEWLAKQKTTYANQVYPVLIGACLCPETPISELEPYLDQIDVIQLLTLDPRNGTKYPSELILDRVIQVEKRLGNRRVEKLINIDGSMTLELAKYFKQGTHQIDWIVSGSALFSGELKTNLKVWKSSIM

SEQ ID NO: 46736 - protein, 118 aa, Brassica napus
MVKICCIGAGYVGGPTMAVIALKCPSVEVAVVDISVPRITAWNSDQLPIYEPGLDDVVKQCRGKNLFFSTDVEKHVREADIVFVSVNTPTKTRGLGAGKAADLTYWESAARMIADVSV

SEQ ID NO: 46737 - protein, 346 aa, Vibrio angustum S14
MTNVVDETMKNNLSTQSVTGDFPMQRFSVAPMLDWTDRHCRYFHRLMSKEALLYTEMVTTGAIIHGKGDFLAYNEEEHPLALQLGGSNPIDLARCAKLAQERGYDEINLNVGCPSDRVQNGMFGACLMGEAELVAQCVTAMRDVVDIPVTVKTRIGIDDQDSYEFLKDFIHVVSEKGGCDNFTIHARKAWLSGLSPKENREIPPLDYPRVYQLKQDFAHLTMAINGGIKTFEEMEEHLKHMDGVMVGREAYQSPYLMAEVDQRLFGSERPVMKRREVVEAMYPYIEKQLANGSYLGHITRHMLGLFQSMPGARQWRRHISENAHKPGAGIEVVQQALDKIPAHLDV

SEQ ID NO: 46738 - protein, 429 aa, Salmonella enterica subsp. enterica serovar Paratyphi A str.
MTTDDLAFDKRHIWHPYTSMTSPLPVYPVERAEGCELVLASGERLIEGMSSWWAAIHGYNHPQLNAAMKAQIDAMSHVMFGGITHQPAVNLCRKLVAITPEPLECVFLADSGSVSVEVAMKMALQYWQARGESRQRFLTFRHGYHGDTFGAMSVCDPDNSMHSLWKGYLPENLFAPAPQSRMDGEWDESDIAPFARLMAAHRHEIAAVILEPIVQGAGEMRIYHPQWLRRIRNMCDREGILLIADEIATGFGRTGKLFACEHAGIAPDILCLGKALTGGTMTLSATLTTRQVAETISNGEAGCFMHGPTFMGNPLACAVACASLTLLESGEWRQQVASIESQLRAELAPAQSSPWVADVRVLGAIGVVETTHTVNMAALQRFFVGQGVWIRPFGKLIYLMPPYIIRPDQLRRLTQAVNDAVHNETFFSH

SEQ ID NO: 46739 - protein, 254 aa, Bacillus subtilis
MWKGLIHQYKEFLPVTDQTPALTLHEGNTPLIHLPKLSEQLGIELHVKTEGVNPTGSFKDRGMVMAVAKAKEEGNDTIMCASTGNTSAAAAAYAARANMKCIVIIPNGKIAFGKLAQAVMYGAEIIAIDGNFDDALKIVRSICEKSPIALVNSVNPYRIEGQKTAAFEVCEQLGEAPDVLAIPVGNAGNITAYWKGFKEYHEKNGTGLPKMRGFEAEGAAAIVRNEVIENPETIATAIRIGNPASWDKAVKAAE

SEQ ID NO: 46740 - protein, 306 aa, Glycine max
  misc_feature (115)..(115): Xaa can be any naturally occurring amino acid
MPMSLSLSTVPAFNSLTMAESCLLSLPSLFYAKNKTLSLSIPTNPLNLQFPCSNSSLFPLTTKTTRHSSLLTFVAQTSGWAKEGEEEEAAWENQGDTAWGTEEGGDDIEDGGEGXSLEEEAEEVKIFVGNLPFDFDSEKLASLFEQAGTVEVAEVIYNRATDRSRGFGFVTMSTIEELEKAVKMFSGYELNGRVLTVNKAAPKGAQPERPPRPPRSFSSGLRVYVGNLPWEVDDARLEQIFSEHGKVEDARVVYDRETGRSRGFGFVTMSSETDMNDAIAALDGQSLDGRAIRVNVAQDRPSRSSF

SEQ ID NO: 46741 - protein, 536 aa, Xanthomonas campestris pv. campestris str. ATCC 33913
MSVINSQLQVGGESFQHNAAAMRAVVEDLRATLARTALGGSEAARAKHTARGKLLVRARIDALLDPGGALLEIAPLAAHGMYDDQVPCAGVVAGIGRVSGVECVIVANDATVKGGTYYPMTVKKHLRAQEIAQQNRLPCIYLVDSGGAFLPLQDEVFPDRDHFGRIFYNQANLSAQGIPQIACVMGSCTAGGAYVPAMSDETVIVREQGTIFLGGPPLVKAATGEEVSAEELGGADVHTRISGVADHFADNDLQALARVRAIIAQLNWRKPALSMAVQAPLPPRHAADELYGVIPADTRRPYDVREVIARIVDDSRLDEFKPRYGSTLVTGFAHLHGYPVGIIANNGILFSESALKGAHFIELCTQRGIPLVFLQNITGFMVGRKYEHGGIAKDGAKLVMAVACAKVPKFTVVIGGSFGAGNYGMCGRAYSPNFLWMWPNARIGVMGGEQAASVLATVRRDGIEAKGGAWSGDDEEAFKSPIRAQFEQQGHPYYASARLWDDGIIDPADTRRVLGLGLSAALNAPIDATRFGVFRM

SEQ ID NO: 46742 - protein, 286 aa, Chlamydomonas reinhardtii
MLRRNVRLRKEYLYRKGLEGKERAAYERKRLIRKALEEGKPIPTELRKDESELRREIELEDDNTAVPRTHVDDEYAHAGETDPKVLVTTSRDPSSRLTQFAKEMKLVIPNSQRINRGGLILKELVRTRAVCVFTSVEHRGEPDGMVVCHLPYGPTAYFGIFNTVLRHDIGQKKEVGTISEAYPHLVLDNLGSKLGARTANILKHLFPVPKDDAKRIVTFSNRQDYISFRHHTYAQPKGASSIELTECGPRFELKLYQIKLGTLDQSHAENEWVLRAYTRNTKRARL

SEQ ID NO: 46743 - protein, 340 aa, Bacillus cereus G9241
MTKITVVGAGSWGTALAMVLADNGHDVRIWGNRSELMDEINTKHENSRYLPGITLPSTIVAYSSLEEALVDVNVVLLVVPTKAYREVLQDMKKYVPGPTTWIHASKGIEPGTSKRISEVIEEEIPENLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNLLGKGHSLEEVLESMGMVVEGVRTTKAAHELAEKMEVEMPITAALYDVLFNGNNVKDAVGSLMGRVRKHEVEAIPDLL

SEQ ID NO: 46744 - protein, 161 aa, Triticum aestivum
  misc_feature (39)..(39): Xaa can be any naturally occurring amino acid
  misc_feature (48)..(48): Xaa can be any naturally occurring amino acid
MYIVAQCAGGIVGAGIVKGIMKDAYQANGGGANMVASGXSRGTALGAXIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 46745 - protein, 222 aa, Triticum aestivum
AIGIARGLEYLHHSCNTRIVHFDIKPPNILLDKDFNPKIADFGLAKLCQTKESKLSMTGARGTIGFIAPEVHSRTFGVVSTKSDVYSYGMMLLEMVGGRRNVKSIVAKSSEKYFPDWIYDHFAQDDGLQACEVTREIEEIARKMTFIGLWCIQVLPMYRPTITKVLEMFERRLDDLDMPPKQNFCELLESSAQNLDVKSSCSTKPEEISLVNSKILQQSPTL

SEQ ID NO: 46746 - protein, 209 aa, Chlamydia trachomatis D/UW-3/CX
MSKTPLSIAHPWHGPVLTRDDYESLCCYIEITPADSVKFELDKETGILKVDRPQKFSNFCPCLYGLLPKTYCGDLSGEYSGQQSNRENIKGDGDPLDICVLTEKNITQGNILLQARPIGGIRILDSEEADDKIIAVLEDDLVYGNIEDISECPGTVLDMIQHYFLTYKATPESLIQAKPAKIEIVGLYGKKEAQKVIRLAHEDYCNLFM

SEQ ID NO: 46747 - protein, 767 aa, Oryza sativa Indica Group
MGSACEAGTDEPSRDDVKGTGNGILENGHSHKPEEEEWRNGMGEDLPNGHSTPPEPQQTDEQKEHQVRIVRWERFLPVKTLRVLLVENDDSTRQVVSALLRKCCYEVIPAENGLHAWQCLEDLQNHIDLVLTEVVMPRLSGIGLLSKITSHKICKDIPVIMMSSNDSMGTVFKCLSKGAVDFLVKPIRKNELKNLWQHVWRRCHSSSGSGSESGIRTQKCTKPKVDDEYENNSGSNNDNEDDDDNDEDDDDLSVGHNARDGSDNGSGTQSSWTKRAVEIDSPQQMSPDQPSDLPDSTCAQVIHPTSEICSNRWLPTANKRSGKKHKENNDDSMGKYLEIGAPRNSSMEYQSSPREMSVNPTEKQHETLMPQSKTTRETDSRNTQNEPTTQTVDLISSIARSTDDKQVVRINNAPDCSSKVPDGNDKNRDSLIDMTSEELGLKRLKTTGSATEIHDERNILKRSDLSAFTRYHTTVASNQGGAGFGGSCSPQDNSSEALKTDSNCKVKSNSDAAEIKQGSNGSSNNNDMGSSTKNAITKPSSNRGKVISPSAVKATQHTSAFHPVQRQTSPANVVGKDKVDEGIANGVNVGHPVDVQNSFMQHHHHVHYYVHVMTQQQQQPSIERGSSDAQCGSSNVFDPPIEGHAANYSVNGSFSGGHNGNNGQRGPSTAPNVGRPNMETVNGIVDENGAGGGNGSGSGSGNDLYQNGVCYREAALNKFRQKRKVRNFGKKVRYQSRKRLAEQRPRIRGQFVRQSGQEDQAGQDEDR

SEQ ID NO: 46748 - protein, 277 aa, Rubrivivax gelatinosus
MRRAFGEPVKVSSQPDTLLDERLPRPMNEPTPLSRSFGYQSVDEREREQRIRRVFSAVAARYDLMNDLMSFGIHRLWKRRFVRMAAPQAGQHIVDLAGGTGDVAALMAAADRRVTVVDPSAEMMAVGQARGHAHVDWQVGSAEQLPLADASVDTLTISFGIRNATRIDVALREIHRVLKPGGRFLCLEFSTPAWWLRPFYNLFSFTVIPRLGAWIANSPEAYTYLVESIRRFPDQRGFAAMISAAGFESVRWHDLSFGIACVHVGTRAAAATPAGTA

SEQ ID NO: 46749 - protein, 225 aa, Zea mays
MDAADARPSAPSAAAAAVAGASVADEPRDARVVRELLRSMGLGEGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQYEENEDENEESNPSLTPNPANSNPTFSQDQRSNEQQHTPQHGQRVSFQLNAVAAAAAKRPRMTVDQLNIG

SEQ ID NO: 46750 - protein, 139 aa, Glycine max
  misc_feature (30)..(30): Xaa can be any naturally occurring amino acid
  misc_feature (52)..(52): Xaa can be any naturally occurring amino acid
VEFQTLKSTQAMGEATKGITKAMGQMNRWXRMNLPSVQRMMQEFERQNDKMXLVSEVMGDAIDDALEGGEEEEETEELVNQFLDEIGIDINSELVNAPATTSVSAPAAKNRVAQAESTANEDSGIYDDLQARLNNLRKM

SEQ ID NO: 46751 - protein, 550 aa, Vibrio angustum S14
MLKNINPTQTQAWQDLTAHFEQAQDFQLSDLFANDSARFSKFSAQFGSDILLDYSKNLITEETLTKLFALAKETELDAAIADMFSGEKINRTEDRAVLHVALRNRSNTPIMVDGEDVMPAVNAVLEKMKSFSDRIISGEWKGYTGKEITDIVNIGIGGSDLGPYMVSEALGAYKTRLNMHFVSNVDGTHIAETLKDLNPETTLFLIASKTFTTQETMTNALSARDWFLAKAEDKAHVAKHFAALSTNGEAVTEFGIDTDNMFEFWDWVGGRYSLWSAIGLSICLSVGFDNFVALLDGGHAMDKHFAEAPLEQKLPVILALIGIWYNNFHGAETEAILPYDQYMHRFAAYFQQGNMESNGKYVDRGGNPVDYQTGPIIWGEPGTNGQHAFYQLIHQGTKLIPCDFIAPAISHNPLGDHHPKLMANFFAQTEALAFGKSREKVEAEFFAAGKSQEEVNELAEFKVFEGNRPTNSILVKEITPYTLGALIALYEHKIFTQGVIWNIFSFDQWGVELGKQLANQILPELNNKEEVSSHDSSTNGLINAFKQWRA

SEQ ID NO: 46752 - protein, 336 aa, Frankia sp. CcI3
MRRAAVLTAGSWGSVFAKVLADAGARVNLVARDPEIVRAVNTRQVNPRYLPAIQLPDRVRAMSDAGEALAGAEFVVLAVPSQALRSVLAGWAPLIGPDAVYVSLMKGVEVGSQLRMSEVITQVTGVSPDRIAVVSGPNLAPEIAAEQPAATVVASTSTSTAEAVQAACWTPYFRPYTNTDVIGCELGGAIKNVIALAAGMLEGMGFGTNSLASLMTRGLAETLRLGVALGADPMTFAGLAGLGDLVATCGSPLSRNRTFGEKLGRGLTLAQVEAEQQQVAEGVRSCRPLLAMADDLGVAMPITRQVERVLYEGLPPMEAVKDLMSREPGPEYRLRP

SEQ ID NO: 46753 - protein, 237 aa, Bacillus cereus G9241
MQQSKEERVHDVFEKISDKYDVMNSVISFQRHKAWRKETMRIMDVKPGNKALDVCCGTADWTIALAGAVGEQGKVVGLDFSENMLSVGKQKVEALQLKQVELLHGNAMELPFEDNTFDYVTIGFGLRNVPDYMHVLKEMTRVVKPGGKVICLETSQPTMIGFRQGYILYFKYIMPLFGKLFAKSYKEYSWLQESASTFPGMKELANMFEKAGLERVQVKPFTFGVAAMHLGMKPESK

SEQ ID NO: 46754 - protein, 148 aa, Bacillus cereus G9241
MEKTFLMVKPDGVQRAFIGEIVARFEKKGFQLVGAKLMQVTPEIAGQHYAEHTEKPFFGELVDFITSGPVFAMVWQGEGVVDTARNMMGKTRPHEAAPGTIRGDFGVTVAKNIIHGSDSLESAEREIAIFFKEEELVDYSKLMNEWIY

SEQ ID NO: 46755 - protein, 290 aa, Bradyrhizobium japonicum
MGPGLRRDDTEFVVTTVANSTLQNITGTILLAGAGKMGGAMLTGWLAGGLDPRRVAVVDPHIAPEISALAAKGVALNPDAKAAGQVETMVVAVKPQMFREAGAKLKPFVSEKTSVVSIMAGTTIASLQEVCGGAVVRAMPNTPAAIGRGITVAVAAKNVSTAQRAVADALLRATGSVEWVEDESLMDAVTAVSGSGPAYVFLLAEELARAGVEAGLPEALATKLARETVAGSGELLHQSELPSGTLRQNVTSPGGTTAAALGVLMGEPGLRDLMIRAIAAATQRSKELAK

SEQ ID NO: 46756 - protein, 506 aa, Zea mays
MPAAAAPAPHTRTRTRSSGSPSAAIGPPLPYWGGAAVGAEEQRWRIGMDSAAAALLDSASASASSANAAGKEMPTARHIAHRTAHNMSSSSLRKKSDLALLRKVPCAPLRRLLDNLQEVLLATKLALLFPAVLLAIAARIFHFGQEWVFVLSLIGLVPLAERLSFLTEQVAFYIGPTVGGLLNATFGNVTEVIIAIFALYQGKVVVVKCSLLGSVLSNLLLVLGTSLFFGGLANLGTEQLYDKMQVDVSTGLLILGVLCHSLPLMLRYAVSSGEHAESSWDSGLELSRACSIVMLLAYVAYLFFQLKTHRQLFEPQPQEVEDDGDDSVSQDEAVLGFSSAMIWLGVMTLMTALLSEFVVSTIEAASESWELSVSFISVILIPIVGNAAEHAGAVIFAFKNNLDITLGVSLGSATQISMFVVPLSVLVAWIMGVPMDLDFNLLETGCLFLAILVTAFTLQDGSSHYLKGLLLVFCYIVISLCFFVLRQHGNGSNDDQLGVASKPWRI

SEQ ID NO: 46757 - protein, 639 aa, Gibberella zeae PH-1
MSSDDDFEIEVPDLAADDPMRAFLPTSFGKKSKEADIAAQFDRSRRTVTSTAPEASGGQAQGPKKKGNSSDDSDSDDSDDSDDEDEFPVSHELVLKTHERAVTTVSLDPAGGRLATASTDCTVKLHDFASMTPTTLRAFRSVDPYEQKASSASSEAHPVHRIEFNPHAGGVFLCVSAHPQAKIMSRDGDIVTEFVKGDMYLRDMHNTKGHISEITTGTWHPTDKNLCITAGTDSTLRIWDVNNKRSQKDVIVFKSKAAGSAGRTKMTAVAWGSSAQGGSNVLVASALDGSLVMYSGNSPFSRPAGEIRDAHKPQTWTSGIDISSDGRMVVTRGGDDLIKLWDTRKFTKPLVTVSHTSTSDHYSTSNIKYAPNSTSIITGSITGHLHILNPGNLRAEHVTPITPGSPLITVDWHPKINQIITGSANAETHVLYNPQMSNKGAVDVMSRAPKKRHIDDNPELTMDQSVGVSGDAIMVPGATGGSRKAGVTVSGRSKDPRRPYMPQQTPLQKNAPDEKSIAENIPLARMLHEDPREALLKYADKAQKDPMFIKAWSKTQPETQYAELSDEEDGPDKKRLKRVSSRRGAPNTKLRMSKPFSRLKQATPFKYRCLFAISVSHCCTPKTPILRASHGAFKGITCM

SEQ ID NO: 46758 - protein, 1531 aa, Debaryomyces hansenii CBS767
MGRYRDRNRETDENDDTNRQATMTTTLVQQHSRQSLGKFVNPSPTKYESTENMDKVVQSVTNATKRLSQISTNTNSSAKKRKTQNRIGPWKLGRTLGRGSTGRVRLAKNVNSGKLAAVKIVPKSNFKKLENPKYKRNSVDSSGSVKDRLPYGIEREIIIMKLISHPNIMGLYDVWENKNDLYLILEYIEGGELFDYLIKKGKLQEFEAISYFKQIINGIHYLHQFNICHRDLKPENLLLDFNKNIKIADFGMAALEVREKLLETSCGSPHYASPEIVAGKNYHGAPSDIWSCGIILFALLTGHLPFDDENIRKLLLKVQNGKFLMPNNLSSESKDLISKMLKVNPSERITIDAILQHPLLTKYPEPSVRKDKVTEYSDLNIRPIDSINNIDKEILKNLSVLFHNRDEQTIISKLLSPEDCSEKTFYYLLVKYRNEHLTASNNTINNYEDDPDLTGSESKQTITRSTSIVKTTTTDPLTGEKHTTIRKIPNSTSNFSNRSRSPKKKPEVLGNITNTAPTFKASTSFNKKKTLMNNNVISRNNSSKSLRKRPPQQQPPKLSRKISGMPDLNDLRLEKTQLNSLYKQQKLNGSFGNKSLFNFESVCQEIFGNAEQHEGDRKIEPKENLRKDKQMDGRTGKLSNIEKCERELAAKVHEKNDARALKLQHQQKEEDAKLQHKKQLESKKRDQSKLLQEKQRQALEKLGSQIQDNNDNNRRGIAHRTQQRHVTEPAPTSSLDPKLGGGAKSLLRAKSLASPSSYVSLRQNTHTSDNTSKVLQTLGIEVAPLKTSTKFNSNLKTSSSKNLSDYLDNETLYSRSDKSIEHQKENISMNKFNEKEKVNQSIAKPNYSRTSTSKLQPLAISRTTTLNSIGYRSLLDGIDENKVQKDLPKRPNGEKDYDTTLSTIETRKNGLIPNPRFSRFSFNGLLNSRFDNPDVTIQNNLVSSGTVVRKSVNQKEPISSRIIEEDPQTSHLKLETGSLKKSSTNLLGLGIVQNHQGKTSRKVSQNSEYCDSNFISVNLSDTADDSQDNTTLEENAISLSHANSVLKDDHANTTVSNTTISKQQEVLNTNVDQRNKRKSSYLGNLEGSKETLVENDKEDKSFQDSIKSMYKDYAKLYNDKKPKSETNTQELGETDDNIPSEKQTRERQSILRDDRINSIDSDNDLSFAADGSSNIDILDSSSIADTNMIENRSEIQLNDNKYSPTITDNQKDFGDEYEDEIDDQFSQHGDQQEYNHEYDHENNHEYNQEDGQEQHEHDHNQQNDQQLQDSDRLQTGTDLRKSTASTQIFSTMNLPKIRDKNSVVEENKEIKHSEVKSEESNQRHNSIFNKLKPKREAPKPPGFKWDDEKSQGHNRFSRISVSSKFDKQQKLNDNYNDSSKSNWFMKFINSLTANSKTPKGEKRKSLIRKFNSDKLDDNETKNFCVLDSTLQSSELTRVIKDTLELKKIEGSVSKVDIDEDFGMISGVIPARYSGGRRLRFKIEIINLKNSSSLHLSKLKGTDKGFKNLTNTVKFIVSKEEQNINRMSSVEA

SEQ ID NO: 46759 - protein, 660 aa, Oryza sativa
MRVIYVLCVLGVLVPDAAGGRRHHRRHDCPPFTCGHLSDVSFPFRRRGDPPECGVQSYELTCADDKATIQIDKETYSVSDINYGDSTLWVVDASFLDSRSSCLLPRWNPLLRDPRLQAKSHHIIELAPPVGVTWASFVNCSQEIRNSSWMYMPVACLSTSRSFVYVFTGQQSAYIQNLEPSCGYLATTPLGGSKLNSTSALQNVSYQDVVKANDDLDLPFDFLSQVSGWNFKECLALSIRQTGTGSKERIANIAIIDFYFWSCFLLGDRSHNNLIYTYMVVDTALLILKWTAVLCRFVLAPLAVFIFLAHKYWRNKITIDAVEKFLQMQLTLGPTRYAYTDLTAITGHFGEKLGQGGYGSVYKGVLPGYVNVAVKVLENANCNGEEFISEVSTIGRIHHVNVVRLVGFCSKELRRALVYEYMPRGSLNKYIFSSKRSFSWDKLNEIALGIARGINYLHQGCDMQILHFDIKPHNILLDDNFVPKVADFGLAKLYPRDNSFVPLNALRGTIGYIAPEMISRSFGVISSKSDVYSFGMLLLEMAGGRRNSDMHAGNSSQAYYPSWVYDRLIEQQVGVGEISAATVANMHELERKLCIIGLHCIQMKSHDRPTMSEVIEMLEGGVVGLQMPPRPFFCDDESMSPMMDSYQFSSGLTEILEEDE

SEQ ID NO: 46760 - protein, 349 aa, Thermosynechococcus elongatus BP-1
MSNKGSSDLRLLLSTLVISGLVAGLAYWQLSQHWTRSPDQNAGSPLHTPTSKWQKIALAMTLRGHEDEVNAIALSPDGNFLVSAGDDRRLYFWNLATGTALGQAKGHTDWIYALVMTPDGQTVISGSKDKTIKLWGVGDRQLQATLSGHQDFVNGLALSPDGRTLASASYDHTVKLWNVPSRQEITTLKANEGIMLSVAISRDGRFLATGGVDKLIRIWDLPSRRLLRTLEGHTSDVNSLAFTPDSSQLVSGSDKDGIKLWNLTTGELQQQFGTEGGQVFSVAVSPDGSTLASGHGDQTVKLWSLSGQLLRNLKGHSGAVYSVVFGQDQLISASEDKTIKVWRLFPETP

SEQ ID NO: 46761 - protein, 604 aa, Cryptococcus neoformans var. neoformans JEC21
MPDQLYPEYELQRAISNTKNADDSTAFGEKSPGVRRIEIIAASFTTWHRWVLFISVFFMSYSYGLDGSVRYTYQAEALSELGTSAQVSTVTVVRSIVAAAAQPAFAKVSDYFGRVSILIISVILYVVGTIVTATSTNLAAFCGGSVLYQFGYTGVQLLVEVLIADVTSLRSRLLFSYIPATPFLINAWISGNVASAVLTHSTWGWGIGMWAIIFPVTVIPLLFSLIQAEWRAHRKGLLREIPSPLRTFGDRHMWADIFWQIDLVGLLLLAAVLALILLPFTLAGGVASIWRTARVIAPLVVGFVVALPLFVFWELKVARHPMLPFRILKDRQVLASLFIAMLLNTAWYTQGDYLYYTLLVAFDRDIISATRVQNIYSFTSVVIGVCLGLIIRKVRRLKWFIVAGTLLFVLAFGLLIRYRGGYSISDFAGLVAAEVVLGIAGGLFPYPTQVMIQSAVQHERTAVVTSLYLASYSVGSALGNTIAAAIWTNTMPSHLYNDFIRAGLSTTDASTLQALAYASPLQFIIDYPPGTPEREAVGSAYREVQRYLTITGICISTVIVFMALSLRNPRLGDEQSLPDAEKLEKVPSEMSGATEETTETKQKN

SEQ ID NO: 46762 - protein, 310 aa, Rubrivivax gelatinosus
MNTMTRIEQALEAALVANEGAGCPPKLAAAIRHAVFPGGARIRPQLCIAVAMANGDTDPALADAAASAIELIHCASLVHDDLPCFDDAPTRRGQPSVHKAYGERLAVLAGDALIVTAFQTLGAAGGRHPERMAHVLQTVARGVGTPLGIIAGQAWECEPRVALSDYQRAKTGALFAAATAAGAQASGGDGETWRALGDWLGEAYQVADDVRDALADPEQLGKPVGRDVALGRPSAAIQHGLVGAVEHFERLVQGAIDVIPDCKGAGMLRQIVRMEAERLVPKAWCANIEALAERAAVRAAERSAAPTQTA

SEQ ID NO: 46763 - protein, 318 aa, Coprinopsis cinerea okayama7#130
MLSTDTPRPIGTFKTSSDYHYQTMRCNVDLLKIIQVGLTLADEEGHNPPECSTWQFNFKFSLAEDMFAPDSVELLQKSGINFELHEREGILPNDFAELMITSGLVLTDETKWISFHSGYDFGYFVKLLTAQSLPTSEDDFFALLKIWFPTVYDIKFLMRAAKNLKGGLQDVADDLGVMRIGSSHQAGSDSLLTSSTFFKMREIYFNDQIDDAEYSGKLYGLGQTFSLTNGLTDHGRGGATIAERDDRGSSVVRDGSQHGHNGTPGPGSAGAPQTPGMLPLGPMQAGGPMQAAMNQAGYGPLGANGPFGLRSSLVGGGR

SEQ ID NO: 46764 - protein, 338 aa, Salmonella enterica subsp. enterica serovar Paratyphi A str.
MRVLVTGGSGYIGSHTCVQLLQNGHDVVILDNLCNSKRSVLPVIERLGGKHPTFVEGDIRNEALITEILHDHAIDTVIHFAGLKAVGESVARPLEYYDNNVNGTLRLVSAMRAANVKNLIFSSSATVYGDQPKIPYVESFPTGTPQGPYGKSKLMVEQILTDLQKAQPEWSIALLRYFNPAGAHPSGDMGEDPQGIPNNLMPYIAQVAVGRRESLAVFGNDYPTEDGTGVRDYIHVMDLADGHVVAMEKLADKSGVHIYNLGAGVGSSVLDVVNAFSKACGKPINYHFAPRRDGDLPAYWADASKADRELNWRVTRTLDEMAQDTWHWQSRHPQGYPD

SEQ ID NO: 46765 - protein, 532 aa, Lactobacillus johnsonii NCC 533
MNKGHKISLFSAIMLALNSLIGSGWLFGSGSAAKIAGPAAILSWIIGAVIIIAIALTYVELGTMFPESGGMSKYAQYSHGPMLGFIAAWANWISLVTLVPMEAVAAVQYMSSWPWKWANWTHHFMQDGNITTPGLLLVFVFMIIFTLINFWSIKIMTHFTNLISVFKVLLPTITIIMLFASSFHPANFGHDVKTFMPYGSRAIFEAASGAGIIMSYDAFQTIINIGGELKNPRKNIIRGVLISMFATAAIYILLQVAFIGAVDPGMLAKNSWHGIDFASPFADIAILLGINWLVILLYMDAFVSPFGTGVAFVATASRALAAMTYTKHLPAWLGRLNRRYLVPRFAMIADLILAMILVSVFRNWNLLATVITCATLIAYLTGPVTTITLRKIAPDLERPYKPNYMRWFAPLTFVLTSLAIYWTMWPTTIQVILVILVGIPIYFYYEVKYQKKDFKSQFKHAAWLLGYLVFISIMSYCGSDGFGGQNWIKYPWDFLLIAIVSLIFYKVAIDTGLEKVDPAAIKVNEKIKLKKD

SEQ ID NO: 46766 - protein, 619 aa, Arabidopsis thaliana
MERSVDLPIHKHPLYHSSRFINGRCRGCKQTSPIYSGYRCNDSDCNHVWYHKECGESLPEINHPSHLEHPLCLIDYRGSGTCAFCGAFLFGPTYHCWICAFNIDIACARKQLPPLAAIENPKCHNHSLVLLEKQVKKDHCGVCKKTVFGMYPYVCLECDVYFHVECINISREVHHSSHTNHTLELFGSESLPDSAQKTCLLCDDVSDHLIYHCSVCNFSICVYCAINPPPLAIEHLKTHEHTLTLLPRQVKFICNACGMKGDGCPYFCLGCGYLIHRKCIDLPRVININRHDHRISLTHHLGLQYSECGVCRQSVNGYYGGYSCSLCPNYVVHPQCAMKDDVWDGIELEGTPEDSEQDTAPFEVVDDNTIKHFSHEKHNLMLNKNGIITQHDEITRCQACVLPLSSDPSYSCGQCDYVLHETCANLPRKKRHVFNNKPFTLHTGGKDSSRNWFECDACRTISNGFRYVSGDWILDVHCGSMSEPLLHDGHSHPLYYYRRQGKSCRSCHNKVVKPRVLCCDTCDFDLDFYCANLPKTVKHCYDEHPLSLCHGEDDVIKDNKYWCDICETETDPKKWFYTCYDCGGGTLMSMDVSMKLFLTARVLDHSATNAILDVKIASF

SEQ ID NO: 46767 - protein, 217 aa, Haemophilus somnus 2336
MDLTKFKEQIEFLDQKVAYFHIDIMDGHYVPNLTLSPFFVSQVKKLATKPLDCHLMVTNPENYIDDLAKAGCDMITLHVETISGQAFRLIEKIRYLEMKVGIIFNPETPIEKAKYYLSKADKVTILTVDPGFAGQSFIPEMLEKVAELKLFRETHQLNYEIEIDGSCNPKTYEMLIKAGADVLIVGSSGLFNNSDNIVEAWDMLEKEIERILSKGML

SEQ ID NO: 46768 - protein, 356 aa, Mycosphaerella graminicola
MSRTAQQQQQQGSRKISFNVSEQYDIQDVVGEGAYGVVCSALHKPSGQKVAIKKISPFDHSMFALRTLREMKLLRYFNHENIISILDIQKPKSYETFTEVYLIQELMETDMHRVIRTQELSDDHCQYFIYQTLRALKAMHSANVLHRDLKPSNLLLNANCDLKVCDFGLARSAASTEDNQGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTSDLALDLLEKLLAFNPTKRITVEEALKHPYLEPYHDPEDEPNAEPIPEEFFDFDKNKDNLSKEQLKRLIYEEIMR

SEQ ID NO: 46769 - protein, 382 aa, Salmonella enterica subsp. enterica serovar Paratyphi A str.
MNLKEKTRALFAEIFGYPATHTIQAPGRVNLIGEHTDYNDGFVLPCAIDYQTVISCAPRDDRTVRVIAADYDNQADEFSLDAPIVTHDSQQWSNYVRGVVKHLQQRNNAFGGVDMVISGNVPQGAGLSSSASLEVAVGTVFQQLYHLPLDGAQIALNGQEAENQFVGCNCGIMDQLISALGKKDHALLIDCRTLGAKAVSMPKGVAVVIINSNFKRTLVGSEYNTRREQCETGARFFQQPALRDVSLEAFNAVASELDPVVAKRVRHVLSENARTVEAASALEKGDLQRMGQLMAESHASMRDDFEITVPQIDTLVDIVKATIGDQGGVRMTGGGFGGCVVALIPEDLVPAVQQAVAQQYEAKTGIKETFYVCKSSQGAGQC

SEQ ID NO: 46770 - protein, 614 aa, Triticum aestivum
MPEAPSAQPAPASGYAPGAHREALDFIEHVTANAGKVQQRVLAEILAQNATAEYLRRYGVSSSSSPLDAVDAFRRCVPLVTYEDLQPDILRIANGDSSPILSGKPISEFLTSSGTSGGERKLMPTIADELDRRSLLYSLLMPVMSQSLPGLDKGKAMYLLFVKAESRTPGGLAARPVLTSYYRSRQFLDRPHDPYTAYTSPNEAILCVDSYQSMYAQLLCGLVHRTDVLRVGAVFASGLLRAIRFLEKHWPRLCHDIRTGELVPEITDKTERDAFGRLLHANPALASEIEAECSKPSWEGIIRRLWPRTKYIDVIVTGAMSQYIQTLEFYGGGLPLICTMYASSECYFGLNLNPMCKPGDVAYTLIPTMCHFEFLPVHCSNANAEPSHRDLVDLVDVKLGHDYELVVTTFSGLCRYRVGDVLRVAGFKNEAPMFSFVRRRNVALSIDSDKTDETELHTAVSSAVQHLAPFGASLVEYTSYADTAAIPGHYVLFWELREGSTAVPASVFEECCLSVEEALNSVYRQCRACDRSIGPLEIRVVSEGTFEKLMDYALSQGASINQYKAPRCVRPGPVVELLDARVQASYFSPKCPKWSPGNKQWNTSSKELLSIGDA

SEQ ID NO: 46771 - protein, 212 aa, Glycine max
  misc_feature (70)..(70): Xaa can be any naturally occurring amino acid
  misc_feature (77)..(77): Xaa can be any naturally occurring amino acid
  misc_feature (86)..(86): Xaa can be any naturally occurring amino acid
  misc_feature (120)..(120): Xaa can be any naturally occurring amino acid
  misc_feature (124)..(124): Xaa can be any naturally occurring amino acid
SGVAYVSLSPNSRYSISRSGVPGAVRAMAQHLVKTKHHVDKFYKLTSQLRGVSLITQTLKSSQAMCEAMXAVTQAMXQMNMQINLXSLHKIMRELDRHNENMELTSEMMSHAIHDALERXQHEXETEDLVNRVLDDIGIDLNQQLVHAPSSAAAAPAVKTKVPQADTTGSDHAAIDSDSHAGLYNVRTSILSAMISGTHSVLVKIDAQLYIP

SEQ ID NO: 46772 - protein, 250 aa, Salmonella enterica subsp. enterica serovar Paratyphi A str.
MAVTKLVLVRHGESQWNKENRFTGWYDVDLSEKGVSEAKAAGKLLKEEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWTDTILPRMKSGERVIIAAHGNSLRALVKYLDNMSEDEILELNIPTGVPLVYEFDENFKPLKHYYLGNADEIAAKAAAVANQGKAK

SEQ ID NO: 46773 - protein, 127 aa, Chlamydomonas reinhardtii
MATSAKGIGIPVKLLHEAEGHVVTVELKSGEMYRGELCDAEDNMNCQLKDVTATGRDGRVTQLAHLFIRGSRVRFFIIPDMLKNAPMFKRIDPKFKNKNMALGVGGRGRAAAVRAAAKAKTPGRGRG

SEQ ID NO: 46774 - protein, 171 aa, Geobacter sulfurreducens PCA
MDELKNIIRDVPDFPKKGIIFKDITTLLADAPSFQRMVDLIAHRYVGKKISKVVVVEARGFVIGAALAYKLGAGVVLVRKPGKLPSETYSKTYQLEYGSDTLEIHTDAIAKGERVIIADDILATGGTMAAVVDMVEALGGEIVECCFMAELEFLGGRKRLPEGKVYSLLTF

SEQ ID NO: 46775 - protein, 306 aa, Vibrio vulnificus CMCP6
MKPTKELLNEILHEVRPLIGRGKVANYIPALARVPAHKLAIAVYTNQGEVIKAGDADEAFSIQSISKALSLTLAMGLYQPDEIWRRVGKEPSGQAFNSLIQLEMEQGIPRNPFINAGAIVVADLLASRLSAPRQRLLEFVRQLSGETHICYDKVVAASEMMHSDRNAAIAYLMRSFGNFENEVIPVLNNYFHACALKMSCVDLAKTFSYLANKGVSVHTDQRVISPVQTKQLNALLATCGLYDGAGEFAYRVGMPGKSGVGGGIIAIVPGEMTIAVWSPELDPSGNSLAGTKALELLSERIGRSIF

SEQ ID NO: 46776 - protein, 528 aa, Candida tropicalis
MAIVDTAIDGINYFLSLSLTQQITILVVFPFIYNIAWQLLYSLRKDRVPMVFYWIPWFGSAASYGMQPYEFFEKCRLKYGDVFSFMLLGKVMTVYLGPKGHEFIYNAKLSDVSAEEAYTHLTTPVFGKGVIYDCPNSRLMEQKKFAKFALTTDSFKTYVPKIREEVLNYFVNDVSFKTKERDHGVASVMKTQPEITIFTASRCLFGDEMRKSFDRSFAQLYADLDKGFTPINFVFPNLPLPHYWRRDAAQRKISAHYMKEIKRRRESGDIDPKRDLIDSLLVNSTYKDGVKMTDQEIANLLIGVLMGGQHTSASTSAWFLLHLAEQPQLQDDLYEELTNLLKEKGGDLNDLTYEDLQKLPLVNNTIKETLRMHMPLHSIFRKVMNPLRVPNTKYVIPKGHYVLVSAGYAHTSDRWFEHPEHFNPRRWESDDTKASAVSFNSEDTVDYGFGKISKGVSSPYLPFGGGRHRCIGEQFAYVQLGTILTTYIYNFKWRLNGDKVPDVDYQSMVTLPLEPAEIVWEKRDTCMV

SEQ ID NO: 46777 - protein, 267 aa, Xanthomonas campestris pv. campestris str. ATCC 33913
MTVPAFGLGTFRLKDQVVIDSVRNALALGYRAIDTAQIYDNEAQVGQAIADAGVPRDQLFVTTKIWVDRFSRDTLQPSLQESLRKLGTDYVDLTLIHWPSPKDQVPMREYLEALADAKAQGLTRAIGVSNFTIALTRQAIEILGADAIATNQIEVHPYLQNRTLIAFLREQGIHVTSYMTLAVGEVLKDPVIQAIARRHDATPAQVTLAWALQQGYSVIPSSTKRANLESNLKAQSLHLSEQDMAEIAALDRGERLANPKAIAPDWD

SEQ ID NO: 46778 - protein, 486 aa, Leifsonia xyli subsp. xyli str. CTCB07
MPENDAQANIGVVGLAVMGSNLARNLASREGNTVAVYNRTFARTEDLVGAHPEAGFVASESIDDFVASLATPRTAIIMVQAGKGTDAVIDQLVERFEPGDIIVDGGNANFLDTIEREKRVSATGVHFVGAGISGGEEGALKGPSIMPGGTAESYKTLGPILASIAAIAEGEPCVTHIGTDGAGHFVKMIHNGIEYADMQLIAEAYDLLRMVGGLEPAAIADVFAEWNTGSLESYLIEITAKVLRQVDAETGKPFVDIVLDQAGSKGTGVWTVQNALDLGIPVGGIAEAVFARAVSSKPAQRTAVQRVITSRPEAQRPEDLAAFADDVSKALYASKIVAYAQGFDAIVAGAEKYGWKLDKDKIAKIWRGGCIIRAQFLGRIADAYEENADIATLLEAPYFADALREGEAAWRRIVATAALSGVPVPGFGAALSYYDSLASGRLPAALVQGQRDFFGAHTYKRVDKDGTFHTLWSGDRTEIETEGSSH

SEQ ID NO: 46779 - protein, 528 aa, Fusobacterium nucleatum subsp. nucleatum ATCC 25586
MEQLEKLKEFRELGLSEKILKVLSKKGYESPTPIQRLTIPALLKNDKDIIGQAQTGTGKTAAFSLPIIENFENLEHIQAIVLTPTRELALQVAEEMNSLSTSKKMKVIPVYGGQSIDIQRKLIKTGVDVVVGTPGRVIDLIERKLLKLNSLKYFILDEADEMLNMGFVEDIEKILTFTNEDKRMLFFSATMPDEIMKVAKNHMKEYEVLAVKSRELTTDLTEQIYFEVNERDKFEALCRIIDLTKEFYGIIFCRTKTDVNEIVGRLNDRGYDAEGLHGDIGQNYREVTLKRFKTKKINILVATDVAARGIDINDLSHVINYAIPQEVESYVHRIGRTGRAGKEGTAITFITPQEYRRLLQIQKAVKKEIKKEKLPDVKDVIQAKKFRIIDDIGQILIDNDYDKFKKLAKDLLKMEDAENIVASLLKLSYSDVLDESNYNEISPVKMEDTGKTRLFIAMGRKDGMTPKKLVEFIIKKAKIKQSYIKNAEVYEGFSFVSVPFKEAEIIVEAFAKNRKGKKPLIEKAKSKK

SEQ ID NO: 46780 - protein, 325 aa, Leifsonia xyli subsp. xyli str. CTCB07
MSGITATGQKRLVLISGRAHPELAQQIAACLGSELVPTDARTFANGEIYARFDESVRGSDAFIIQSHTSPINEWLMEQLIMVDALKRASAKRITVVAPFYPYARQDKKGRGREPISARLVADLFKAAGADRIMSVDLHAAQIQGFFDGPVDHLFAMPVLLEHMRRELDPSTLTVVSPDMGRVRVADIWSDKLGVPLAIIHKRRDPLVPNQVSVHEIVGDVSGRVCLLVDDLIDTGRTIVKAAEALKASGATGVVVAATHAVFSDPAVELLQSEFIDSVVVTDTLPLPEHKRWDKLTVLPIAPLLADAIEQVFTDGSVTSMFDGAA

SEQ ID NO: 46781 - protein, 439 aa, Debaryomyces hansenii CBS767
MAVTKLFARYVYDSRGNPTVEVDLTTDKGLFRSIVPSGASTGIHEALELRDGDKSKWLGKGVTKAVANVNELIAPAFVKANLDVTNQSAVDDFLNKLDGTPNKSKLGANAILGVSLATAKAAAAEKNVPLYQHLADISGSKQDKFVLPVPFQNVLNGGSHAGGALAFQEFMIVPTDAPTFSEALRMGSEVYHNLKSLTKKKYGQSAGNVGDEGGVAPDIGSPREALDLIMDAIDKAGYKGKIGIALDVAASEFYKDGKYDLDFKNPNSDESKWLSGEQLASLYEELINEYPIVSIEDPFGEDDWDAWVHFYSKVSSKVQIVGDDLTVTNPLRIKTAIEKKAANALLLKVNQIGSLTESIKAAQDSFDATWGVMVSHRSGETEDTFIADLSVGLRAGQIKTGAPARSERLAKLNQILRIEEELGDKAIYAGKNFHAASQL

SEQ ID NO: 46782 - protein, 528 aa, Klebsiella pneumoniae subsp. pneumoniae MGH 78578
MHSSNVSTHGMAVAPHHLASQSALAILREGGSAIEAMVAAAAAIAVVYPHMNGLGGDGFWLIVPPEGDPIAIDASGAAGSLATLEAYAGQRHIPNRGPQAALTVAGTVSGWVEALRISRDLTGRALPVARLLADAIGYAEDGIPVTASQAHATASKLEELRHQPGFSETWLVAGEAPRPGSRFRQPALAGTLRMLASDGLDSFYRGPLAERLAQGMAALGMPITLGDLQAHRARRPGPLTLQHQQGTLWNLAPPTQGLVSLAILGITDRLKMADADDAQTVHRIVEATKRAFALRDAHITDPRHLDVDVQQLLTPEALQPLADSIDDASASPWGGGKGPGDTVWMGVVDNSGLAVSFIQSIYHEFGSGVVLPDTGIVWQNRGAAFSLDPQHLLALAPGKQPFHTLNPAAARLNDGRVMVYGSMGGDGQPQTQAALFTRYILQGVPLQESISRPRWLLGRTWGQSSDSLKLEGRFAPACIARLRELGHDVEVLADFSEAMGHAGAIVRHPNGLLEGATDPRSNGAAAGY

SEQ ID NO: 46783 - protein, 188 aa, Fusobacterium nucleatum subsp. nucleatum ATCC 25586
MSLIGRKVPEFKATAFKKGEKDFVTVTDKDLLGKWSVFVFYPADFTFVCPTELEDLQDNYEAFKKEGAEVYSVSCDTAFVHKAWADHSERIKKVTYPMVADPTGFLARAFEVMIEEEGLALRGSFVINPEGKIVAYEVHDNGIGREAKELLRKLQGAKFVAEHGEVCPAKWQPGSETLKPSLDLIGEL

SEQ ID NO: 46784 - protein, 478 aa, Rhodococcus sp. RHA1
MRERYETFVGGHDERSKSGQYFSTRDPATGDVIAEVALGGAEDIEAAVAVAQSAFRSWRDTPAATRGRILLEVARTLREHADELARIETLDTGQTLSQSNVDIETAARYFEYYGGAADKVHGETIPLGPDYLSYTRNEPFGVIGVVTPWNAPINQAARAIAPALAMGNVVVLKPAEDTPLSALEMSRLAVEAGLPAGVLNVVPGFGADAGAALTGHDKVRKIVFTGSVETGRAIMRAAAQRLIPLTLELGGKSPNIVFDDADLDAAATGAWTAFTTKAGQVCSAGSRLLVHSSVHDELVGRLVQHAKTTVIAPGIEDPDIGSLATRGQFDKVRSYLELGPSEGARVATGGHVADTGRLGRGLFIEPTIFVDVDNTMRVAREEIFGPVLTVLRFDSDEEAVEIANDSDYGLVAGVWTRDHGRAHRVAGAIEAGQVFINQYFAGGVETPFGGYKLSGFGREKGFEALKHYCQLKTITARL

SEQ ID NO: 46785 - protein, 220 aa, Myxococcus xanthus DK 1622
MTSPNFIPSTKPLPFELHPSSIQGQGAFAIRRIRKGTRIIEYLGERITQAEADVRYDDESMARHHTFLFNLDKRTVLDAGTIHNEARYINHSCAPNCEALIEKGHIYIYALTSIEPGEELVYDYGYERTEDMGPEAEALYVCRCGAPNCRGTILAPAKKAPARKTSAKKAKTSSTSRKKSASKSRGNKGAGGKKAAGKKSSAGTRKSTQRAKSPSRKRAS

SEQ ID NO: 46786 - protein, 290 aa, Morus alba
NWGFFELVNHGIPHEFLDTVEKMTKDHYRKCMEQRFKELVASKGLEAVQAEVNDMDWESTFFLRHLPVSNISEIPDLDDEYRKVMREFAKQLEKLAEELLDLLCENLGLEKGYLKKAFYGSKGPTFGTKVSNYPPCPKPDLIKGLRAHTDAGGIILLFQDDKVSGLQLLKDGHWIDVPPMRHSIVINLGDQLEVITNGKYKSVLHRVIAQTDGTRMSIASFYNPGSDAVIYPEPTLVEKEAEEKNQVYPKFVFEDYMKLYAGLKFQAKEPRFEAMKAVETSVTLGPIATA

SEQ ID NO: 46787 - protein, 321 aa, Thermosynechococcus elongatus BP-1
MNIAPDITALIGRTPLVRLNRIPQAEGCVAEIVVKLESMNPAASVKDRIGLSMIQEAEAAGLITPGKTVLVEPTSGNTGIALAMVAAAKGYRLILTMPETMSAERRAMLRAYGAELDLTPGTEGMSGAIRRAEEIAASLEDAFMLQQFKNPANPKIHRETTALEIWQDTDGQVDILVAGVGTGGTITGVAEVIKAKKPTFQAIAVEPSNSPVLSGGKPGPHKIQGIGAGFVPPVLKRELIDEVIPVSDDQAIHFGRRLAREEGLLSGISSGAALCAAIQVAQRPENAGKLIVMVQPSFGERYLSTPLFQEALPLVPSYLQT

SEQ ID NO: 46788 - protein, 297 aa, Mycobacterium sp. JLS
MQLGLVGLGKMGFNMRERLREGGHEVVGFDPRPEVTDVPSLAALADALAAPRVVWVMVPSGPVTHDTIVSLAEVLGEGDLVIDGGNSRFTEDAPHAELLKAKGIGFIDAGVSGGVWGLAEGYGLMVGGDDADIERVMPIFDTLRPPGDRADGFVHAGPVGAGHFAKMVHNGVEYALMTAYGEGYELLAAEELIRDPQAVYQAWTNGTVVRSWLQQLLAKALREDPGLAEISGYTEDSGEGRWTVEEAIRLRVPVPSIAASLFARFESRQEDSPTMKAVSALRNQFGGHAVQRISKSG

SEQ ID NO: 46789 - protein, 304 aa, Burkholderia vietnamiensis G4
MNYQPILERIHTELAPWIGQGRVADYIPELAKVPADKFGMAVVTLDGNVYTVGDARERFSIQSISKLFACTLAFQLLGDALWERVGREPSGTAFNSLVQLESERGKPRNPFINAGALVVTDVLCRRFVKAETALVEFVRRLIGATDVDYDSRVALSELQHAERNRAMAHFMASFGNMQMPPDTVIDAYCRQCAIEMNCIELAQAALFLANGGVAPVTGERIVDASSAKRLSALMLTCGTYDAAGDFVYRVGLPAKSGVGGGIVAVLPGEMAVCVWAPGLDANGNSLAGTLALEWLTTYSGRSIF

SEQ ID NO: 46790 - protein, 307 aa, Pseudomonas syringae pv. tomato str. DC3000
MSLPRIALIGECMIELQQHADGSLHQSFGGDTLNTAVYLSRLLGERAKVDYVTALGDDSFSDAMCRAWADEGIGLGKVQRMPGRLPGLYCIQTDASGERRFLYWRNEAAVRDCFMTPAAEPILAALASYDVLYFSGITLAVLGEQGRARLLEALGRARLRGVRVAFDNNYRPRLWASVEQAREAYQACLPHVDLALLTEDDEQALYGYADSEELLAAYRDRGIGEIVVKRGAQSCLIEAGGERFEVAPLKVEQVVDTTAAGDSFSAAYLAARLMGERPQQAAEAGHRLAAVVIQHPGALIAKSVMPV

SEQ ID NO: 46791 - protein, 511 aa, Gossypium hirsutum
MMAVLFVYLGFMVFGIIVLRFLYRFIDNNGLPRNWPFVGMIPTLLLNIHRPHDKVAQVLRRSNGTFFYRGLWFTNTSFLATSDPENVRYILSSNSSVYLKGPEWLKQFDIFGEALFNSDGEAWKCHRRVFHAFLNHPQYRQSLSKVLHQRIEEALVKVLEYVSGREMVVNLQDLLAGHAFDIGCITGVGFDPGLLSIEFPENRFQKAMSDTLEAAFYRYVVPDSLWKLQSWPQIGKGKKRSDAWKALDDLLTQFISTQRHKSTKSVASSGSNEEHDFNFLNCYLTGHEITGPTPKESLIRDNLIHFLFASDGTYSLTLTWFFYLISKAPVVENKIREEIKRHLSMKQVEGSLQIPSNYDELSKLTYLHAALCETLRLYPPIPFDFRTCTKQEYLPSGHRVDQNTRIIIGIHAMGRMESLWGEDCYAFKPERWIGEDGKIKRESPTKFSAFLAGPRICPGKEVSFLLMKATATAIIHNYNVHVVEGQNIGPKNSVVYQMKKGLMVRIKKRWS

SEQ ID NO: 46792 - protein, 78 aa, Zea mays
GKRFGIDGELVEFLGPFSPIPLPFVGGGSPMAAPGGIKKPGKNRVGVPIGGAFDFFGGGFPSKDVFLWPRKQNLVGQV

SEQ ID NO: 46793 - protein, 525 aa, Pseudoalteromonas tunicata D2
MSKNIHDSRVLILDFGSQYTQLIARRIREIGVYCELWAWDVTEEQIREFAPDGIILSGGPESTTEDNSPRAPEYVFNAGVPVLGICYGMQTMAMQLGGLVQSSDKREFGYAKVAKLGQCKLFDAIEDHVADNGQGILDVWMSHGDKVIEIPASFTTTAQTETCPHAAMADEAKRFYGVQFHPEVTHTQQGQRLLERFVVDICGCEKLWTPATIIEDAIERIKEKVGDDEVILGLSGGVDSSVVAMLLHRAIGSKLTCVFVDNGLLRLNEGQQVMDMFGDHFGLNIIKVDAEAQFLADLAGLSDPEAKRKAIGHTFIDIFDAESKKLKNAKWLGQGTIYPDVIESAASATGKAHVIKSHHNVGGLPDDMEMGLVEPLRELFKDEVRKIGLELGLPYDMLYRHPFPGPGLGVRVLGEIKKEYCDLLRRADAIFIEELHKADLYNKVSQAFTVFLPVKSVGVMGDARKYDWVVSLRCVETIDFMTARWSHLPYDFLGLVSNRIINEIDGISRVVYDISGKPPATIEWE

SEQ ID NO: 46794 - protein, 414 aa, Glycine max
RREKTTEGVATSTSKNHATKCTGCGNCTSPAENGIEILSQIPSPRLVNLIGFSTDPNGNKLLVVEYMPNGSLHDLLHSVKKPPGWNRRVRFALQVAKAVRELHSSNPPVIHRDVKSSNVLIDQEWNARLGDFGLALRGHVEDVRVKCTPPAGTLGYLDPCYLAPEDLSAKSDVFSFGILLLEIISGRNAIDVNFSPPSVVDWAVPLIKIGDFAGICDRRIGPPPDPAVVRQLAVLAARCVRSTAEKRPSMAEVVECLNLARKRIRASPIWNSLRRRVARVESALPVFDGNDCDGSEEFVRMVNKGGSGSKRNGKVSSVSRVGYGSEASNNNKVMRSKSIGSGSLKGSWVKMQPHQTENEGFGRRKVKLKRSKSMGVLQGSLLIHYGSENDVVIRSGMAKLVVKDKLEKPLVKSR

SEQ ID NO: 46795 - protein, 523 aa, Candida maltosa
MAIEQIIEEVLPYLTKWYTILFGAAVTYFLSIALRNKFYEYKLKCENPVYFEDAGLFGIPALIDIIKVRKAGQLADYTDTTFDKYPNLSSYMTVAGVLKIVFTVDPENIKAVLATQFNDFALGARHAHFDPLLGDGIFTLDGEGWKLSRAMLRPQFAREQIAHVKALEPHVQILAKQIKLNKGKTFDLQELFFRFTVDTATEFLFGESVHSLYDEKLGIPAPNDIPGRENFAEAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 46796 - protein, 404 aa, Glycine max
MGLHHHHHRKLMPLPEKICGSICHVKKSELCSSDCKVCLKICLTNPQYPSFYYSPPPPQVPPFQSYDDVVDGADQAYNHKISTYLFLALALLTAAFFVVSCRAIYTRFSSRRRVSSPSTSRRQTQTHHDDDDFVDDEEHHGRMVDHPIWYIRTLGLQQSIINAITVCKYKKGEGLIEGTDCAVCLSEFQEDENLRLLPKCQHAFHLPCIDTWLRSHTNCPMCRAPIVAEIATARMESSFVDSSSLENSHMEVLENSAPDSELMNNRAEEEEGQLEEVVDDDGVRVCETETPVEDVASTLPRSSVSLDSFSFANFNLALATVESNGNSKRVLGGVDDIDDPTASKGVIGNDLATSSKGSSSFRLARYLQGVPSSSVKRSQSFNGKYLLSWYGCSQKKPNAPLRSF

SEQ ID NO: 46797 - protein, 272 aa, Vibrio vulnificus CMCP6
MEHKNIAFIGAGNMVRAIVSGLVANGYPADKITATAPSETRRLPLEQQFGIQTTSDNLMAATQADVIVLSVKPQMMEEVCKPLQSVDFSNKLVISIAAGINCARLNDMLATQLNLVRVMPNTPSQLGLGMSGLYAPASVAEQDRHFAEQLMQAVGKTCWVDEESGINHVIAAAGSAPAYFFLFMEAMQAEAMAQGFDKQTARLLVQQSALGAASMVVENPDTELATLRENVTSKGGTTAEALRTFNEHQLSDIVAKAMQAAVARAQEMEKLF

SEQ ID NO: 46798 - protein, 343 aa, Arabidopsis thaliana
MICHRRIEFHEEEEEEEEDAWLMYDDLAADMEAQIHQIEKEAYISVLRAFKAQGDAISWEKESVITELRKELSLSNEEHRELLGRVNSDDTIRRIRQDLKSEHLSDEQGMETIWRNAAKYAQCCSTSMKTHKPNQPIPSQPFASSSPSFHPQADPTHPFASSTAKRGPVPIVKGKKHKPVFPGSSSTKHAPYHPSDQPPRGQVMNRLPSVPASSSEPTNGIDPESFLGRRVRTKWPEDNTFYDAIITQYNPVEISPGDIEWIGEDPGLGNRYNGQGHGLNRTTGPNCVPQRGSGLEKNTIRKGFRTSQNGTGKKKHLDIRIRQTDVLIREVGINYLQEGAFRR

SEQ ID NO: 46799 - protein, 236 aa, Vibrio vulnificus CMCP6
MNSIQQNIEHITTQIHDSTQKCGRARDSVQLLAVSKTKPVEAILEAYHAGQRAFGENYVQEGVEKVRFFAEQHPEKSIEWHFIGPIQSNKSRLVAEHFAWVHTIDRDKIAQRLNDQRPAELPPLQVLIQVNTSGEASKSGVSGEEIFALAELISTLPNLTLRGLMSIPENVDDHASQLAAFQPLAELQQRLVQRYPSVDTLSMGMSGDMDAAIESGSTMVRIGTAIFGHRDYSNKA

SEQ ID NO: 46800 - protein, 538 aa, Candida maltosa
MSVSFVHNVLEVVTPYVEYYQENLTKWYILIPTILLTLPFLSILHTKYLEYKFNAKPLTNFAQDYSFGVITPLMLMYFKWHGTVMEFACNVWNNKFLVLNGNVRTVGLRIMGLNIIETTDPENVKAILATQFNDFSLGTRHDFLYSLLGDGIFTLDGAGWKHSRAMLRPQFAREQVAHVKLLEPHVQVLFKHVRKSQGKTFDIQELFFRLTVDSSTEFLFGGSVESLRDASIGMVPSTKNIAGREEFADAFNYSQTYNAYRFLLQQFYWILNGSKFNKSIKTVHKFADFYVQKALSLTDDDLEKQEGYVFLYELAKQTRDPKVLRDQLLNILVAGRDTTAGLLSFLFFELSRNPTVFEKLKEEIHNRFGAKEDARVEEITFESLKLCEYLKACVNEALRVYPSVPHNFRVATRNTTLPRGGGKDGMSPIAIKKGQNVMYTISATHRDPSIYGEDANVFRPERWFEPETRKLGWAYVPFNGGPRICLGQQFALTEASYVTVRLLQEFHTLTQDANTRYPPRLQNSLTVSLCDGANIQMY

SEQ ID NO: 46801 - protein, 523 aa, Candida maltosa
MAIEQIIEEVLPYLTKWYTILFGAAFTYFLSIALRNKYYEYKLKCENPPYFKTAGFVGIPGLIDVIKAKNAGKLADYADQTFDEYPHHSFYMTVAGMLKIVLTVDPENIKAVLATQFNDFALGARHAHFDPLLGDGIFTLDGEGWKHSRAMLRPQFAREQIAHVKALEPHVQVLAKQIKLNKGETFDLQELFFRFTVDTATEFLFGESVHSLYDEKLGVPPPNNIPGRENFAKAFNTSQHYLATRTYSQMFYFLTNPKEFRDCNAKVHKLAQYFVNKALDASEDEVAEKSKGGYVFLYELVKQTRDPKVLQDQLLNIMVAGRDTTAGLLSFAMFELARNPKIWNKLREEIEVNFGLGEEARVDEISFETLKKCEYLKAVLNETLRMYPSVPVNFRTATRDTTLPRGGGKDGTSPIFVPKGSSVVYTVYKTHRLEEYYGKDAYEFRPERWFEPSTRKLGWAYVPFNGGPRICLGQQFALTEASYVITRLAQMFEHLESKDETYPPNKCIHLTMNHNEGVFISAK

SEQ ID NO: 46802 - protein, 168 aa, Triticum aestivum
MAPTVMASSATSVDPFQGLKSTAGLPVSRRSNGASLGSVSNGGRIRCMQVWPIEGIKKCETLSYLPPLSTEALLKQVDYLIRSKWVPCLEFSKVGFIFREHNASPGYYDGRYWTMWKLPMFGCTDATQVINEVEEVNKEYPDAYVRIIGFDNMRQVQCVSFIAFKPPG

SEQ ID NO: 46803 - protein, 276 aa, Gibberella zeae PH-1
MTRFRPCIDLHAGQVKQIVGGTLDSTSAALQTNYVSQHPPAHFAQLYRDNELHGAHVIMLGSGNDGPAKEALQAWPGGLQVGGGINDKNAKEWMDAGAEKVAHRKRLAKTVVLIIWQVIITSYLFPEGRFSQERLDAVLEALGCDKNKLVIDLSCRRRGEDSWFVAMNKWQTITDMEVNQESIKSLEPYCSEFLIHAADNEGLQKGVDEKLVERLAQWCSIPVTYAGGGRHLEDLENVKRLSNGKVDLTIGSALDCFGGSGVKFDDCVAWNKKQDN

SEQ ID NO: 46804 - protein, 334 aa, Methylococcus capsulatus str. Bath
MLRICNSLANLFPVWVLLCSGLALYFPPWFTWFTGPMIVWGLSIIMLGMGITLTFDDFHRVAKMPRIIIAGTVAHFGIMPFLGWSIAHGLALEPELAVGLILVACCPCGTASNVVSYIARADVALSVLLTMVSTFTAVVMTPLLVKLLAGAYTPVDGWGIFLNTLQVIVMPVTAGLLLNRYAPRLVRTVSPVTPLVSVIFIAFICASIIGANADVIKSAALKLFGAVALLHVGGFGLGYVFARVLGYRDAVVRTIAIEVGMQNSGLATVLAKANFAGMALAPIPSAISASFHSIIGSLLAGWWRLRTHRPLPSMGHAFDTPMPVPADCPDRCEP

SEQ ID NO: 46805 - protein, 305 aa, Zea mays
RPSVQANCEQASVQANCERSSRLPSNERQNFSTHNTFQEPKMESEGAGEHFVEQADGSGHVVWTSAMSAYMLSNLASLVAEGIRTSTGFKKVHLNMCAKTLNDYFKMLTGEQVKNHLRTWKRRYAKINRLRKLSAASWNEDNYMITLDHEHYANYVQDHKSDAEFLNKPLENYKEMFTVFGNNMATRKYAKGSSEALGTKDRNSMAETEIDEGDGNAVPSPIDDIEASSSTPRPRKKAKVTSNEEAGLIGAFKDGAERLAMAIEKAGSDDLPPDLLQTLQSIPGFDDTHKAFYFAYLMKNPGLAR

SEQ ID NO: 46806 - protein, 407 aa, Yersinia pestis CO92
MSSVDINVPDLPESVADGSVATWHKKPGDSVKRDEVLVEIETDKVILEVPASQDGILDAILEDEGATVTSRQVLGRIRPSDSSGKPTEEKSQSTESTPAQRQTASLEEESNETLSPAIRRLIAEHDLDATAIKGSGVGGRITREDVDSHLASRKSASAVVADAKAVAAAAPVLAGRSEKRVPMSRLRKRVAERLLEAKNSTAMLTTFNEINMQPIMDLRKQYGEAFEKRHGVRLGFMSFYIKAVVEALKRYPEVNASIDGEDVVYHNYFDVSIAVSTPRGLVTPVLRDVDTLSMADIEKKIKELAVKGRDGKLKVEELTGGNFTITNGGVFGSLMSTPIINPPQSAILGMHAIKDRPMAVNGQVVILPMMYLALSYDHRLIDGRESVGYLVTVKEMLEDPARLLLDV

SEQ ID NO: 46807 - protein, 388 aa, Yersinia pestis CO92
MNLHEYQAKQLFARYGMPAPTGYACTTPREAEEAASKIGAGPWVVKCQVHAGGRGKAGGVKLVNSKEDIRAFAEQWLGKKLVTYQTDANGQPVHQILVEAATDIDKELYLGAVIDRSSRRVVFMASTEGGVEIEKVAEETPELIHKIALDPLTGPQPYQGRELAFKLGLTGKQVGQFTKIFMGLATLFLERDLAMVEINPLVVTKQGDLICLDGKLGADGNALFRQPELREMRDPSQEDAREAHAAQWELNYVALDGNIGCMVNGAGLAMGTMDIVKLHGGEPANFLDVGGGATKERVTEAFKIILSDDKVKAVFVNIFGGIVRCDLIADGIIGAVEEVGVNVPVVVRLEGNNAELGAKKLADSGLNIIAATSLTDAAQQVVAAVGAK

SEQ ID NO: 46808 - protein, 541 aa, Campylobacter jejuni RM1221
MDNFLEIFLITVAIAIVLNVIFKKFEIPTIIGYIAAGEIISEIYHLSGKGEITHIAEFGIVFLMFTIGLEFSFKHLMAMKQEVFLNGSLQMLTCGFVFMLLAIGILGLGDKSATIVGFALALSSTAVVLKILNDNGDINEQYGRKALGILLFQDIAVIPLLLLVDIFSSNNQNIEKLLFTTLISALILITLLFFIGKYLVDRIFRLIIHTSSQEIFISTVLFMVIGASFLANYFGFSYSLGAFIAGALIAETKYKHKIEADLIPFRDLLLGLFFITVGMQIQLDVVAQNWFLIIVLTLLVMALKFGIVFGFLFLYTKKRVALKTAFAIAQIGEFALAIFSLLQAKNMLDIKTSQILIVVSILTMIITPFILNNIRKITNVVEDIALNTNAVQNIDSNIKLKNHLVVFGYGRLGQEVVQKIKNTGVPYLVLESDLNLVELGVSRGENVVFANAAQEETLKIANIEECAVAIITVTNEAKLEILCQVLANYPKPIDTIIHVNGTLKKMLFSSIDENIRIIRSEKVIARNLVQEALECRIHKNT

SEQ ID NO: 46809 - protein, 177 aa, Glycine max
  misc_feature (29)..(29): Xaa can be any naturally occurring amino acid
FILSSDIRATQWVLKALKKPGNSLMGNGXSKLGTGATVVAAANSTALECSKEIEAAMQISLRNALGMMNNRTTDGPMDDLTIMKETLRVKDEELQNLSRDLRARDSTIKDIADKLSETAEAAEAAASAAYTMDEHRRIACAEIERLNKDSEKQQELFTQKLNESEDKIWGLSKDRER

SEQ ID NO: 46810 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRDRGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 46811 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIYDCPNSRLMEQKKFAKFALTTESFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRDRGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 46812 - protein, 434 aa, Prochlorococcus marinus str. MIT 9211
MDHLDKPDKYLAKGWNQHIWPPFTQIASSLPQQRVVGSRDALLFREQGPPIIDAISSWWVTLHGHANEYVANAIADQAKKLEQVIFADFSHPQAERLAERLSHITGLQRLFFSDNGSTAVEVAIKIACQFWQNRKEPRHQLIAFEGAYHGDTFGAMAVGERNLFNAPFEKMLFPVSRLPWPATWWNDEDIENRENETITQLARLLETPTAAVILEPLVQGAGGMSMVREEFLKKVETVVKDSKALLIADEVMTGFGRCGDLFATKRAQVSPDLMTLSKGLTSGFLPMGVTMAREDIFETFVGNDPRLTFWHGHSFTANPLGCAAANASLDLLENAPSAYTRFESRHLPHLKKLAQHRKVTKPRLTGTIAAFNIEVSGKSGYLNVVGKSLKQFALEHGVLIRPLGNVVYLLPPLCITDDQLEKCYSIIEDGLEFC

SEQ ID NO: 46813 - protein, 316 aa, Fusobacterium nucleatum subsp. nucleatum ATCC 25586
MINFNNVKIFSGNSNLELAKKIAEKAGLQLGKAEIQRFKDGEVYIEIEETVRGRDVFVVQSTSEPVNENLMELLIFVDALKRASAKTINVIIPYYGYARQDRKSKPREPITSKLVANLLTTAGVNRVVAMDLHADQIQGFFDIPLDHMQALPLMARYFKEKGFKGDEVVVVSPDVGGVKRARKLAEKLDCKIAIIDKRRPKPNMSEVMNLIGEVEGKIAIFIDDMIDTAGTITNGADAIAQRGAKEVYACCTHAVFSDPAIERLEKSVLKEIVITDSIALPERKKIDKIKILSVDSVFANAIDRITNNQSVSELFN

SEQ ID NO: 46814 - protein, 273 aa, Aspergillus nidulans FGSC A4
MAELIEKAKRAAGKAAVENHYPKDAKFVGIGSGSTIVYVVEAIKELGIDTSGTCYVPTGFQSKQLIVSAGLTAVDFDAIPEGTVLDIAFDGADEVDDELNLIKGGGACLFQEKIVALQAKEFICVADSRKLQSRLLSNWKYIPIEVAPIAAKRVLPALRQLGSINPVLRPQTGSKLGPLKTDQDFYIIDAPFPTLLTKADVAAGKDGSGKDGIWEVDALSLAIKQIPGVLDVGIFSGVTGPQAQALGGIGGQKPVAAYFGMPDGSVQVRKADA

SEQ ID NO: 46815 - protein, 462 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVYGFWCTGTERHY

SEQ ID NO: 46816 - protein, 102 aa, Vitis vinifera
MASNLFKALTTSLNRPSNSRSLCLVSGQISNHTAKWMQDTSKKSPMELINEVPPIKVEARIVACEGDTNPALGHPIEFICLDLKEPAVCKYCGLRYVQDHHH

SEQ ID NO: 46817 - protein, 232 aa, Rosa hybrid cultivar
EWGVMHLVNHGISDELMERVKKAGQAFFDLPIEQKEKYANDQASGKIQGYGSKLANNASGQLEWEDYFFHCVYPEDKRDLSIWPQTPSDYIVATSEYAKELRGLATKILTVLSLGLGLEEGRLEKEVGGLEELVLQMKINYYPKCPQPELALGVEAHTDISALTFILHNMVPGLQLFYGGKWVTAKCVPNSIVMHIGDTLEILSNGKYKSILHRGLVNKEKVRISWAVFCEP

SEQ ID NO: 46818 - protein, 506 aa, Thermosynechococcus elongatus BP-1
MLLEAPTVPISPAALLHSLLELRQEITKEGEARFQEWQLKIKRSEFIPSARNLAYYLALRWRDLRAMQMALMPWGLSSLGRIESRVLPNLDAVINTLGALCHTHGSLPPRPPLDAFFAGDRQLRRQTEELFGPIRGKRHVRIMVTLPTEAATDRQWSITLLRKGMNCARVNCAHDDPATWEAMIEHLRAASHITGQPCKILMDLGGPKPRIADIFPETVRVHSGDRLRLTTEICPEGGEIPQFTCSLPEIVPQLEVGQRVWIDDGRTGGRIVSKDAQGVELTITHCKEGQRLKVAKGLNFPDSDLRLCPLTASDREHLAFACRYADIIGYSYVQSAEDIALLQRELAHCCGDCADQMGIIAKIETPKAIRALPEMIIQAAGRQPFGVMIARGDLAVEIGYQRLAEMQEEILWLCEAAHVPVVWATQVLENLVKKGVPSRAEITDAAMAERAECVMLNKGPYVGLAVDILDDVLARMEAHQQKKTPQLRALHSWHPDKTIGRPSICD

SEQ ID NO: 46819 - protein, 338 aa, Rhodococcus sp. RHA1
MKIAVIPGDGIGPEVIDQAVRTLHEVAPTIDTSYFDLGARNFRETGRLLAPETLDEIRHHDAILLGAIGDPTVPAGTLERGILLEMRFALDHHINPRPTKTMPGAPRVLAGDVNVDLLVVREGTEGPYTGNGGALRVGTPHEVATEVSVNTRFGVDRLLREAFERATVRRQRLTIVHKPNVLAFAGSLWTRAADDLSALYPDVEVDHMLVDAAMLHLVTNPARFDVIATDNLFGDLITDLTSALGGGVGLAASANIDGSRRNPGMFEPVHGSAPDIAGRGVADPTAAILSVALMLHHLGRSPEANAIDQAVQDHVATRGPESCSTEEIGEQIRSRVGS

SEQ ID NO: 46820 - protein, 337 aa, Rhodococcus sp. RHA1
MPTHQAVHVQAPGEPLTLVDVETGSPPRDHVRIAVSACGVCGTDHAFVNGAFPDMSWPLTPGHEIAGTIAELGEGVDNYAVGDRVAVGWFGGHCNQCIPCRQGSFIHCEKLQVPSWQYPGGYAESVIVPANALARIPNELSFAEAAPMSCAGVTTYDALRKTRAVPGDRVAILGIGGLGHLGVQFARAMGFETIAIARGADKGDDARQLGAHHYIDSTAGDVSEALQALGGVSVVLGTAASSKAMGDVVGGLLPLGELTVVGVTPDPLPISPLQLITPGVDVTGHPSGTARDVEETMHFAVLSGVRARIEEQPLARAAEAYAAMEEGRARYRMVLTM

SEQ ID NO: 46821 - protein, 334 aa, Streptomyces sp. TP-A0274
MKILVTGGAGFIGSHFVRSYADQDELTVLDKLTYAGNLANLEPVEGRFTFVHGDIGDAALVAEVVPGHDLVVNFAAESHVDRSIADADEFVHSNVLGVQTLMRACLDAGTPRVVHVSTDEVYGSIDTGSWDETAPLNPNSPYAAAKAGGDLIALAHARTHGLPVSITRCGNNYGPYQYPEKVIPLFVTNLLDGLSVPLYGDGGNVRDWIHVDDHCRAIRLVAERGEPGEVYHIAGTAELTNMDLTTRLLNALDADWRSVEKVRDRKAHDRRYSLTDARLRALGHRSRIPFEEGLVETIEWYTDNRAWWEPLKKRARPHALSRISAVRDRMPNFR

SEQ ID NO: 46822 - protein, 236 aa, Lactobacillus sanfranciscensis
DSFALAVDPEIFNLGLPILGICYGMQLMAKDLKGGEIVTADNSEYGQAQIEVTDKDSKFFKGMNDKQTVLMSHGDFVTKVPDGFEITATSGSCPISAMADPKRGFYAVQFHPEVNLTEEGREMLHHFVFDIAGAEANWSMDDFIEDAIANIKETVGDKKVLLGLSGGVDSSVVAVLLHRAIGDQLISVFVDHGLLRKNEAQQVLKALGDDFGLNIDFVDASELFLGKLKGVTDPET

SEQ ID NO: 46823 - protein, 350 aa, Streptomyces sp. TP-A0274
MLAGGSGSRLRPITHTSAKQLVPVANKPVLFYGLESIAEAGIREVGIVVGDTAAEIEAAVGDGSRFGLDVTYLPQEAPLGLAHAVTIARDYLGDDDFVMYLGDNFIVGGIGALLDRFRVSRPDAQILLTRVSDPRAFGVVELDTDGRVIGLEEKPEHPRSDLALVGVYMFSARVHDAVSRLKPSWRGELEITDAIQELIDADCRVESTLVSGYWKDTGNVADMLEVNRLVLDGVEADCSGVVDSSELVGRVVIEEGATVTGSRIVGPVVVAAGSRIHDSYIGPFTSIDRGCSVIDSEVEYSIVLRGASIVGVRRVERSLIGREVEVTSTPRILRSHRLVLGDHSKVQVAS

SEQ ID NO: 46824 - protein, 418 aa, Xanthomonas campestris pv. campestris str. ATCC 33913
MAPDLRHLHTFGELDPPQRLLMGPGPVNAHPRVLRAMAADLLGQFDPEMTTYMNEVMALYRPLFGTQNRWTFLVDGTARAGIEAALVSLVQPGDRVLVINFGRFGLLLTEILGRLGADVHTVDAPWGEVVPLAAIAEAIASVAPKLVATVHGDTSTTMAQPLDGLGALCRAAGALSYVDATATIGGMDIASDRWEVDVVTAGLQKCLGGPSGSAPITVSAAAAEAIFARRHVERGIVREDIANGSGPRIASNYFDLAMIMDYWSDKRLNHHTEATTMLYGARECARVALQEGLEARYARHAAAGRAVSAGVRALGLEVFGDDAHRMSNVTGVVIPHGVDSEAVRRRMREDFEIEIGTAFGPLQGRIWRIGAMGYNAMKHKVLLTLAALEAVLRAEGYACTQGLAVEAARAAWHAEPAA

SEQ ID NO: 46825 - protein, 380 aa, Zea mays
MEQVVNTVMDLVMPPASMVMLAFAWPTLSFLRGVEWALKTLTKEDMLGKVVVITGASSAIGEQIAYEYARRNANLVLVARREQRLFAIRDNARLLGAGHVLVIAADVVKEDDCRRLVADTVSYFGQLNHLVNTVSLGHDFSFEEAGDTTAFPHLMDINFWGNVYPTHAALPYLRRSHGRVVVNASVESWLPMPRMSLYSAAKAAVVDFYETLRYEVKEEVGVTVATHGWVGGDAGGSKFTLDQQQHHQEGAAADQVQWKQQGEREPAAATLLGGHVEAYARALVAGACRGDAYVKRPSWYDVFLVFRVFAPDVLAWTFRLLLSTSTPAPAGPSASASAIAARRPPPAALPAPPLRPLLEYPPAAVYRGPAHAQQVVQKLE

SEQ ID NO: 46826 - protein, 142 aa, Rhodopseudomonas palustris CGA009
MTVRAILETKGRYIHTVEAEARLASAVKTLAERRIGAVLVMHGTRLEGILSERDVVRVLADRGPAALDEPIGAVMTRDVFTCRQDDTVGEIMERMTAGKFRHLPVMEHDRVVGLISIGDIVKSRLSEYEHEQQALHDYIKSA

SEQ ID NO: 46827 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEEAYKHLTTPVFGTGVIYDCPNSRLMEQKKFAKFVLTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 46828 - protein, 364 aa, Plantago major
MEGRGCFGNFFERAKPYIAMICLQFGYAGMNIITKVSLNRGMSHYVLVVYRHAFATAVIAPFAIILERKVRPKITFTIFMQLFVLGLLGPVIDQNFYYAGLKFTSPTFSCAMSNMLPAMTFVMAVICRMEILDLKKVRCQAKLFGTIVTVAGAMLMTLYKGRVINFFWSQFIHPGVSSNAPDQTTQHSDSDWLKGSILLITATLAWAAFFILQAITMRKYTAHLSLTALVCFLGTLQSIAVTLVMEHRPHAWVVGWDMNLLAAAYAGIVSSGIAYYVQGLIMQKRGPVFVTAFSPLMMIIVAIMGSFILAENIYLGGVLGAVLIVIGLYSVLWGKYREYKDKEAEEIPEPMKGINGNNKMGAID

SEQ ID NO: 46829 - protein, 315 aa, Arabidopsis thaliana
  misc_feature (212)..(212): Xaa can be any naturally occurring amino acid
  misc_feature (242)..(242): Xaa can be any naturally occurring amino acid
  misc_feature (250)..(254): Xaa can be any naturally occurring amino acid
MIGSFLTKGLVMVFGYAYPAYECYKAVEKNKPEMQQLRFWCQYWILVAALTIFERVGDALASWVPLYCEAKLAFFIYLWFPKTRGTTYVYDSFFQPYVAKHENEIDRSLIELRTKAGDLAVIYCRKAVSYGQTRIVEILHFVALQSTPKPKPKEKKQAAAPEEEEQKQPDLKATSQAASSNPQVRLQSKKPQLVTKEPISPKPLSSPRKQQXLQTETKEAKASVSQTKLTTLTPPGPPPPPXPPSPLPTXXXXXNADPAQPSPTEAEEASQTVAALPEPASEIQRASSSKETIMEETLRITRGSLRKARSAGAPR

SEQ ID NO: 46830 - protein, 528 aa, Candida albicans
  misc_feature (279)..(279): Xaa can be any naturally occurring amino acid
  misc_feature (465)..(465): Xaa can be any naturally occurring amino acid
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIHDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDXLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGXGRHRCIGEQFAYVQLGTILTTFVYNLRWTIDGYKVPDPDYSSMVVLPTEPAEIIWEKRETCMF

SEQ ID NO: 46831 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEEAYKHLTTPVFGTGVIYDCPNSRLMEQKKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKASKGVSSPYLPFSGGRHRCIGEQFAYVQLGTILTTFVYNLRWTIDGYKVPDPDYSSMVVLPTEPAEIIWEKRETCMF

SEQ ID NO: 46832 - protein, 216 aa, Plantago major
TRKGSILLIIATLAWAAFFILQAITMRKYTVHLSLTALVCFLGTLQSIAVTLVMEHRPHAWVVGWDMNLLAAAYAGIVSSSIAYYVQGLVMQKRGPVFVTAFSPLMMIIVAIMGSFILAENIYLGGVLGAVLIVIGLYSVLWGKYKEYKEKEAEEIPEPMKGISGNNNMGTIDEDIEANIIVECEKHECRRMSFPAIAISSPMPNPPMLAKLAPKA

SEQ ID NO: 46833 - protein, 526 aa, Xanthomonas campestris pv. campestris str. ATCC 33913
MLHTLRARRGMVVAPHHLAAQAGRDILRAGGNAIEAAVATAACLAVVYPHMTGIGGDGFWLIHEPDGRVHAIDACGRAAQAATLDFYRGHTHIPWRGPGAANTVAGTVSGWALALQHGGGTLPLQQLLEEAIHHAEVGVPITLGGAHIAASKGDELRCLPGAYARIFEPRGAPLHEGAVLQQPQLARTLQRLAHDGLDSFYRGALADDIAADLRVLGSPLHADDLATHTAEASVPLSVAIAGARLYNHAPPTQGLASLLILALFDRLPATQADSFAHLHGLIEATKQAFLIRDAHIGDSAWMTLDAQALLDDSAALDALAARIDLHAALPWPQPSQAGDTVWFGAIDAQGRAVSCIQSTYFEFGSGLVLPHTGITWQNRGCSFRLATDGWNALAPGRKPFHTLNPALATFDDGRVMAYGTMGGEGQPQTQAALFSRYAHFGMPLQQAITAPRWLLGRTWGDDSTTLKLEDRFDPAVVQALRDAGHAVELLPAYSSVMGHAGALVREVTGVVSGASDPRSDGAVAGW

SEQ ID NO: 46834 - protein, 328 aa, Corynebacterium diphtheriae NCTC 13129
MKLLVTGGAGYVGSVCSTVLLEQGHEVTIVDNLTTGNRDAVPLGATFVEGDIKDVADNVLSSDSFDAVLHFAARSLVGESVEKPDEYWQHNMVTTLALLDAMKRNNVRNIVFSSTAATYGEPETVPITEDAPTHPTNPYGATKLSIDYAITSYAHAYGFAATSLRYFNVAGAYGLVGENREIETHLIPLVLQVALGHRDKIFMFGDDWPTEDGTPIRDYIHIRDLADAHILALQSNVEGSHRIFNLGSGEGYSVKQVIDTCREVTGHLIPAEVAPRRAGDPAVLIASSAKAQSELGWKPQRTDLHTIVSDAWAFTSQLGDKAHSASRG

SEQ ID NO: 46835 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEDAYKHLTTPVFGKGVIYDCPNSRLMEQKKFAKFALTTDSFKRYVPKIREYILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 46836 - protein, 540 aa, Frankia sp. EAN1pec
MGVARGEAGWDFFISYTAVDTAWAEWIAWQLEDAGYRVLIQAWDSVPGSNWAVRIQQGTTESDRTIAVLSASYLRSVYGQNEWHAAHAADPGGFARTLLPIRVEDCPRPGLLGQIVSIDLFGHPADVARQHLLDAISTARAGRAKPTAAPAFPPRPALPPQQPSARTAPPFPGPDPTASLDQPALRTHARSDRLLHGPQRRVSLAVVLLVITGTVFLASSARDRNPSATSAHSAAPPTSAPTPSLSGSPLRDHTDSVRSVAFSRDGRTLASASQDGTARLWDIAERTSQPLTGRIAVWSVAFSPDKHTLASANGDSTVQLWDVAEGTLPHPVASLPGHSDAVGSVAFSPDGRTLASASDDHTVRLWDVATGTTTHTLTDHTGPVNSVAFSRDGRTLASASDDHTVRLWDVAEGTLLRTLPGHTEPVMSVAFSPDRRTLASASQDNTVRLWDVAARTAPRLVGSLSDHTHWVMSVAFSPDGRILASASQDRTVRLWDVAARTTTHTLTGHTGPVFSVAFSLDGRTLASASDDNTVRLWDMS

SEQ ID NO: 46837 - protein, 327 aa, Leifsonia xyli subsp. xyli str. CTCB07
MTALATRPADPASSLSPGEVCDSVAALIGNTPLVELRSLTAGLGARILVKLEGRNLGGSSKDRTALSMIRTAEASGALSPGATIVEATSENTGIGLALIGRLTGHPVIIVHSADIADEKRKVLAAYGPRLVEALWDAAPDDPANPRAVADRIAQEIPGAWRPAQFANTANPAAHYRGTGPEIWRQTAGRVTHFVASVGTGGTVSGAGRYLKEASGGAVNVVGANPVGSTYGGGQAGRILVDGVGTAWPREFWPENFDPAVVDAVDTVEDAAVYCTLRRLAAEEELLLGPSVGARCRRRAAAGAVGGAGRGHRGRRPRRRGELPDEGF

SEQ ID NO: 46838 - protein, 198 aa, Corynebacterium diphtheriae NCTC 13129
MSILTVGEKFPEFNLTALKGGDLHDVNASQPEDYFETVSLDKYEGKWKVVFFYPKDFTFVCPTEIAAFGKLDEEFQDRDTQILGGSIDNEFSHFNWRATHPELKTVPFPLFSDIKHDLIKALGVENEEGVADRATFIIDPDGIIQFVSVTPDAVGRNVDEVLRVLDALQSEEVCACNWQKNDPTKNIDKFAELEKGLN

SEQ ID NO: 46839 - protein, 442 aa, Vitis vinifera
MVCRFSTKLLNICIASLCKVGQLEKAEAVVIDGIRLGLLPDVVTYNTLLSAYSRFVGIDAAYSVIHRMKEAGISPDVITYNSLIAAATKRCLLSRSLDLFEEMLRTGIRPDVWSYNSLMHCFFKLGKPDEANRVFQDIILTNLLPSSSTFNIMINGLCNNGYTGYALSLYRYLQRQGFVPELVTYNILINGLCKSRKLNAARRILRELGESGNVPDAITYTTVMKCCFRSRQFEQGFEIFSEMKSKGYAFDAFSYCAVIAALTKTGRLEEANDIMEQMARSDIDLDILEATYKLLDEIEEHGLECDEYTHTILIDGLCKAGNVEGALRHLKNMTKMGFDSTLVAQNCVIDGLCKVGQLDHAIKMFASMEVKDSFTYSSMVHNLCKARRYRHASRLLLACLRGGMKILRANQRSVIDGLCYSGYTSEARRLKSKIRLARILHY

SEQ ID NO: 46840 - protein, 793 aa, Thermococcus kodakarensis KOD1
MSEYRFIKWFEELGKEDVPLVGGKGANLGELTKAGIPVPPGFCVTAEAYKYFVENVKLEDGKTLQEWIMEIISQTNVDDSKQLQENTAKIRQKIIELPMLPEIAEEIERAYKELSARFNKDAVYVAVRSSATAEDLPEASFAGQQETYLDVYGVDDVIDKVKKCWASLWTARATFYRAKQGFDHSKVYLSAVVQKMVNSEKSGVMFTANPVTNNRNEIMINASWGLGEAVVSGSVTPDEYIVEKGTWKIKEKFIAKKEVMVVRNPETGKGTVYVKVADYLGPEWVEKQVLTDEQIIEVAKMGAKIEEHYGWPQDIEWAYDKDDGKLYIVQSRPITTLKEETKAEEVEGTEEAEVILKGLGASPGIGAGRVVVIFDASEIDKVKEGDVLVTTMTNPDMVPAMKRASAIVTDEGGRTSHAAIVSRELGIPAVVGTKEATKKLKTGDYVTVDGTRGVVYKGIVKSLVEKKEEKAAGAAGGQVVVAGAPLITATKVKVNVSMPEVAERAAATGADGVGLLRAEHMILSIGQHPIKFIKEGKFDELVEKLADGIRTVAAAFYPRPVWYRTLDAPTNEFKEMPGGEDEPDERNPMLGWRGIRRGLDQPELLKAEFTAIKKVVEEGYNNIGVMLPLVGHPEQIRKAKEIARSVGLEPHKDVEWGIMIEVPAAALIIEDLIKEGIDFVSFGTNDLTQYTLAIDRDNDRIAHLYDETHPAVLKLIKHVIKVAKKHGVETSICGQAGSDPKMAKILVRLGIDSISANPDAVELIRKTVAQEEQKILLEAARKRLFEEEDELEF

SEQ ID NO: 46841 - protein, 509 aa, Burkholderia vietnamiensis G4
MNANATPQPGQDVPTVKLLIDGAFVESATSEWRDIVNPATQQVLARVPFATAAEVDAAVQAAHAAYATWKNTPISARMRIMLKFQALVRANQQRIAKTLTAEQGKTLPDAEGDIFRGLEVVEHACSIGTLQLGEFAENVAGGVDTYTLRQPLGVCAGITPFNFPAMIPLWMFPMAIVCGNTFVLKPSEQDPLSTMELVELAIEAGVPQGVLNVVHGGKEVVDAICTHPLVKAISFVGSTAVGTRVYNLGSQHGKRVQSMMGAKNHAILLPDANREQAINALVGAGFGAAGQRCMATSVAVLVGSAREWLPDIVAKAKTLKVNAGSEAGTDVGPVVSRGAKARILSLIDAGVKEGAKLELDGRDVKVPGFEDGNFIGPTIFSAVTTDMTIYTHEIFGPVLVVMEVDTLDEAIALVNANPMGNGVGLFTQSGAAARKFQSEIDVGQVGINIPIPVPVPFFSFTGSRGSKLGDLGPYGKQVVQFYTQTKTVTARWFDDDTTAGPVNTTIRLH

SEQ ID NO: 46842 - protein, 482 aa, Thermosynechococcus elongatus BP-1
MVISAERTNVGFITQVIGPVVDIEFPSGKMPAIYNALRIQGKNAAGLDVAVTCEVQQLLGDNRVRAVAMSSTDGLVRGMEVVDTGAPISVPVGTATLGRIFNVLGEPVDEKGAVNATETLPIHRPAPSFTQLETKPSVFETGIKVIDLLTPYRRGGKIGLFGGAGVGKTVIMMELINNIATQHGGVSVFAGVGERTREGNDLYNEMIESGVIDKDDPSKSKIALVYGQMNEPPGARMRVGLSGLTMAEYFRDVNKQDVLLFIDNIFRFVQAGSEVSALLGRMPSAVGYQPTLGTDVGALQERITSTTEGSITSIQAVYVPADDLTDPAPATTFAHLDGTTVLSRSLAAKGIYPAVDPLGSTSNMLQPDIVGEEHYQTARAVQATLQRYKELQDIIAILGLDELSEEDRLTVARARKIERFLSQPFFVAEVFTGAPGKYVTLEETIKGFQMILSGELDDLPEQAFYMVGNIEEAKAKAEKLKA

SEQ ID NO: 46843 - protein, 560 aa, Rhodococcus sp. RHA1
MTTPKTRSVQAKAPRTEGQWAQGDREPLNVNEQVKQDDDGLNVRKRIEEVYCRTGVAGIDPTDRRSRFRWWGLYTQRAPGIEGGRTATLPPEELEDEHFMLRIRIDGGALTTEQLRVVGEVSRLFARDTADLTDRQNIQLHWIRVEDLPEIWRRLEGVGLTTAESAGDTPRVVLGSPMAGIAVDEVLDATPALHEITRRLIANPDYSNLPRKFKTAISGLQDVVHEINDVAFIGVDHPDHGPGLDVWVGGGLSTNPRIGERLGAWVPLEDVPDVWIGIVSLFRDYGYRRLRAKARLKFLVSDWGVEKFRDVLEKEYLGRAMLDGPAPEPLDEPRDHVGIQRQKNGLNAVGIAPVVGRVGGTVLTDLARAAEASGSRRVRITPMQKLVILDVEDDSIDSLQADLEKLGFPARPSPWRRSTMACTGIEFCKFGIVETKARAATLIADVEKRLADVQDQLEHPITVHLNGCPNSCARIQVADIGLKGMIVTDVDSNQVEGFQVHLGGGLGLDTSFGRKLRGHKLPATEVPDYVERIVRRYVAGREGSEKFATWVQRATEADLA

SEQ ID NO: 46844 - protein, 436 aa, Acidovorax sp. JS42
MAVWALGINHHTAPLDLRGRFAFALDQIAPTLHGLRDSLSSASGRHPGVETAIISTCNRTEIYCAAEAPALDHTLDWLAHSGGVSPALLRSHSYSLENGLVARHAFRVASGLDSMVLGEAQILGQMKDAVRAAEGAGALGTTLNQLFQRSFAVAKEVRTSTDIGAHSISMAAAAVRLAGQLFEDLSQIRVLFVGAGEMIELCTTHFAAKNPKQISIANRTLERGEKLAARFGGDVMRLADLPDHLHEYDAVISCTASSLPIIGLGAVERSLKKRRHRPMFMVDLAVPRDIEPEVQQLQDAYLYTVDDLASVVQTAQAHRQAAVAQAEAIIDAGVQSFVHWMELRSPATQNGGVVPLIQQLNSQADEWRALEIARAKKRLAKGEDIETVLEALSRGLTQKMLHGTMAELRAGDAEARAQTAQAVSRLFLRSHSKNGL

SEQ ID NO: 46845 - protein, 160 aa, Pseudoalteromonas tunicata D2
MIRIGHGFDVHRFGGEGPLTIAGVKIDYPQGFVAHSDGDVAIHALCDAILGALALGDIGKHFPDTAKEYENIDSRILLRHVVSLATERGYQLGNADITIVAQAPKMLPHIEKMRAILAADLNASVEQVNVKATTTEKLGYEGRKEGISTHAVVLMMSQPV

SEQ ID NO: 46846 - protein, 443 aa, Myxococcus xanthus DK 1622
MKRADIVGLDKAHVWHPYTAMEAYIAETDPLVVVRSEGAYLHDADGTRYLDANGSWWVSTLGHRHPRLMRALAEQAAALPHVSLAGITHEPAALLASELAAIAPGSDRPGLPSSERLSRVFYSDNGSTAVEVAIKMAAQYWAQNGQPRRTRFITLSGAFHGETMGATSVGGVPLFREVFGPLLFDVVHVPSPAEEGGWARAFEQVQSTLRAHPEVIAGVILEPVLQGAAGMVMYSPDFVRAVREATSEVDTFLIADEVFTGLGRTGARFAVDLAGVVPDMLCLAKALSGGILPFGATLASERVFSGFLGASNRALYYGHSYCGNPLGAAIAREVLAVYRDEDVMGQVARKAPRVKAAFERMAASIPGLVRPRAVGMVGAVDLGGGGYLARGGWRVYEAARRRGLYLRPMGDTVYIAPALTISDEALEELLSGVEASLQEVAGG

SEQ ID NO: 46847 - protein, 387 aa, Xanthomonas campestris pv. campestris str. ATCC 33913
MTHSHAAPSKRRVILEDDIDGFTPAQLLLLQSPEVEVLGISAVSGNIWRDEVIAHSCRLLELAGQPQILVHPGPVHPLLNSELATERWEALYGKLVWKGAWTKHWVDGDTVQSAPRYHAHDVVPDLPLGNPSVVRASDEPAALFMLRMVRQYPGEVSIIATGPLTNLALAQALDPAFATLARELVYMGGSLNPRQQRDSVSARQFAREFVNSPRREFNIRWDPEAASIVMRAPWRKITMVPVDPSTATELTPELLARMSAADTPIGHALRRRETGFPMWDELATAVWLRPELATHTETLYIDTNTAFDAGYGDILSWAPGYQPGLGEQAQTVVHAVNVQAFEQLLVDHLTAPQSPAVGLPLSLLPSGEVARRADEGTSPDKDAAPVE

SEQ ID NO: 46848 - protein, 162 aa, Plantago major
MAPIAVGDVIPDGQLSYFDGEDQLQTVSIHSLAAGKKVILFAVPGAFTPTCSMKHVPGFIEKADELKSKGVDEILCISVNDPFVMKAWAKTYPDNKHVKFLADGSATYTHALGLELDLAEKGLGVRSRRFALLVEDLKVKVANVESGGEFTVSSAEDILKAL

SEQ ID NO: 46849 - protein, 176 aa, Rhodopseudomonas palustris CGA009
MAIYELDGHRPDLPADGNCFIADSASVVGKVRLGSSVSVWFGAVLRGDNEWIEIGEGSNIQDGTTCHTDPGFPLRVGKGCTIGHNVILHGCTIDDSVLIGMGAIVMNGAKLARGCVVGAGAVVTEGKSFPENSLILGAPAKVARTLTPEQVQAMLAGAGFYVANGQRYAKGLKKIG

SEQ ID NO: 46850 - protein, 605 aa, Burkholderia mallei ATCC 23344
MYRYTEFDKAFVRNRAAQFRDQLERWRQGALSEDAFRPLRLQNGWYVQRHAPMLRVAVPYGELSSAQIRMLARIARDYDVPEPARYRAACDAQARLGTVRLPTRNAHFTTRTNVQFNWIPLEKAADVMDLLATVDMHGIQTSGNCIRNISCDERASVAPDEIADPRPFAEVMRQWTTLHPEFAFLPRKFKIAITGAADDRAATDWHDVGLRLVRDAAGELGFRVSVGGGMGRTPMTATLVRAFVPWRHVMNYIEAIVRVYNRYGRRDNRYKARIKILVKAEGQRYIDDVDEEFRQIVEHDGGPHTIEQAEFDRVCASFVPPVPPPCAAGRHAKTDIDADMDAALARMRTLAGAQPAFARWLERNVAPHRDPARRIVTLSFKRRHQAPGDASPEQLDALAHLAERFSAGEARVTHAQNVVLPWVRAIDLHALWEAARDAGLASANVRLLTDMIACPGGDFCALANARSIPIADAIAERFDDLDELHDIGDVDLHVSGCINSCGHHHSGHIGILGVDKDGDEWYQVTLGGSDGTAANGPAQPGKVIGPSFSADEIVDVVDALVATYLRVRRTEAGRVERFIDAYRRVGPEPFKAAANAARHPETSVA

SEQ ID NO: 46851 - protein, 250 aa, Yersinia pestis CO92
MAVTKLVLVRHGESQWNNENRFTGWYDVDLSEKGRSEAKAAGKLLKDEGFTFDFAYTSVLKRAIHTLWNILDELDQAWLPTEKTWKLNERHYGALQGLNKSETAEKYGDEQVKQWRRGFAITPPALEKSDERFPGHDPRYAKLTDAELPTTESLALTIERVIPYWNDVIKPRIASGERVIIAAHGNSLRALVKYLDDLGEDEILELNIPTGVPLVYEFDENFKPIKHYYLGNADEIAAKAAAVANQGKAK

SEQ ID NO: 46852 - protein, 520 aa, Arabidopsis thaliana
MNIVDFQNCFFFVLLSLFSLLCYSLFFRKPKEPRLHYDLPPSPPTLPIIGHLHLLLSVLVHRSLQTLSTKYGSILYLRVFSFPVALVSSASIAYEIFREHDVNISSRGFPPTDDSLFAGSFSFTSAPYGDYWKFMKKLLVTNLLGPQALERSRGFRADELDLFYENLLDKAMKKESVDICVEALKLSNNSICKMIMGRSCSEENGEAERVRALATQLDGLTKKILLANMLRAGFKKLVVSLFRKEMMDVSSRFDELLERILVEHEDKLDMHHQGTDLVDALLAACRDKNAEYKISRNHIKSFFADLLFASTDTFVQTTQWTVAEIINNPNVLERLRGEIDSVVGKARLIQETDLPNLPYLQAVVKEGLRLHPPGPLFARFSQEGCRIGGFYVPEKTTLMINAYAVMRDSDSWEDPDEFKPERFLASSRSEQEKERREQAIKYIAFGSGRRSCPGENLAYIFLGTAIGVMVQGFEWRIKEEKVNMEEANVGLSLTMAYPLKVTPVPRTLVPLTQNPLNRSS

SEQ ID NO: 46853 - protein, 511 aa, Campylobacter jejuni RM1221
MKKADILVLDFGSQYTQLIARRLREQGVYAEILPFNVSLTDIKAKEPKGIILSGGPASVYATDAYFCDKGIFDLNLPILGICYGMQLMAHHYKATVAPAGHKEYGKANIEIKKDNALFKNLPKKQTVWMSHSDKVENLPQGFEVLATSENSPFCVFGNEDKKFFALQFHPEVQHSEFGKNILKNFAKYACNCESVWNMGSFAKTQAEKIREEVGNDKVLCAVSGGVDSSVVAALLASAIKEQVIVVFVDNGLLRSREKEQVEFMFKNTLGIDLISIDASEIFLSRLANVTDPEQKRKIIGNTFIEVFEEEAKKHKDVKYLAQGTLYTDIIESSVVGASKTIKSHHNVGGLPEKMNLKLIEPLKEIFKDEVRALGLELGLSKEVVYRHPFPGPGLAIRIMGEVNRPGLELLRKADVILLEELKSTGWYDKTWQAFCVLLNVKSVGVMGDNRTYDNAVCIRVVDASDGMTATFSHLPYEVLENISRRIINEVEGINRVVYDISSKPPATIEWE

SEQ ID NO: 46854 - protein, 640 aa, Oryza sativa Indica Group
MQNSIVFVLTEVVMPGVSGISLLSRIMNPQYFARIFPVIMMSSNDAMGTVFKCLSKGAVDFLVKPIRKNELKNLWQHVWRRCHSSSGSGSESGIQTQKCAKSKSGDESNNNSGSNDDDDDDGVIMGLNARDGSDNGSGTQAQSSWTKRAVEIDSPQAMSPDQLADPPDSTCAQVIHLKSDICSNRWLPCTSNKNSKKQKETNDDFKGKDLEIGSPRNLNTAYQSSPNERSIKPTDRRNEYPLQNNSKEAAMENLEESSVRAADLIGSMAKNMDAQQAARATNAPNCSSKVPEGKDKNRDNIMPSLELSLKRSRSTGDDANAIQEEQRNVLRRSDLSAFTRYHTPVASNQGGTGFVGSCSPHDNISEAMKTDSAYNMKSNSDAAPIKQGSNGSSNNNDMGSTTKNVVTKPSTNKERVMSPSAVKANGHTSAFHPAQHWTSPANTTGKEKTDEVANNAAKRAQPGEVQSNLVQHPRPILHYVHFDVSRENGGSGAPQCGSSNVFDPPVEGHAANYGVNGSNSGSNNGSNGQNGSTTAVNAERPNMEIANGTINKSGPGGGNGSGSGSGNDMYLKRFTQREHRVAAVIKFRQKRKERNFGKKVRYQSRKRLAEQRPRVRGQFVRQAVQDQQQQGGGREAAADR

SEQ ID NO: 46855 - protein, 352 aa, Schizophyllum commune
MGACVSSSSQPVADVQAKERSDEIDSQIKADSERLKKECKILLLGSGESGKSTIVKQMKIIHKNGFSPQELASFRPTVYRNVIDSAQAVAQIIKKANPESPNLALLDKIIDYDANGIVTPDLADAIRRITSDPATPKIIDEHANEFYLMDNAAYFFENVVRIGAEKYLPTETDILRARVKTTSIKETRFACGPLTIHMFDVGGQRSERKKWIHCFESVTSIIFCTALSEYDQVLLEEKNQNRMAESLTLFESVINSRWFLRTSIILFLNKTDVFKIKLPKVPLDRYFPEYTGGNDINKAAKFILWKFMQANRARLSVYPHLTQATDTKNVRHVFAAVKETILHNALKDSGIL

SEQ ID NO: 46856 - protein, 338 aa, Yersinia pestis CO92
MYVLVTGGSGYIGSHTCVQLIEAGYKPVILDNLCNSKSSVLARIHSLTGYTPELYAGDIRDRTLLDSIFAAHPIHAVIHFAGLKAVGESVNRPLEYYNNNVFGTLVLLEAMRAAQVKNLIFSSSATVYGDQPQIPYVESFPTGSPSSPYGRSKLMVEQILQDVQLADPQWNMTILRYFNPVGAHPSGLMGEDPQGIPNNLMPFIAQVAVGRRESLAIFGNGYPTPDGTGVRDYIHVVDLADGHVAAMKTLHGKPGVHIFNLGAGVGHSVLQVVAAFSKACGKPLAYHFAPRREGDLPAYWADATKAAEQLGWRVSRSLDEMAADTWHWQSKNPQGYPD

SEQ ID NO: 46857 - protein, 564 aa, Corynebacterium diphtheriae NCTC 13129
MNNVMTDTIIKGTGVVSGVRYAKAVWISPRPKLPQAGEVVDEADRAQQLDNFVAAADAVAQRLLDRSEHAEGAASEVLKATAGMVKDRGWQKAVKKGIQGGHPAEYAVVAATTKFVSMFEAAGGVMAERTTDLRDIRDRVIAELRGDLEPGLPDVHEQVVLFADDLSPADTAALNTDYFVGLVTELGGPTSHTAIIARQLNVPCIVATGEKIHKIEVGTDVLIDGALGTVTLDADPETARAAELESRMLAERIAQWKGPAETKDGHRVQLLANVQDGKAARIAATESQAEGIGLFRTEMCFLTATEEPSVDEQAAVYKKVLEQFPDSKVVVRSLDAGSDKPVAFASMADEMNPALGVRGLRVARANESLLTRQLDAIAQAAHELGRDENSPTWVMAPMVATTREARWFAGLCAERGLTAGAMIEVPAASLMADKLMPYLDFVSIGTNDLTQYTMAADRMSPQLAYLTDPWQPAVLRLIKHTCEEGKRFNTAVGVCGEAAADPLLACVLTGLGVNSLSAASTAIAGVGAQLASVDFETCVRAAEAAVNAEGAIDARAAVRKVLQP

SEQ ID NO: 46858 - protein, 386 aa, Chlamydia trachomatis D/UW-3/CX
MHLHEYQAKDLLTAYQLPIPPYHVATSVPEVETAIQAEQWKAGVVKAQVHAGGRGKNGGVVIAHSPEDLLAAADKLLHMQFSSNQTAGLSLPINKVLISPLVEIASEYYLAIVIDRKHRCPVIMLSKAGGVDIEEVAEKQPDQLLKMTLPSSGKIYGYQLRRIAKFMEWDQPIADQGNRIIRQLLQCFYEKDASLLEINPLVLTKDGSLVILDAKMTIDDNALYRHPQLADCYDPSQENIRDVLAKQLGLSYIALDGTIGCLVNGAGLAMSTLDILKLYGGSAANFLDVGGSASEKQIQEAISLVLSDKSVRVLFIHIFGGIMDCAVVASGLVSAMQGQKETIPTVIRLEGTNVDKGKDMIINAGIPCEFVTSMSEGAELAVQLSR

SEQ ID NO: 46859 - protein, 237 aa, Prochlorococcus marinus str. MIT 9211
MEDLQTQMKEAVAKAAIEQIHDGMVLGLGSGSTAALMIKALGAKISSGHLKDIVGVTTSFQGEVLATELGIPLQGLSAVSQIDLAIDGADEVDSNFQLIKGGGACHVQEKLVASLAERFVVVVDSSKIVKTLNLTFKLPVEVLPSAWQLVKNKIHEIGGVSQLRMAQKKAGPIVTDQGNLVLDVTFAGGINDPQTLEKQINNIPGVLENGLFVNLADEVLVGEIVSGTPGVKSLQKI

SEQ ID NO: 46860 - protein, 222 aa, Listeria monocytogenes EGD-e
MKMIAASIMCADSLHLADELRALEQANVKMLHCDVMDGVFVENAAMGAYVLQDIKNNTKMLLDIHLATVNPDKFVDLYAAIKPAYMSFHLEASRDVNATINHIRELGIRPSIAISPDTEIEQIYPFLGKVDMVLMMTVNPGFAGQKFQHHVLEKIKKLQKELESHTNKPLIEVDGNIFEETVRLLEPIGADVYVVGTAALFNEKAGSYTEKLAPLREIIQER

SEQ ID NO: 46861 - protein, 186 aa, Oryza sativa Indica Group
DELMLDGNPRLNLASFVTTWMEPESDKLIMDSVNKNYVDMERVPCHHGAPNRCVNIIPHLFNAPIKEDETAIGVGTVGSSEAIMLAGLAFKRKWQNKRKEQGKPCDNPNIVTGANVQVCWQKFARYFEVELKEVKLSEGYYVMDTVKAVEMVDENTICVAAILGSTLTGEFEDVKLLNNLLTEKNK

SEQ ID NO: 46862 - protein, 254 aa, Triticum aestivum
YNKFVQKSRLVPVRNSRDIVDPRVRTGASHGGVLAGLAACGVMMSIVSTAADLMQDFKTGYLTLASPRSMFISQVIGTAMGCVIAPCVFWLFYKAFDNIGISGTEYPAPNAAIFRSMAILGVDGFSSLPKNCLTLCYIFFVGAIVVNLIRDLVPKKVSNFIPIPMAMAIPFYIGSYFAIDMFIGTVILFVWQRLDRAKSETFAPAVASGLICGDGLWVLPQSVLALAKVKPPICMKFLSRGMNDKVDAFITTLS

SEQ ID NO: 46863 - protein, 192 aa, Exiguobacterium sibiricum 255-15
MNLPNQLTVLRVLLIPVFVAVLAINPDWGQWDVLGAVLPVSHFVAAMIFSVAAITDWLDGYIARKNKLVTNFGKFMDPLADKMLVAAALVYLVELDFVAAWVVVIILCREFAVTGLRLVASDEGIVLAAGNSGKAKTWVQLTSIIAFLLHDIGFALLNIPFAEITMWLALVLTIYSGVEYFSKNIKLITKSM

SEQ ID NO: 46864 - protein, 216 aa, Listeria monocytogenes EGD-e
MAKIVPSVFGADIGRINEQLQVLEKNDIDLLHVDMMDGSFVPNIAFGPDQIKMMKKGTKLQFDVHMMVYEPDRYIPRLVEAGAHMITVHQEATTHLHRTIQLIKSYGVRAGVVLNPGTPPSTLEYVLDDIDCILLMTVNPGLGGQKFFQSSLEKIRKTKAYIGNRPIQIEVDGGVNDELAKECTLAGADLIVVGSYLFEGDIEANLEKLAKGVLTE

SEQ ID NO: 46865 - protein, 348 aa, Listeria monocytogenes EGD-e
MKALKLYGKRDLRYEEADMPTIEEPDDVILKVKTVGICGSDISRYSKLGPYVPGMVWGHEFSGEVIEVGSEVTDIEIGDRAAGCPALYCGECEYCKKGEFARCRKLTVIGARHPGAYAEYIKLPAENVVKIPNELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 46866 - protein, 473 aa, Kluyveromyces lactis NRRL Y-1140
MSKRSSQHVVGIHYAVGPKIGEGSFGIIFEGENILNGGSKNPVAIKFEPRRSDSPQLRDEFRAYRILNDVRGIPHAYYFSQEGIHNILIIDLLGPSLEDLFEWCSRKFSVKTTAMLAKQMIDRVRSIHEHDLIYRDIKPDNFLISEFQRELSDGSVVKSCATSSGGDANLIYVVDFGMAKQFRDPNTKQHIPYRERKSLSGTARYMSINTHFGREQSRRDDLESLGHVFFYFLRGSLPWQGLKALNNKAKYEKIGLTKQRLKPTDLLTPEIPKQFAEYLSYCRSLRFDQDPDYDYLISLMTQIMQENGYEEDGHYDWMDLNGGQGWNIKVNKRVNLHGYGNPTPRNTKHSAQQLTPLHQQQAQQQAPGQVQGQNHQQQNSRHDSRNYRSFSQSTPNKSQKKNVNSSMGNSRVRLSQGNGFVGPNVPLKQNLNIQSYDSMGKLHGRRIPNNEEYDDNDSIEEGGFFSKLCCGIC

SEQ ID NO: 46867 - protein, 314 aa, Aspergillus nidulans FGSC A4
MSLADTTYKLNTGAEIPALGLGTWQSAPGEVSAAVYHALKVGYRHIDAAQCYGNETEVGEGIKRALSEGIVKRSEIFVTTKLWCTYHTRIQQALDLSLSKLGLDYVDLYLVHWPLAMNPNGNHDLFPKLPDGSRDLVREHSHVTTWKGMEELITNNPDKVKAIGVSNYSKRYLEQLLPQAKIVPAVNQIENHPALPQQEIVDLCKEKGILITAYSPLGSTGSPLFKAEAIVAVAERRGVTPASVLLSWHLARGSSVLAKSVTPSRIEENRKLVKLEPEDVELIGKYSAELAATNGFQRYVYPPFGVDFGFPDKS

SEQ ID NO: 46868 - protein, 382 aa, Rhodococcus sp. RHA1
MFELIDEWGPEKVVCVSDARTGMRGVLVIDNTARGMGKGGTRMSTTVSVGEVARLARNMTWKWAGVDLFYGGAKAGIWADPTASSKEAVLRAFVRALRNEVPEEYVFGLDVGLTEKDAAIMLDEVGGRGGAVGTPHALGGLPYDQLGVTGHGVAESADAAAQALGLSTGSLSVSIQGFGAVGAASAKRLAELGATIVAVSTSQGGIHNPDGLDVATLLDLRDQYGDGLVDQYSDAKPLAAGEELSVTADILIPAALQDVIDADLARTLPAKIVVEGANLPSSPEAQSVLFDRGVTVVPDFIANAGGVVAAAVAMDARYSGIRPEPAAVFDNISNKLRASTIDTLDASKAQGRTTHEVARATAQERVREAMVLRGRSPQNAAF

SEQ ID NO: 46869 - protein, 336 aa, Streptococcus agalactiae
MVVKVGINGFGRIGRLAFRRIQNVEGVEVTRINDLTDPNMLAHLLKYDTTQGRFDGTVEVKEGGFEVNGQFVKVSAEREPANIDWATDGVEIVLEATGFFASKEKAEQHIHENGAKKVVITAPGGNDVKTVVFNTNHDILDGTETVISGASCTTNCLAPMAKALQDNFGVKQGLMTTIHAYTGDQMILDGPHRGGDLRRARAGAANIVPNSTGAAKAIGLVIPELNGKLDGAAQRVPVPTGSVTELVETLEKDVTVEEVNAAMKAAANDSYGYTEDPIVSSAYRGISYGSLFDATQTKVQTVDGNQLVKVVSWYDNEMSYTSKLVRTLEYFAKIAK

SEQ ID NO: 46870 - protein, 461 aa, Klebsiella pneumoniae subsp. pneumoniae MGH 78578
MMTDKVRIDTLRADLLDANNETFLARQAEFESNVRSYPRKLPLAITKAEGVWLTDADNKQYLDCLAGAGTLALGHNHPDVLQSIQSVITSGLPLHTLDLTTPLKDRFSEYLLSCLPGEGKEYCLQFTGPSGADAVEAALKLAKKYTGRTAVISFSGGYHGMTHGALSVTGNLSPKAAVNGMMPEVQFMPYPHLYRCPLGIGGEAGVKALTYYFENLINDVESGVRKPAAVILEAVQGEGGVNPAPVEWLQRIRKVTEEHGILLIVDEVQAGFARTGKFFAFEHAGIQPDIIVMSKAVGGGLPLAVLGIKKQFDAWEPGHHTGTFRGNQLAMATGLTTLRHLRDNKIADKVAAQGEWLKGKLAELQKRYPVIGHVRGLGLMIGIEIVKPNEAQDHMGCYPADGELSALLQKKCFEAGLILERGGRHGCVLRLLPSLLISDAELDVFLDKFEQALLAAGVKPV

SEQ ID NO: 46871 - protein, 336 aa, Streptococcus sp. 'group C'
MVVKVGINGFGRIGRLTFRRIQNVEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 46872 - protein, 376 aa, Oryza sativa
MALLLSTSVLLVMCLLPVDPAAPPVAAIPHRRSGRHYVPFGRHAAFGPFATEVELLLHGGGAVPDIRTFRDTLDRLPDWSHFDAELGPLERYFGSDGELNVKERLLYLFPMLHRAPKDGGVSCGELEAWLRRQAADRLDAVARRELKRHDKDGDGVVTLREYLAVDHDQHIGTDNCNFSVSVCTVFVDASPRFKHVICSPQRHPTTRRRKGDWTDTEHGEPGWWLHKFISADRDHSGAMDFIELNDGMDHDRDGKLSLDEFISQFHMIDHNSIVEHSADDDTSCAEAEKKFRELDSNNDGYLTVEEARPVIQSLISGEFSYAKSHAKLLMKADDNKDNKLSLEEMLNHYLSFYNIVYMDDHYDYDDIGNNIHDELR

SEQ ID NO: 46873 - protein, 527 aa, Rhodococcus sp. RHA1
MITHERKFAISPGPGPHFRPRPVTVSRRPITPATTGAQLALSISCPTRPLERLMSTLEQPPETLQKSLKQRHLTMIAIGGVIGAGLFVGSSALLHTSGPAAFVSYAITGVVIVLVMRMLGEMATTNPSTGSFAGYARKAFGGWAGFTTGWLYWFFWVVAVGAEAVIGGKLLQRWIDLPSWVMAVVLLLAMVATNLRSVRNFGEFEYWFAGIKVAAILLFLGLGAAYVFGLWPSHSADFSNLTDHGGFTPNGWTVILSGVVVAVFSMVGPEIATIAAAESAEPEKAVAKATNSVIARIGFFYIGSVLLLAIIVPWTDVKVGQSPFVDALTHMGIPGGPDIMNAVVLVAVLSCLNSGLYTSSRMLFTLAHKGDAPQSIARLDKHGVPRNSLLLATLVGFACIGLDYLSPDTVFAFLLNASGATILMVYLMIAMSQIKLRGLMTREEVAQLRLKMWLFPYLSILAAGGILAVLVSMFYVESSRSQLSLSVGALIATLIAYRLRRRINPQNPLANNISAPAPGPITKPASK

SEQ ID NO: 46874 - protein, 184 aa, Pseudomonas stutzeri
MNIPNLLTRVRVLLIPIFILLFYLPFHWSYLAASAVFTIAAVTDWLDGYLARRLEQSTPFGAFLDPVADKLMVAVALVLLVGEHANLWLTLPAAIIIGREIVVSALREWMAELGARAQVAVSNLGKWKTAAQMVALVILLANPPALTIWVGLGYTLLIIAAGLTLWSMINYLNAAWPHLSAEKK

SEQ ID NO: 46875 - protein, 536 aa, Escherichia coli
MLAGVDGVGGIPFDNYPFAYMVSNLALAIILLDGGMRTQASSFCVALGPALSLATLGVLITSGLTGMMAGWLFNLDLIEGLLIGAIVGSTDAAAVFFLLGGKGLNERVGSTLEIESGSNDPMAVFLTITLIAMIQQHESSVSWMFVVDILQQFGLGIVIGLGGGYLLLQMINRIALPAGLYPLLALSGGILIFALTTALEGSGILAVYLCGFLLGNRPIRNRYGILQNFDGLAWLAQIAMFLVLGLLVNPSDLLPIAIPALILSAWMIFFARPLSVFAGLLPFRGFNLRERVFISWVGLRGAVPIILAVFPMMAGLENARLFFNVAFFVVLVSLLLQGTSLSWAAKKAKVVVPPVGRPVSRVGLDIHPENPWEQFVYQLSADKWCVGAALRDLHMPKETRIAALFRDNQLLHPTGSTRLREGDVLCVIGRERDLPALGKLFSQSPPVALDQRFFGDFILEASAKYADVALIYGLEDGREYRDKQQTLGEIVQQLLGAAPVVGDQVEFAGMIWTVAEKEDNEVLKIGVRVAEEEAES

SEQ ID NO: 46876 - protein, 243 aa, Acidovorax sp. JS42
MSTTHFGFQSVQEEDKARHVRGVFDSVAPKYDLMNDLMSAGLHRAWKAYTVMVANLREGDQVLDIAGGTGDLSLAFSKKVGATGRVVHTDINEAMLRVGRDRLINEGVVLPTAVCDAEHLPFPDNHFDLVSVAFGLRNMTHKDAALREMCRVLKPRGRLLVLEFSRVAKPLEKAYDWYSFQVLPRLGKLVAGDDSSYRYLAESIRMHPGQEELKSLMQQSGFGHVDYHNMTGGIVALHVGIKC

SEQ ID NO: 46877 - protein, 275 aa, Rhodopseudomonas palustris CGA009
MVMHQINPQSANVTALDPIWERVRNEAEDIVRREPELASFIFASVLHHDRLEDAVVHRVAERLDHAALSGDLIRQTYEDALRDQPDIGNAFRADMVAVFDRDPATSRFIDPLLYYKGFHAIQTHRLAHWLFGKGRKDFALYLQSRASAVFQTDINPAAKIGRGIFLDHATGLVVGETAVIDDDVSILHGVTLGGTGKEHEDRHPKIRRGVMIGAGAKILGNIEVGHCARIAAGSVVLKSVPHNMTVAGVPAKVVGEAGCAEPSRTMDQMINAIGL

SEQ ID NO: 46878 - protein, 388 aa, Zea mays
SFQIGLPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGLLFKYL

SEQ ID NO: 46879 - protein, 413 aa, Chlamydomonas reinhardtii
MKAAANFTLDENERSYFDFFSAILLFVTALGGAWLPKYLCSHGASDTLSSSSFGLAFHLGNMLSAGVMLSAGFCHLLADAHRHILFAGRFPLANFLAACGYIITLVADQVVQAVSEANAASSSVVAGGGAGEYRKLPAAELTSALARSNTDTGLTTAVHREGHHHHRGSNGSTMGSGDPEAGEMSHSRSSGALNGAVGGGGAGVSGAGGAGSSVKQPLLADLRSGAGDRDSRDDGAGRMHSVTAATKGVEDCHVGGVAVLLGAGGRKLSFATAVLLAAALCIHSILEGMALGAQVSMRSTEDIMMAIAAHKGLAAYALGASIVESGASSTRFWTVIGLFAAATPLGILMGYGLSSSANSKPGAALSALASGTFLYVAFMEVIPKELADGKNRLLKMGVFLLGYGLMSLLAVWA

SEQ ID NO: 46880 - protein, 413 aa, Plantago major
MGGYTSNEHEQKNNQIDPAASIHSGKEILLQAFNWESHKHDWWKNLEKKVPDIAKSGFTSAWLPPPTNSFAPEGYLPQNLYSLNSAYGSEHLLKALLNKMKTHKVRAMADIVINHRVGTTQGHNGMYNRYDGIPLSWNEHAVTSCTGGKGNKSTGDNFSGVPNVDHTQPFVRKDIANWLRWLRTSGFEDFRFDFARGYSPKYVKEYIESAKPIFSVGEYWDSCNYKGQYLEYNQDSHRQRVINWIDGTGQLSAAFDFTTKGILQQAVKGELWRLRDAQGKPPGVMGWWPSRAVTFLDNHDTGSTQAHWPFPSHHIMEGYAYILTHPGIPSVFYDHFYDWGTAIHDQIVKLIDIRKHQGIHSRSSIHIIEAQPNLYAANIGDKVSMKIGDGSWCPSGKEWTLATSGHRYAVWQK

SEQ ID NO: 46881 - protein, 188 aa, Triticum aestivum
  misc_feature (93)..(93): Xaa can be any naturally occurring amino acid
MKEATASGGGAAAGPNDPRQPGTARPYAPPKLSSQDLPVDYAGFLAVVFGVYFRPLVVLVLVGVMLHYKVCSWIAIIFCAQSLANMKNFENDXLKQLSMAFMFAVMGLVTNYFGPRPGAGKALANPAHHGAVGILGNIPEFFESGPAFKCPPPPSGWGPETSRIMDASSNSLAPPRSGFKKISKGPFP

SEQ ID NO: 46882 - protein, 367 aa, Methylococcus capsulatus str. Bath
MTFTSIRRHRPPIHTLPNQVSPIRFIPEWEKQSAVLIAWPPGHGDFAPWLDQVEQTYAAIAAALSQRETLLIACLDAAHERRIGDILANTGADKNRIVFIRIPYDDIWVRDTAPLSRLHEGRPELLDFRFNGWGGKYECSDDAALAARLVATGIFGRTPRVQVDFVLEGGSVETDGLGTVLTTSRCLLNPNRNPGYSRAEIEDCLARTLGADRILWLDHGQAEGDDTDAHVDTLARFCSEHTIAYTACDDTSDPHHAPLKAMEGQLQDLKQRDGRPYTLVPLPIPKPIRNEQGQRLPATYANFLIVNDAVLVPVYADPADSVAIERLAPCFPDREIVPIHCTPLIRQYGSLHCMSMQFPEAVGVSRP

SEQ ID NO: 46883 - protein, 1673 aa, Ustilago maydis 521
MAAATAAILPPATDFVNMDHRSADSHRMSPASFADASLANGRPLRSAKSVPSPSTPTSPFRLRGTPHSPSIPHRRVYNIDDESITSTSHSFASETRSSDASITPSQSASNVSAPASPRSYAHLALPLPPSSPGSPSRPLAHKKSAERRRKATRNQHLTNLEVASLSTPELHLASDPMLDTQEPSFLRKLVRGSRAHSNDAVSSAGSEGQTQASSHTDNASSRLGVSPGLAYSSFAAAMSAVDACEDSSQPDANPQVHCFRKKSTSTLRSADSEVSRASWSILNTSTDTLSPPKDINVRSSPTKSEPKSSAGTWFRRHRQQSDPSRKLNQNFDASGANSSTQVSVQRSQMSDATVGSGTTLLSQSNYTGLSSATTASFDLSELASPQAALESIRKARSFMIRELGRIAEPGDASDKPRISALVSQASLEVHDLHSEASSFWHSIADGVLLCLLANRLRPGSVDRIDRRDLEWVKSNNISRFLRAARDHLGLRSKDLFQTFDLTDSTVGGLLRVVHTLQATEKMARRSSKVTAARANAIKIEPRTTSMTPPTTPRAQDRKMLPVGNGDLECIENSSELFLNDDTPKRAVLSIQQNRREAERILIGKSDSSRYTSTSFDAKRRSIELGHPKPKGSSITFADSVKQNSYSADDDNRLPYRDRKLSESVISLTGVAEEPEDGVVTNDDSLPTAESFSTSSTPSVSMELSQVRRGSSESDKSTKSFAVKPPLLARSTSQKRISQELALGQLPRAVIGSTENLDDYLFISGSPTRHAPTRRHSARLYAGPSLLNPSRESLLNLGSQANGESDALASSRVPFPRGANDSPGARRMARHLSMNAGVSDTISTASGPSTAIATNGSSSSSKVSSRPHFRHMRYSSDLHLPSMSRPTSVGGRSPDPSVDERSYISTSRSRFDSEIGSIYTNTLGSLPTDESGSTTTRASRDATGPKHKIVVAEEGKPSVTYQLGNCIGRGQFGSVYRALNLNSGRMVAVKRIKLEGRTDEEINDLMGEVDLLKSLTHPSVVKYEGLVRGPDVVSIILEFVENGSLLHTLKAFGNFPEKLVASYVVKILEGLNYLHGQNVVHCDLKAANILTTKQGNVKLSDFGVSLNLKAVKKMGNKNDAIGTPNWMAPEVIELKGVTTAADIWSLGCTIIELLTGKPPYYDMLAMSAMFRIVEDDCPPIPEKCSDALRDLLMQCFNKDPAKRPSAEMLFEHEWMQQVWSGHKDLRELRPQDSVPFLRRISADARRLDPRIFEEDERAVQPAMERSTSSPAPTLQRPGLEALRANTSPAESLAAVATEMANGVSPTTSPAVHSNPLPSVDTSSKNQAQSPALTPANPTVFLPAGETSMLDLGLMAEEEAKPHAFVKSTFSKAVVCKICREPVKKHAVLCEECGLVCHARCAVHAPSPCNLRAQLLLFQQRASMDQTSPMSSAAQLAPVSPMLAGGAPNAAVPINFRFPFGMKRQSKSPTADSQPQLGLVASASSETEVRGSPSPPTGNGVTAAKPAKDQAAVRKRRISLIPGRQRSPSPPPAETPEAMRSPYGNGALHGTRRHSSMSYGSISGASSISSAGGILLGHSSSRGSSAQQHQAQQAHPHASTPVLPVEQLHARPSKERFRRRLSSGVVTSGARAEALSAKHTTKGGVSTGQVTPTPRSAIERQKSRRSSSKADCTIM

SEQ ID NO: 46884 - protein, 329 aa, Triticum aestivum
MASRAATMVVLLLAAVAATATCAQAQLHEKFYSESCPSVEDVVRREMVRALSLAPSLAGPLLRMHFHDCFVRGCDGSVLLDSANKTAEKDALPNQTLRGFGFIERVKAAVEKACPDTVSCADLLAIIARDAVWLSKGPFWEVLLGRRDGSVSISNDTDALPPPTANFTVLTQNFAAVNLDAKDLVVLSAAHTIGTSHCFSFSDRLYNFTGMENASDIDPSLEPQYMMKLKSKCASLNDNTTLVEMDPGSFKTFDTDYFKLVSKRRGLFHSDGALLTDPFTRAYVQRHATGAFKDEFFADFAVSMVKMGNNQVLTGSQGEIRKKCSVANH

SEQ ID NO: 46885 - protein, 209 aa, Oryza sativa Indica Group
MEKEGGVKAAAEAEAEAEGEIVAAPAEKVACFKKTAGEEADATFMERVKDYYNQLKESSAEKHWICIKDKFRAAGEYVSQKSSSVFGKKKVEPVVKDAAVPGEASSVTVESQLRMESIKTQSQGSASSVPKNPAMSSCRKKKSDDATFLEDLKDHIDEFIHASMDEHKHCFKNTIQKMFGMSKVVAERSAEAKEAEVESALPLQTSVSQ

SEQ ID NO: 46886 - protein, 413 aa, Arabidopsis thaliana
MTLTISDLPRDLKKKIFSRIPLRYVRALRLTCKEWETLIKSRSLKIDEEESQMVALMDYNLCLMSKSFNGGDPSTEIKGKLTCFDEQVKVSMLFHCEGLLLCILKDDNTKVVVWNPYLGQRRFIQVRFSHIPGGWDQFSYALGYYKNNNMMKSFKLLRFFDYFYTSNDFVFYEIYDFDSGLWKTLDVTPYWRIRFFDDIGVSLKGNTYWCAKERKPEWNADPFIIVDHIICFDFTSERFGPLVPLPFRAMKESLVTLSCVREEKLAALFCRDVVVEVWITTTIEFDKVSWSKFLTFGVRDCPMIYSCTGSFFIDEVNKVAVIFGQPLKRDKVFIIGEAGQVRDVDLGEPAHQDSWLYVCPYVPSLVKIKQPPGCKRRRQSSSENRRYKRNMMRLVELEKYHIAMEPKRGDKTI

SEQ ID NO: 46887 - protein, 483 aa, Corynebacterium glutamicum ATCC 13032
MTTALEEQNAQQAATAGRVVRVIGAVVDVEFPRGELPALYNALTVEVTLESVKKTVVLEVAQHLGDNLIRTIAMAPTDGLVRGAAVTDTARPISVPVGDVVKGHVFNALGDCLDDVSLNNNPEIERWGIHREPPSFDQLEGKTEILETGIKVIDLLTPYVKGGKIGLFGGAGVGKTVLIQEMITRIAREFSGTSVFAGVGERTREGTDLFLEMEEMGVLQDTALVFGQMDEPPGVRMRVALSGLTMAEYFRDVQNQDVLLFIDNIFRFTQAGSEVSTLLGRMPSAVGYQPTLADEMGVLQERITSTKGRSITSLQAVYVPADDYTDPAPATTFAHLDATTELDRSIASKGIYPAVNPLTSTSRILEPAIVGERHYEVSQRVIGILQKNKELQDIIAILGMDELSEEDKITVARARRIERFLGQNFFVAEKFTGLPGSYVPLTDTVDAFERICNGDFDHYPDQAFNGLGGLDDVEAAYKKLTGK

SEQ ID NO: 46888 - protein, 425 aa, Burkholderia mallei ATCC 23344
MHTVTLKPSKDKSLLRRHPWVYANAIDRVDGKPAPGATVIVRAHDGRFLARATYSPHSQIRLRVWSFDENEPIDHAFFKRRVQRALAHRRAMISGTDAVRLVFGEADGLPGLIVDYYVAARGAAHTGDAAARAAEGGAAAPVAPGDGEGRGQLVCQFMAAGVEHWKGAIVAAIVAATGCPNVYERSDVSIREKEGLEQTTGVLAGDAPPDTLIANENGVLYHVDVRNGHKTGFYVDQRENRALVAQYARDRDVLNCFCYTGGFSLAALKGGAKRVVSIDSSGDALALAQRNVAANGFDAARAQWLDADAFKTLRRLVDEGERFDLIVLDPPKFAPTRDSVDRAARAYKDVNLSGLKLLRPGGLLFTYSCSGAIDMDLFQKIVAGAAADAKVDARILKRLGAGVDHPLLTAFPEGEYLKGLLLQIA

SEQ ID NO: 46889 - protein, 309 aa, Methanopyrus kandleri AV19
MILVTGGAGFIGSHVVEELVDRGHDVVVLDNFSVGCEENLREVRDDIEIVRADVTDPRAVERTFREYRPEAVIHLAAQVNVRYSMESPFVDARINALGTLNLVSLAAEHDVERFVYASSGGAVYGEPEYLPVDEEHPTRPISNYGVSKLAGEYYVRVYAERDGFEYVILRYANVYGPRQDPRGEAGVIPIFLLRAARGEPLTIFGDGEQTRDFVFVEDVARVTAEAVERGDGVYNIGTGRETSVNDIVNAVKAVTGVDVEVVYEDPRPGEVRRIYLDPSRAREELGFEPRVDLEEGIERTWEWIRRKIA

SEQ ID NO: 46890 - protein, 373 aa, Campylobacter jejuni RM1221
MEISYYEILEITQNADKETIKKAYRKMALKYHPDRNQGDKEAEDKFKLVNEAYEVLSNDEKRAIYDRYGKDALKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKNSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRIGNQIVQISIKFPTSLNDEQKELLEKLSESFGIKDGMHQEQKGLFEKIANWFKS

SEQ ID NO: 46891 - protein, 422 aa, Yersinia pestis CO92
MTPSDLVFDQQHIWHPYTSMTEPLPCYPVVGAEGVELQLADGRRLIDGMSSWWAAIHGYNHPVLNFAAHQQLDKMSHVMFGGITHPPAVKLCRQLVAMTPPPLECVFLADSGSVSVEVALKMALQYWQAKGERRQRILTLRHGYHGDTFGAMSVCDPQNSMHSLYQGYLAENLFANAPQCGFDDPWDPQDIANFVALITQHANEIAAVILEPVVQGAGGMRIYHPSYLREVRALCDKHQILLIADEIATGFGRTGKLFACEHAQIVPDILCLGKALTGGYLTLSATLTTRAVAETISKGDAGCFMHGPTFMANPLACAVASANLSLLAENSWQQQVSKIEDQLKRELLPLAQEDTVADVRVLGAIGVVEMKKPVNVARLQRSFVEQGVWIRPFGKLIYLMPPYIISQHALTRLTAAVVDRGS

SEQ ID NO: 46892 - protein, 359 aa, Methanopyrus kandleri AV19
MIRLLEYQAKHLLKEAGVPIPEGDVARTSADAARIAAELGGPVAVKAQVPVGARGKAGGILFADDPEGARKAARKLLGSRIRGETVRKVLVEEKLDIAEEWYVSITLDRAKRRPVLLVSREGGVDIEEVPDEKIARRYLDPILGLRPFEAREAILEAGIPKEHLRDVEEVITSMYEVFESYDAHLVEINPLVLTENGEVVAADAVVNLDEDAANIRHPEFAEETRDFPFVELDGDIGIIANGAGLTMATIDLVKDLGGKPANFLDVGGGAYPTLIRRAILTVAELDVKVILLNIFGGITRCDEVAEGIVQALDDVDVPLVVRLVGTNEEEGHRILREHGVDVYTELKEAVERAVELAGA

SEQ ID NO: 46893 - protein, 1124 aa, Arabidopsis thaliana
MNSPASDETAPRRNRRKVSRKNYDENAMDELIEKQLGGKAKKKYRTKQDLEKETETEALIALSVGFPIDELLEEEIRAGVVRELGGKEQNDYIVVRNHIVARWRGNVGIWLLKDQIRETVSSDFEHLISAAYDFLLFNGYINFGVSPLFAPYIPEEGTEGSVIVVGAGLAGLAAARQLLSFGFKVLVLEGRSRPGGRVYTQKMGGKDRFAAVELGGSVITGLHANPLGVLARQLSIPLHKVRDNCPLYNSEGVLVDKVADSNVEFGFNKLLDKVTEVREMMEGAAKKISLGEVLETLRVLYGVAKDSEERKLFDWHLANLEYANAGCLSNLSAAYWDQDDPYEMGGDHCFLAGGNWRLINALAEGLPIIYGKSVDTIKYGDGGVEVISGSQIFQADMILCTVPLGVLKKRSIKFEPELPRRKQAAIDRLGFGLLNKVAMLFPSVFWGDELDTFGCLNESSINRGEFFLFYAYHTVSGGPALVALVAGEAAQRFECTEPSVLLHRVLKKLRGIYGPKGVVVPDPIQTVCTRWGSDPLSYGSYSHVRVGSSGVDYDILAESVSNRLFFAGEATTRQHPATMHGAYLSGLREASKILHVANYLRSNLKKPVQRYSGVNINVLEDMFKRPDIAIGKLSFVFNPLTDDPKSFGLVRVCFDNFEEDPTNRLQLYTILSREQANKIKELDENSNESKLSCLMNTLGLKLMGANSVLDTGEQPFLRTSTPKLLKLERMTTMGDLPGDLVEEILSRVPLTSLRAIRSTCQKWNSLSKSQICGRKATAAENKFLGFMMKDSRVCSMKFDLQGIRNDDGELVEPSIKQVSKLDQIEVSQVFHCDGLVLCIIKDNTGLLVWNPYLGQTRWIHPRNNYQIEDRYALGYDNNRNHKILRIFDLYPSSNRVFGYEVYDFSSNSWKVLDVIPEWDIQSHFRGASLKGNAYFPAQKKETVGGIKTINIEDVLLCFDFTRERFGPPLPLPFHSYNADFFVSLACVREEQLAVLYQRWGAFETIEICVTNKIDPNTVSWSKFLITSTGFPVDTFSGSFFIDEEKKVAVVFDLDRYKPTETCRYQIVYIIGQDEYFKSVNMGVAPNIAKNSYQAYCVPLVCSSSYVPSLVQLQINKPGKRKESN

SEQ ID NO: 46894 - protein, 174 aa, Thermococcus kodakarensis KOD1
MADKQIERTLIILKPDAVVRGLMGEIISRFEKRGLKIVGMKMIWIDRKLAEKHYAEHKGKPFFEPLIDYITKAPSVVMVVEGRYAISVVRKMAGATDPKDAEPGSIRGDYGLDVGDAIYNVIHASDSPESAEREINLYFKPEELFEYCKAADWFYHTHARSKKEYLDSMDCLER

SEQ ID NO: 46895 - protein, 311 aa, Listeria monocytogenes EGD-e
MAGKMKLFSVTSERPLATKIADYLDIPLCEVELQKFSDGEVKINIEESIRGTNAYVVQSMNSNVNERLMELLIMVDALKRASVHSINIIMPYYGYARQDRKARSREPITAKLMANLIQRAGANRLITVDLHAAQIQGFFNIPIDHLSAIPLIGDYLIENYGEKDVVVVAPDHSGVVRARRIADRLNAPIAILNRKPRPHEDEIMSVIGDVKGKVAIVVDDIIDTGVRATTSADILLEKGAVEVIACATHSVMAGNATERLQNSNIKEVITSDSIDLPEDKQFDKLTTISIGRILGRAIEGVQENRSLHPLF

SEQ ID NO: 46896 - protein, 116 aa, Prochlorococcus marinus str. MIT 9211
MSLVDWNYLPTGIMVEATGSSPGGATVIEKQSELVRKRSPRYKVLLHNDPVNSMDYVVTTLRQVVPQLSEQDALAVMLEAHNTGVGLVIVCDLEPAEFYSESLKAKGLSSTIEKET

SEQ ID NO: 46897 - protein, 172 aa, Triticum aestivum
MAAAGDAGEKKMVTLKSSDGEEFEVEEAVAMESQTIRHMIEDDCADNGIPLPNVTSKILSKVIEYCNKHVQAKPADAAAAGAAAPDAAAPPAEDLKNWDAEFVKVDQATLFDLILAANFLNIKGLLDLTCQTVADMIKGKTPEEIRKTFNIKNDFTPEEEEEIRRENQWAFE

SEQ ID NO: 46898 - protein, 408 aa, Prochlorococcus marinus str. MIT 9211
MVQINGSYLKLKAGYLFPEISRRVNDFSTANPKADLIRLGIGDVTEPLPKACCNAMQLAIEEMSTEAGFHGYGPEQGYSWLREAIAKFAYQARNCEITPEEIFVSDGSKCDSSNILDILGDNNRIAVTDPVYPVYVDSNVMVGRTGLAEKSGRYQGLSYIPMNAENGFEAEIPSEHFDLIYLCFPNNPTGSVATKEQLMRWVEYAKNHDALILFDAAYEAFIQDPELPHSIYEIDGARDCAIEFRSFSKNAGFTGTRCAFTVIPKCLRGRSPSNDEVDLWSLWNRRQSTKFNGVSYIVQRGAEAVYSPEGQSQVSDLISFYMDNAQIIRSQLSSIGLQVYGGQNAPYAWIKTPEGMDSWAFFDYLLQKANVVGTPGSGFGSSGEGYFRLSAFNSRNKVNEAMRRITSI

SEQ ID NO: 46899 - protein, 749 aa, Thermosynechococcus elongatus BP-1
MTEDFRLVIDLSVVLGAAAVGGLLAALLRQPILLGYLLAGMLVGPTGLGLLKEVPQVEGLAQLGVAFLLFALGVSFSLGEIRKVQGVSLGGSALQILLTIAVTTLIAVGVGWVSSPNQGIFLGAVLSLSSTAVVLRSLMDRNELESIQGQIMLGILVVQDLAVGLMIAVLPALNKPPEELGLALGQAVLTIALIALGAIAAGMWLLPPLLRLLAKTESREIFLLGVVALCLGIALLTQYLGLSIEIGAFIAGLMISEVEYADQTLDYVESIRDIFTTLFFASIGMLIDPVFLWEHLDRIIELVSLVILGKFLITTPIVKFFGYSWKTSLLVGIGLAQIGEFSFVLLTAGRGLGLVSQQVYLLTLGTTAVTLLVTPFLLKLVPVLLELPLLRRLLKEDEILDMDLTGLPKRNHVIVCGYGRVGKSVVKLLQKQNYPVLVIEQSETVINEVRDAQLPYIYGNAASQTILAKAGVDQALGMAIALSDSMSTRLCLKRALEFAPELDVIVRANSDRDIELLYQLGAREVVQPEFEASLELAAHLFFSLGMGERHIQQQVQQVRDSHYANLRGDALPEGTARLLRQAAQDMNSRWLSVPEDSPIRGMSLAEIQLRQLTGVTLLAIVRADGTEVDYPSGQTRLQGGDRLLIVGEPAEFEACEALIHGRVSVPQGETFFLWILLPQEIGEKHCTIADLHLPETVTIRALRREGTLLSEPSSDCPLMAGDRLLLTGPMDALRRIGDQLQARSTPLPP

SEQ ID NO: 46900 - protein, 471 aa, Coprinopsis cinerea okayama7#130
MEDAHATVLDLDEGKEDSNAFFAVYDGHGGSTVAKFAGANVHKRLVNEESYKAGDYETALKRAFLGTDEDLLANPGHTRDPSGCTAVAALITTDGKIYVANAGDSRSVIGIKGEVKPLSFDHKPTSERNLALSRALGDFEFKKNYALPPEKQIITADPDVTVHEITEEDEFLVVACDGKCFIHSDQVVDFVRYQVSQGKELQEIGEMICDHCLAPDTSSGAGIGCDNMTVLIVAITHGRTKEEWYKWITDRVNSNYGYATPSQPPQLYAASRIASFRARQEAQQARDRLNSQGLNEPAFPMETDDFLRRYGLTVSTFGGGISFRPGGNIMGDSGTLMFTNDDSDEDDSEDEGVGSRSFFTETLGLGRSQSPDATKNLKAQLEEFEKSIDVDEDGDAQMSDPEDDNSKSSSEESTKTLQGEAPPPPKALPNGDSSSIAVPVKQLEPLPAGDKPEPVSNVEGLLDKSEEPLKG

SEQ ID NO: 46901 - protein, 474 aa, Blastocladiella emersonii
MSPAAQLAKAAARSTCMTRLPSGIRVATAPSNSHFAAVGVYVDAGPIYETSIDRGVSHFVSSLAFKSTHGATESQVLKTMAGLGGNLFCTATRESILYQGSVLHHDLPRTVQLLADTTLRPALTEEEIAERRATIAFEAEDLHSRPDAFIGEMMHAVAFGGRGLGNSIFCEPQRARNMTSDTIREYFATYLHPSRMVVAGTGVAHAELVDLVSKAFVPSSTRAPSSVTHSDIETAYVGGSHQLVIPKPPPTHPNYEQTLTHVQVAFPVPPFTHPDMFPVSTLQVLMGGGGAFSAGGPGKGMYSRLYTNVLNRYRWMESCAAFQHAYSSTSLFGISASCVPSFNPHLCNVLAGEFVHMARNLSDEEVARAKNQLKSSLLMNLESQVITVEDIGRQVLAQNQRLEPLELVNNISAVTRDDLVRVAEALVAKPPTMVAVGEDLTKLTDIKETLAAFNASGEALQPVGSAGSFGRVTM

SEQ ID NO: 46902 - protein, 125 aa, Thermococcus kodakarensis KOD1
MKMAKPSYVKFEVPQELAEKALEAVEIARDTGRIRKGTNETTKAVERGQAKLVIIAEDVDPEEIVAHLPPLCEEKEIPYVYVPSKKELGAAAGLEVPAASVAIIEPGKARELVEDIAMKVKELMK

SEQ ID NO: 46903 - protein, 161 aa, Zea mays
MTSSSSPSRKALSKIACNRLQKELAEWQLSPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPVDNDRYVRNCRNGRSPKETRWWFHDDTV

SEQ ID NO: 46904 - protein, 509 aa, Thermosynechococcus elongatus BP-1
MVTLFENPLRVGLRQERTPEPLILVIFGASGDLTQRKLIPSIYQLRLERRLPPELTIVGVARRNWSHDYFRKHLRQGVEEFGGGIQAEPLWQEFAQGLFYCSGNIDDPAAYTQLKTLLAELDEKRQTRSNRVFYLAVSPSFFVEAIQQLGAAGLLSDPQKHRLVIEKPFGRDLTSAQALNEVVQSVCKEEQVYRIDHYLGKETVQNLMVFRFANAIFEPLWNRQYVDHVQITVAETVGVEDRAGYYETAGALRDMVQNHILQLLALTAMEPPNALDADSLRSEKVKVLQATRLADLDNLDACAVRGQYRAGWMKGKPVVGYRQEPGVSPTSTTPTYAALKLGIDNWRWQGVPFYVRTGKRLAKKVTEISIQFRGVPLLIFQSAARQTNPNILTMRIQPNEGIALRFEAKMPGADLRTRTVEMDFSYGSSFGMATADAYARLLLDCMLGDQTLFTRADEVEAAWRVVMPVLTAWDAPTDPEAIPTYDAGTWGPDAAEVMINADGRRWRRL

SEQ ID NO: 46905 - protein, 348 aa, Thermosynechococcus elongatus BP-1
MTDYAAHQQALDRDCLTLSRHVLQQLQSFDAAAQDLSALMNRIALAGKLIARRLSRAGLMEGVLGFTGAVNIQGEDVKKMDVYANEVFIAAFKQSGLVCRLASEEMAQPYYIPENCPIGRYTLLYDPLDGSSNVDINLNVGSIFAIRQQEGTDLDSTAADLLQDGHQQIAAGYILYGPSTMLVYSLGKGTHVFVLDPSLGEFILAIENLQIPASGAIYSVNEGNFWAWEEPIRNYVRHVHRQPGYSARYSGALVADIHRILMEGGVFLYPGTQKNPAGKLRLLYEAAPIAFLVEQAGGKASTGTQPLLDVVPDHLHMRTPLIVGSPENVALVESFIQQTPAQPTVTQV

SEQ ID NO: 46906 - protein, 281 aa, Prochlorococcus marinus str. MIT 9211
MPTKVAYLGPRGTYAEKAAYALVKLDKLSEATLLPCSGIRSVIENVATKHCEAAVVPIENSVEGGVTETLDALWGHPNLFIKSAVVIPIRHALIGSGSLEEISEVLSHPQALAQCSGWLNQNLPNCLQLPTSSTSEAVRMVQGSKFRAAIGSTKAALEINGLSKLAYPINDVQGNCTRFVLLQNNESNQEGDIASFAFSLHSNKPGSLLKALNCIASLGLNMSRIESRPSKRELGEYIFFIDIDLKDKLIDTNKKLKRLLEPLCENIVYFGSYKNEEFEID

SEQ ID NO: 46907 - protein, 181 aa, Zea mays
MTSVWKTKVLPGLNRSFDKDDKVAEAYEASPPEVKALFKDKKPVKVSKKNSAAVTKFLDELAKIDFPGAKVVSEAVAKSGTSPLLTAITFILDKVAPFIPKEEPKAEPAAEATSREVAVEEKKEEAEPAAATEAAPAPAETPSEAAVVEEKKEEEKKEEEDKPAAEEAAPPAEAAAAAEEK

SEQ ID NO: 46908 - protein, 372 aa, Coprinopsis cinerea okayama7#130
MQKCQASGSSDIEASEGNSGSDADHFPNVLGSVSISSGDRRKGTHSSSSDSHASTTSSFLAEYFPTRFFILKSLSEDDLALSVKNGLWATQKHNELLLDQAFRTAKDVFLIFSVNKSGEFYGYARMIGPIRRGEGTVTWASRSDGSFPSPSGSTTSPRANRFKANTDTKLLSGSPQPKMFFSPDGGHVVDESPLQLDDLDDSPPPSSSETPLPPRLLQQQSAPPKIGGGFDGDEGPQRTPSLKFSLDHHQRKKFDPPREAFELDPEAPIRAVRAGMHDPPGPQHRDGKAKSREVEEPKFDRQQDGEAPSTPGWGECFKIEWLELRRIPFHQTRHLRNPWNKGREIKISRDGTELEPTIGKKLLDEWGTLAEA

SEQ ID NO: 46909 - protein, 219 aa, Vitis vinifera
MGQQSLIYSFVARGTVILAEFTEFSGNFTSIAAQCLQKLPATNNKFTYNCDGHTFNYLVEDGYTYCVVAVEAVGRQIPIAFLERVKEDFTKRYGGGKAATAVANSLNKEFGPKLKEQMQYCVDHPEEISKLAKVKAQVSEVKGVMMENIEKVLDRGEKIELLVDKTENLRSQAQDFRQQGTKMRRKMWLQNMKIKLIVLGILIALILIIVLSICGGFNC

SEQ ID NO: 46910 - protein, 413 aa, Pseudoalteromonas tunicata D2
MGFAALGLNQQLVQALTECGYDTPTPIQTAAIGEILQGKDVMAGAQTGTGKTAAFALPILQRLAEQPERKGQLRTLVLTPTRELAQQVFASFEKYGQHSELTAALAYGGVSIGEQIKAIKAGVDIMVATPGRLLDHLVKGTVNLSNVQYLVFDEADRMLDMGFIDEINNILRRLPKERQTLLFSATFDDAIFKLSKKLLNQPVLIEVNQRNQAASEVEQIVYAVDADRKRELISHLIGAKNWQQVLVFTRTKQTADELAKEMCKDGLKTQAIHGDKSQGARDKALSEFKEGKTRVLVATDVAARGIDIQQLQYVINYELPYIAEDYIHRIGRTGRAGEKGLAISLLSIDENWLLEEIEAVLDKRLPQQWLPGYEPDLTKEPVDKRKNGKVAEKRRAKKRLSGQKTGNRAQRKR

SEQ ID NO: 46911 - protein, 331 aa, Glycine max
DSVRKMADKSARDMISPSGGVHIILPDYYSPEGMGLIVPKTKDGRVVFMLPWLGRTVAGTTDSNTSITFLPEPHEDEIQFILDAISDYLNVKVRRTDVLSAWSGIRPLAMDPTAKNTESISRDHVVFEDHPGLVTITGGKWTTYRSMAEDAVNSAIKSGKLTPANGCITNNIRIVGGEGWDPVSFTILSQQYMRMKVTYRGKVVPGVMDTASAKHLSHAYGTLAERVAAIAQNENLGKRLAHGYPFLEAEVAYCARHEYCESAIDFIARRSRLAFLDTDAAGRALPRVIQILAAEHKWDKSRQKEEMFKAKEFLETFKSSRNAQFYDGKHN

SEQ ID NO: 46912 - protein, 293 aa, Campylobacter jejuni
MHNILFGNILNRSATMKGIILAGGSGTRLYPSTLTLCKQLLPIYDKPMIYYPMSVLMLAKIKEVLIISTPKDIDRFKELFKDGSFLGMQIQYKIQERPEGLAQGLILAQDFIQNDDIALILGDNIFYGQGFSDILENAKDDLKKGFASIFSYHVKDPERFGVVEMDQNGNVLSLEEKPKNPKSNYVATGLYFYNNDAIDIAKNIKPSARGELEITDVNIEYLRLNKLKSQHLGRGFAWIDTGTHDSLIEANSFVQTIELRQGYKIACLEEIAYNNNWIDNETLEKRALLLSKK

SEQ ID NO: 46913 - protein, 377 aa, Methylococcus capsulatus str. Bath
MAKEDYYETLGVPRNASDSDIKKAFRRLAMKYHPDRNKDNPEAEERFKSVKEAYDVLSDPKKRSAYDQFGHAGIDPSMGGGGGFGFTGDSFSDIFGDVFGDIFGGGGRRRGRGQRGSDLRYNLELTLEEAVAGTEAKIKVPTWVTCTECGGSGAKKGSAPVTCPTCHGQGAVRMQQGFFSVQQTCPTCRGTGQHISDPCRVCYGQGRVQETKTLSVKIPPGVDTGDRIRLSGEGEAGEGGGPPGDLYVHIGVKQHPIFTRDGADLYCEVPIGFPTACLGGELEVPTLDGKVVLKIPAETQTGRLFRVRGKGVKPVRGGVAGDLLCRVRVETPVHLNKEQIDLIRQLDESLRGGGSHHSPQAHGWLDGVKQFFDRLGL

SEQ ID NO: 46914 - protein, 397 aa, Oryza sativa
  misc_feature (277)..(277): Xaa can be any naturally occurring amino acid
IRSLKPPANQPNPKDAKNFGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSXIPPLSVVGLSEQQALEEAKSDVLVCTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 46915 - protein, 378 aa, Methylococcus capsulatus str. Bath
MKTPALLALDDGTVFRGYAIGAEGASVGEVVFNTSITGYQEILTDPSYARQIVALTYPHIGNTGINEEDTESTGIFASGLVIRDLPLRASNWRCERRLDEYLRQRGVVGIAGLDTRRLTRILRDKGAQRGCIAAGNGLDADAAVAMARGFPGLQGMDLAQVVTTPQRYEWTEGSWRFGAEPVQSGQGGFHVVAYDFGVKRNILRLLADRGCRVTVVPARTPAAEALALKPDGLFLSNGPGDPEPCDYAVAAIREFLDTGIPVFGICLGHQLLALAAGARTSKMKFGHHGANHPVQDLSTGRVVITSQNHGFAVEEASLPANVRPTHRSLFDGSLQGIEFTDRSAFSFQGHPEASPGPHDLCDLFDRFVGAMRAARNRH

SEQ ID NO: 46916 - protein, 139 aa, Leifsonia xyli subsp. xyli str. CTCB07
MDAGKGEYQIAKSDEEWRRELTPEQYGVLRQAGTEQPWTGELLDESRAGVYACAACGAELFRSGTKFDSGCGWPSFYESVRPEAVELLEDTRLGITRTEVRCANCGSHLGHVFPDGFRTPTGDRYCMNSISLDFQPEDE

SEQ ID NO: 46917 - protein, 395 aa, Desulfitobacterium hafniense DCB-2
MMNKKGLKDIAVQGKRVFVRVDFNVPMDDHGNITNDTRIRAALPTIHYLIDEGAKIILASHLGRPKGKPDPNYSLAPVAKRLGELLKRPVAMATDCIGPEVEKAAAQLQEGEVLLLENVRYHAEEEKNEPEFVKQLARLAEVYVNDAFGTAHRAHASTEGIAHHLPGVAGFLLQKEIESMGKALENPERPFVAIIGGAKVSDKIGVIENLLHKVDALIIGGGMANTFLKAQGYSLGKSLVEGDKLSLAQEILEQGRELQVDILLPQDVVAAKEFKADAPYRVTPVREIAEDEMALDIGPESAGLFSARIQKARTIVWNGPMGVFEMEQFAKGTEKVAQAVALCPGLTIVGGGDSVAAVEKMGVGEQMSHISTGGGASLKLLEGKTLPGIAALQNI

SEQ ID NO: 46918 - protein, 255 aa, Desulfitobacterium hafniense DCB-2
MAKRHPIIAGNWKMNKSLRETQEYAVKLLGVLGEVTAIDVVVCAPFTALNVLKNELEESVIHIGAQDMFYAPDGAYTGEISAAMLVDVACTYVILGHSERREILRETDEEIAKKVKAALKAGLTPILCVGENLANREEGKAFAIVRGQVEKDLTDLAPDDLKRVVIAYEPIWAIGTGKTASSEDAQEMCAMIRSTLAGIAGVVADEVNILYGGSVKADNIGELMSQPDVDGALVGGASLEAEGFAQLVQNAVAVL

SEQ ID NO: 46919 - protein, 511 aa, Desulfitobacterium hafniense DCB-2
MKPLLLMILDGWGYNPQSAGNAVAKAPKPHFDRLLEEYPHTLIVASGEEVGLPPGQMGNSEVGHLNIGAGRVVYQEFTRISQAIRTGEFARNTVLQEAMERVKDGPNALHLMGLLSDGGVHSHSEHLFALLAMAKTMGVKKVFIHALLDGRDVLPQSAKGFMTQLNSKCRELGLGQVATVSGRYYMMDRDKRWERVEKGYRALVNGEGLKAPNSLAAIEQSYDVRVTDEFVAPTVIVDSAGEAVGPLRDGDSFIFFNFRSDRAREISYALLDEEFTGFDRGRPLQLHYVCMTEYDDKLKGAAVAFPAQNLDNTLGEVLAKHQKKQLRIAETEKYAHVTFFFNGGVEEPCPGETRCLIPSPQVPTYNLLPEMSAYGITEELLKRLEREEDEVIILNFANADMVGHTGEFEATVKAIAAVDQCIGQIVPQVLERQGTVIITADHGNAEAKVDLQTGQPLTAHTTNPVPLILVNDQLKGKTLREGGALRDVAPTMLRLLEIPQPQEMTGKSLIC

SEQ ID NO: 46920 - protein, 425 aa, Desulfitobacterium hafniense DCB-2
MSYIEEIYGREILDSRGNPTVEVEVLLEDGSMGRAAVPSGASTGAFEAVELRDGDKGRFLGKGVLQAVANVNEVIAPELEGLNPFDQPAIDRELIALDGTENKGKLGANAILGVSLANAKAAAECVGLPLYQYLGGVNAKELPVPMMNILNGGQHADNNVDIQEFMIMPVGAKSFAEALQMGTEVYHSLKAVLKEKSLATAIGDEGGFAPSLESNADALLAIMDAIQRAGYTPGKDIALALDVAATELYRDGKYHLEGEGLTKTADEMIAYYEELVEKYPIVSIEDGLSEEDWEGWKKLTEKLGSKIQLVGDDLFVTNPARLARGIKEKCANSILIKLNQIGTLTETLDAIEMAKRAGYTTVISHRSGETEDVTMAHVAVAVNAGQIKTGAPARTERVAKYNELLRIEEELGETGVYPGHEALGR

SEQ ID NO: 46921 - protein, 553 aa, Listeria monocytogenes EGD-e
MFKHILLSLNGYKISYLRNDVISGVGVAALTIPVAMGYAQVAGLPPIYGLYASFLPVIAYVIFASSPQLIFGIDATASAITGSIILGTAGLAAGSKEAIALAPILAFFCAIFLVLFSVLKLGRFAKYISAPVLSGFISGLSVSIIMGQIPKIMGLKESGDSFFSSLGIIFGQFFQSNWISFAMGVVTVIIVITCKKVIPKIPMSLVVLVLGTMAAYFFKLDQYNVDIVGKIPVGFPSLALPDFGASSWALAIGGGLVCAIATFAGSLLPSESFAMRNKYTIDDNRELFAYGVSNFVAAFSGCSPASASVSRTAANEQFRGKTQMVSIVAATIIALIVAFLSGLLYYMPQPVLSGIVFAALVGIIDVDVLKGLFKVSRREATVWIVAALGTLLVGVIFGVLLGIFLSFINVVSRSMKTPIAILGVIEGRHGYFDLKRKSEAKPIPNVVIYRYSASLFFGNFNKFADGLKEAVQDDTKLVIFEASAIINIDTTATESMKDLLKWLDDKGIEYYFADLIDHLKTSFRKHDLGYLIDNGYTKKTVEDALDAYYAEHK

SEQ ID NO: 46922 - protein, 433 aa, Burkholderia vietnamiensis G4
MSANDDATFWHNATHHLIRYGGTFEPLIVERARGSFVYDADGRAILDFTSGQMSAVLGHCHPDIVAVIAEYAGKLDHLFSGMLSRPVVELATRLADLTPPGLDRALLLSTGAESNEAAIRMAKLVTGKYEIVGFAQSWHGMTGAAASATYSAGRRGVGPAAVGSFAIPAPFAYRPRFERNGAYDYLAELDYAFDLIDRQSSGNLAAFIAEPILSSGGIIELPDGYMAALKRKCDERGMLLILDEAQTGVGRTGTMFACQRDGVTPDILTLSKTLGAGLPLAAVVTSAQIEERAHALGYLFYTTHVSDPLPAAVGLRVLDVVQRDGLVQRANLMGERLRRGLLDLMERFECIGDVRGRGLLLGVEIVKDRRTKEPADGLGAKITRECMKLGLSMNIVQLPGMGGVFRIAPPLTVSEAEIDLGLSLLEQAIARAL

SEQ ID NO: 46923 - protein, 410 aa, Triticum aestivum
  misc_feature (198)..(198): Xaa can be any naturally occurring amino acid
  misc_feature (398)..(398): Xaa can be any naturally occurring amino acid
NKFVQKSRLVPVRNSRDIVDPRVRGPYISTKAGEWYPAGLGSNDFKGLYGYKVFISVSVILGDGIYNLIKIIYATIKEIMNARSKQGRLPLVRAQDDDESSELSSEEKLLNDVFVKDSIPPWLAGSGYVGLAAISTATVPMMFPQLKWYLVLSAYVVAPLLAFCNSYGTGLTDWNLASTYGKIGLFIFASWVGQHGGXVIAGLAACGVMMSIVSTAADLMQDFKTGYLTLSSPRSMFVSQLIGTALGCVIAPLTFWLYWAAFDIGNPDGMFKAPYAAIFREMSIMGVEGFSVLPQHCLAICFVFFFAAIAINLMRDVTPKSMSKFIPLPMAMAVPFYIGAYFAIDMFVGTVILFVWERVNRKESEDFAGAVASGLICGDGMWSVPSAILSIMRIDPPXMCMYIKPSLTYG

SEQ ID NO: 46924 - protein, 227 aa, Coprinopsis cinerea okayama7#130
MVSLAAQQPHQRAFNPYTENGGTILAVAGADFTVIAGDTRQSEGYNIQTRYAPKVFKLTDKAVLAVNGFAADGNMFVKKVKQRLEWYRHAHAKDMPIRSIARLIQTMLYARRFFPYYVYNILGGIEEDGTGAVYSFDPIYFKNQTPAPGTSFPQHLPLQTVLALVIDSFTGATERHIEVGDGLEMYVVLSQNSSALQSLQNVRGVQEVTATNDGERVFVIRRDLKKD

SEQ ID NO: 46925 - protein, 553 aa, Ralstonia solanacearum GMI1000
MYQYDAYDHRLVADRVAQFRDQVRRRISGELTEEEFLPLRLQNGLYMQRHAYMLRVAIPYGHLRAKQLRMLSHIAAEHDRGYGHFSTRQNIQYNWIKLEDVPDILGKLASVEMHAIQTSGNCIRNITTDQFAGVAPDEFVDPRPLAEILRQWSTFIPEFAFLPRKFKIAVSATREDRAVTQLHDIGVYAYEKDGRTLLRVLAGGGMGRTPILGAIIKEDLPWQHMLSYIEAAIRVYNRYGRRDNKYKARIKILVKAIGAEEFARQVEEEWQHIKDGPSTIPQAEFDRVAKDFAPPAYEKLADTDAAYEKALLENKAFARWVSRNVHPHRVPGYAAVTLSLKPGVALPPGDATAEQMALVADWSERFGFGELRVAHEQNLILPDVKKHDLFALWQLAKEHGMATANIGLLTDIIACPGGDFCSLANAKSIPIAQAIQARFDNLDYVHDLGEISLNISGCINSCGHHHVGNIGILGVDKADEEWYQVSLGGAQGNDSALGKVIGPSFKAEEMPDVIERIIDTFVANRIEDERFIETYNRIGMTPFKERVYAREAA

SEQ ID NO: 46926 - protein, 453 aa, Geobacter sulfurreducens PCA
MPDYDTQTLRDWDRRHIWHPFTQMKEWEESEPVVIVEGEGSWIIDSEGKRYLDGVAAIWTNVHGHCRREINEALKAQVDRLEHSTLLGLTNDRAVVLAKRLAEIAPPGLCKVFYSDNGSTAVEVGVKMAFQFWRHEGKPEKSRFISFTSAYHGDTLGAVSVGGIDLFHGVFRPLLFPTIQAPAPYCYRCPMGRDTPAACGMECLTELERIMESHAGEVAGLVIEPLVQGAGGMIVQPEGFLKGVRELCDRHDILMIADEVAVGFGRTGAMFACGREGITPDIMALSKGITAGYMPLAATLATQQVYDAFLGEYREMKTFFHGHTFTGNPLGCAVALASLDLFESDRLLGKLPNKIKLLQEKLKGLIELEHVGDVRQCGMIAAVELVRDRATKEPFDWEERVGVRVCLEARTHGVFLRPLGNVIVIFPPLAITAEEIDFLVDGLEKSIHTVTGG

SEQ ID NO: 46927 - protein, 168 aa, Zea mays
MATSEQSPSYNVFVYGSFQEPAVVSLILEFTPVIVSAQLHGFHLYRLKGRLHPCIAPFESGLVNGKVLTGLTEAQLKNLDMIQGAEYVRKTVEVVLTETSEKMEVEALIWANKDDPDMYGEWNFEEWKRLHMDKFIEASKKFIEWKKNPDSKTREEFEKFVHEDPPVT

SEQ ID NO: 46928 - protein, 469 aa, Helicobacter pylori
MKAMEGKIIQVLGPVVDVEFESYLPAIFEALDINFEVNGVQKSLVLEVAAHLGGNRVRAIAMDMTEGLVRNQAVKARGKMIEVPVGEEVLGRIFNVVGESIDNLEPLKPSLTWPIHRKAPSFEQQSTKTEMFETGIKVIDLLAPYSKGGKVGLFGGAGVGKTVIIMELIHNVAYKHNGYSVFAGVGERTREGNDLYFEMKEGGVLDKVALCYGQMNEPPGARNRIAFTGLTMAEYFRDEKGLDVLMFIDNIFRYAQSGAEMSALLGRIPSAVGYQPTLAGEMGKLQERIASTKNGSITSVQAVYVPADDLTDPAPASVFAHLDATTVLNRKIAEKGIYPAVDPLDSTSRILSPQMIGEKHYEIATGIQQVLQKYKDLQDIIAILGLDELSEEDKKTVERARKIEKFLSQPFFVAEVFTGSPGKYVTLQETLEGFGGILEGKYDHIPENAFYMVGSIQEVLEKAKNMKNS

SEQ ID NO: 46929 - protein, 490 aa, Yersinia pestis CO92
MSRYGLQKLYINGAYTDSTSGDTFDAVNPANGECIAQLQAANAQDVDKAVAAAKQGQPVWAAMTAMERSRILRRAVDILRDRNDELAAIETADTGKPLSETRSVDIVTGADVLEYYAGLIPALEGQQIPLRGSAFVYTRREPLGVVAGIGAWNYPLQIALWKSAPALAAGNAMIFKPSEVTSLTALKLAGIYTEAGLPAGVFNVLTGSGDQVGQMLTEHPGIAKVSFTGGIASGKKVMANAAGSTLKDVTMELGGKSPLIIFADADLDKAADIAMMANFYSSGQVCTNGTRVFVPQALQAAFEQKIVERVKRIHIGDPSDERTNFGPLVSFQHRDSVMRYIDSGKREGATLLIGGYSLTEGALAHGAYVAPTVFTHCRDDMQIVREEIFGPVMSILSYQSEEEVIRRANDTEYGLAAGVVTQDLNRAHRVIHQLQAGICWINTWGESAPEMPVGGYKHSGVGRENGISTLEHYTQIKSIQVELGSFNSVF

SEQ ID NO: 46930 - protein, 362 aa, Pichia angusta
MSKNIVLLPGDHVGPEVVAEAVKVLEAVSSAIGVKFNFSKHLIGGASIDAYGVPLSDEALEAAKKADAVLLGAVGGPKWGTGSVRPEQGLLKIRKELNLYANLRPCSFASDALLKLSPLKSEIVKGTDFVVVRELVGGIYFGDRKEDAGDGVASDTESYSVPEVQRITRMAAFLALQSDPPLPLWSLDKANVLASSRLWRKTVEETIKNEFPQLTVQHQLIDSAAMILVKSPTKLNGVIVTNNMFGDIISDEASVIPGSLGLLPSASLASLPDTNKAFGLYEPCHGSAPDLGPGKVNPLATILSAAMMLKLSLDLVDAGRAIEQAVKNVLDAGIMTADLGGSSSTQEVGDAVAQEVAKLLKN

SEQ ID NO: 46931 - protein, 441 aa, Physcomitrella patens subsp. patens
MRSKGLGNKIDESWKPPLGDLFCQLNDESLLNILRRLSPAPHYALVCKRWMRLHGSLRQSIKVQDWTFLESGRIRQRFPNLTDVDLSRACMVTPPAGKGSAILLTHQGLTVQLNYDAVDSPSIECCIEEQQLSPAKLDKGLKLLADTYPGLQRLCVRNTEETGIASIAKKCPLLQELDLYQCTDETLRAIADCDNLQIVRLIGSITGFYHCTFTDIGLTIMSHTFRRLVSLELSGCEASYEGISAIGKCCVMLEELTLSNKGFYEGWVAALSFLACLKTLRLEGCKQIDRNPGPYGRLGRCSTIERLHLERCDLRDRIGFAALLAVCAVVKELEFKDCWGLDDDTLALTVSCKRVRLLSLEGCSLVTTAGVDSVVQSFKDLNRFRVTFCDNIRDSELSPALCDRFLTLKEFSWRPDTKSVLNAGLAGTGVGRKGGRFFRKS

SEQ ID NO: 46932 - protein, 671 aa, Desulfitobacterium hafniense DCB-2
MDFASTPIWAVLAGLVGLAFAFYFASSVLKESPGNARMQEISLAIQEGAMAFLNRQYKTLIPFVIIIFLILTFLKGWQTAVSFLVGALLSAVAGYVGMGITTRANARTTEAARTSLNKALGVSFRAGAVMGLSVNGLGLIGVAALFLWFQDAETINSFAFGASAIALFARVGGGIYTKAADVGADLVGKVEAGIPEDDPRNPAVIADNVGDNVGDTAGMGADLFESYAATTIAAMLIGAVAFKSLGGGVSGLMLPLMIGIAGILSSIIASFFVRTGENANPQTALNKGLWGTNLLTAIASYAIVQLMITEPVHVSESLTLTANNIFIAIVCGLVVNILIGLLTEYYTSNQKAPAQAIAKASETGAATNIIQGLATGMKSTALPVVVICVATYVSFAAAGIFGIAMAAMAMLSTAGMVVAIDSFGPVADNAGGIAEMADLDPSVRKTTDKLDSVGNTTAAVAKGFAIGSAALTALALFNAYSELAHLDRIDILVPTTIIGLFIGAALPFLFSAFAMEAVGKAAFEMIGEVRRQFREIPGLMEGKAKPDYRACVDISTKAAIRQMIVPGLLAIGSPILVGFLLGKDALGGMLAGGTVSGLLMAIFMANAGGAWDNAKKYVEAGNLGGKGTPTHAAAVIGDTVGDPFKDTAGPSLNALIKVMGTISLIIAPLLI

SEQ ID NO: 46933 - protein, 481 aa, Thermococcus kodakarensis KOD1
MPRRKLIKERVPTPERPPEERIKDFKEVNLGYTFELAVKEAERCLQCPYEYAPCIKGCPVHINIPGFISKLVEYRDDPDKAVKEALNVIWACNSLPATTGRVCPQEDQCEMNCVMGKVGDKINIGKLERFVADYAREKGIDEELLFEIIPKIEKKGQKVAIIGAGPAGLTAAGELAKLGYDVTIYEALHEPGGVLMYGIPEFRLPKEIVNKEIEKLRKLGVKILTDHVVGRTVTIEELLQEYDAVFIGSGAGTPRLINAPGINLNGIYTANEFLTRVNLMKAYLFPEYDTPVYVGKKVIVIGAGNTAMDAARSARRFGAEVTIAYRRGEEDVSAREEEVEHAKEEGIKFVYFVNPVEFIGDENGRVKAVKFEKMKALDERDARGKRKIVGTGEYVTLEADTVIIAIGKHPNRLIINTPGLKVERGKIVVDENLMTSIPGVFAGGDAIRGEATVILAMGDGRKAAKAIHEYLTKKRQEKANA

SEQ ID NO: 46934 - protein, 166 aa, Glycine max
MVNFMLMITAELENLTNLQPQDGCDDPNFSYLFKLKCGRCGELSQKETCVVLNDTVPLPVGKSTTHLIQKCKFCGRDGTVTMIEGKGKPLTQEISESGKYAPLMLFDCRGYEPVDFVFGDGWKVESLEGTKFENVDLSSGEYAEYDEKGECPVMISNLRATFEVTK

SEQ ID NO: 46935 - protein, 291 aa, Chlamydia trachomatis D/UW-3/CX
MKRNDPCWCGSNKKWKHCHYPTKPERPLDNLRQLYASRYDIIIKTPEQIEKIRKACQVTAHILDALCEAAKEGVTTNELDLLSRELHKRHNAIPAPLNYGHPPFPKTICTSLNEVICHGIPNDIPLQNGDIMNIDVSCIVDGFYGDCSRMVMIGEVSEIKRKVCEASLEALNAAISILEPNLPLYEIGEVIENCAAKYGFSVVDQFVGHGVGVKFHENPFVAHHRNSCKIPLAPGMIFTIEPMINVGKKEGFIDPINHWEARTCDHQPSAQWEHAILITDSGCEVLTLLDK

SEQ ID NO: 46936 - protein, 504 aa, Sphingomonas sp. LB126
MMESTGNAAIFEQARARIARPFGHFINGLWEAGSGEPIAVVNPATEQPIGSIAAGGEAEVDRAVAAARQRFESAEWTRMPAAERERLLLRLADLVERDRDELAAIETLDNGMPFAPARMMAVGSAISAIRYNAGWARRMTGEEAPVSVPGRWHGYTSREPLGVAALIVPWNAPFAITCNKVSAALAAGCTVVLKPAELAPMSGLRLAELVQEAGFPDGCLNVVTGLGAQAGAALVRHPGVDKISFTGSTATGQSILRETAGRLTRVSLELGGKSAVLVFPDADLEKAIPAVAMGIFGNSGQVCAAGSRLFLHDSVFDRFVTGLVDFAEKLMVGPGDQPGVALGPLISAGQKERVMGYIAAGEAEGAQIATRGSAPDEPGYFVKPTIFVDTRPDMRIVREEIFGPVLSVMRFSDDNLENLARQANDSIYGLSAYVWTRDLSTAHAMARYLRAGSVKVNGSGMEFALPFGGFKQSGIGRENGPRGGGSLYRKEVGNDRLVMVWTAL

SEQ ID NO: 46937 - protein, 308 aa, Vitis vinifera
MAYQLIREWTGIQQFPLATRTKLIELLGKLKQENVNTLTILVMGKGGVGKSSTVNSILGERAVTVNAFQSEGPRPVMVSRSQAGFTLNIIDTPGLVEGGYVNDQAVEIIKRFLLDKTIDVLLYVDRLDVYRTDNLDKQVVKAITDSFGKQIWRRGVVVLTHGQLSPPDGLNYEDFFSRRSEALMRVVRLGAGIRKQDLQDFAIPVIPVENSGRCNKNESDEKILPNGTAWIPNLVKTIIDLVSNGSKAILVDKKLIEGPNPNKRGKFLIPLIVAFQYLVVKQIQRTIKDDVKKEPKAPWELRSANLKF

SEQ ID NO: 46938 - protein, 419 aa, Frankia sp. EuIK1
MIYLDHNATTPVDPRVVEVMLPLFTERFANPASKHAPGQEATRIVERARREVASLAGARPREIVFTSGATEAANLAIGGVLATAEPGRRRILVGATEHPAVLGAADAAVSAGSAVSADGTTAAERIAVHPDGTVDVDDLRRRLGPDVALVAVMAANNETGAVNDPRPLVEAARSAGRCCCADVTQALGRVPVEFERTGVDLAVSSAHKLYGPKGVGALIASKDAWSRLAPRVHGGGQERGLRAGTLNTAGIAGFGAAARIAAESMADDGTRQRALVALLTELLVKRLGPGAVELNGPVRARLPNTVNLRFVGAGADEVQACAPRVAISAGSACSGGGDEPSHVLRAMGRTATEARESLRFSLGRATTTEEIRTAADLVARAVLRVRSLSQSTPIQDEVRDDNRASSNSLNRGSAASKES

SEQ ID NO: 46939 - protein, 331 aa, Vibrio fischeri ES114
MTIKVGINGFGRIGRFVFRASVERNDIEVVGINDLIDVEYMAYMLKYDSTHGRFNGTVEVVDGNLVVNGKTVRVTAERNPEDRKWDAINVDVVAEATGLFLDDATARKHITAGAKKVVLTGPSKDATPMFVMGVNHESYAGQDIVSNASCTTNCLAPVAKVLNDKFGIESGLMTTVHATTATQKTVDGPSAKDWRGGRGASQNIIPSSTGAAKAVGVVLPELNGLLTGMAFRVPTANVSVVDLTVNLKTAASYEAICAAMKEASEGELKGVLGYTEDAVVSQDFIGEVQTSVFDAAAGVALTDKFVKVVSWYDNEIGYSNKVLDLIAHVSK

SEQ ID NO: 46940 - protein, 135 aa, Vibrio fischeri ES114
METQKTFLEYTDEEWRKKLTKEEFDICRKQGTEAPFSGTLLHNKEKGYYACTCCQTILFVSDNKYDSGCGWPSFDAPVNDQVIRYIEDNSHGMKRIEIRCRHCDSHLGHVFDDGPKTTNERYCVNSVSLNFSQDK

SEQ ID NO: 46941 - protein, 252 aa, Exiguobacterium sibiricum 255-15
MNLINKTVVLTGASSGLGEALAYELNRHGANLILVARREDRLQQMAKTLQAEYIVYDLEHSPERLADQIADRYGMIDVLINNAGFGEFSFLKDTTIETIESMNRVNVLAPIRLTKACLPLFRPHGIIVNVASQAGKLPTPKSSIYCMTKAALYQFSNALRLELKPQGLHVMTVNPGPIATEFFVRADLSRKYEKNVANIVLSKEKLARTVTRAMVREKREVNAPFWMEGSAKAYGLFPRVIEWLGKSGFDKK

SEQ ID NO: 46942 - protein, 411 aa, Vitis vinifera
MNALAATNRNFRHASRILGLDSKLEKSLLISFREIKVECTIPKDDGSLATYVGFRVQHDNARGPMKGGIRYHPEVDPDEVNALAQLMTWKTAVVDIPYGGAKGGIGCTPRDLSMSELERLTRVFTQKIHDLIGTHIDIPAPDMGTNAQTMAWIFDEYSKFHGHSPAVVTGKPIDLGGSLGREAATGQGVVFATEALLAQHGKSIKGLTFVIQGFGNVGSWVARLIHERGGKIIAVSDITGAVKNQNGLDIVDLLRHKEETGCLTNFSGGDHMDPNELLTHECDVLIPCALGGVLNKENAADVKAKFIIEAANHPTDPEADEILSKKGVVILPDIYANAGGVTVSYFEWVQNIQGFMWEEEKVNYELQKYMTKAFHNIKAMCQSHNCSLRMGAFTLGVKRVARATTLRGWEA

SEQ ID NO: 46943 - protein, 706 aa, Bradyrhizobium sp. ORS278
MSALWVIVLCGALSIVYAIWATQSVLSADAGNARMQEIAAAVAEGAQAYLRRQYTTIGIVGVVIFVLLAYFLGTLVAVGFAIGAILSGAAGFIGMNVSVRANVRTAQAATTSLAGGLELAFKAGAITGLLVAGLALLGVTIYFGVLTGFLKLAPDSRTVIDALVALGFGASLISIFARLGGGIFTKGADVGGDLVGKVEAGIPEDDPRNPATIADNVGDNVGDCAGMAADLFETYAVTAVATMVLAAIFFAKSSLLANMMTLPLAIGGICILTSIAGTFFVKLGASQSIMGALYKGLIATGVLSLVGLAIAIAWLIGFGKLDGVDYTGSALFICGVVGLVVTGLIIWITEYYTGTDFRPVKSIAAASVTGHGTNVIQGLAISMEATALPAIVIIAGILVTYSLAGLFGIAIATTTMLALAGMIVALDAFGPVTDNAGGIAEMAGLPKEVRKSTDALDAVGNTTKAVTKGYAIGSAGLGALVLFAAYNQDLQFFISDSAKHPYFAGIKPDFSLNNPYVVVGLLFGGLLPYLFGAMGMTAVGRAAGAIVEEVRRQFREKPGIMQGTDKPDYGKAVDLLTKAAIKEMIIPSLLPVLSPIVVYFLIYAIAGGGAAGKSAAFSAVGAMLLGVIVTGLFVAISMTSGGGAWDNAKKYIEDGHFGGKGSDAHKSAVTGDTVGDPYKDTAGPAVNPMIKITNIVALLLLAILAH

SEQ ID NO: 46944 - protein, 255 aa, Euglena gracilis
MPRKFFVGGNWKCNGTRESISKIIEEFNKGPSVADADVEVVIGCPFVYADYTREKLRQDWALSVQNCWIGKGGAFTGEISAEMIKDAGIPWVILGHSERRHLPELKESDETVAIKVAYALANGLKVMACIGELLEEREGGQTQAVNERQLKAIAAKLKEEDWKNVVIAYEPVWAIGTGKVATPEQAQEVHEQVRAWVASNVSPSVAAEVRILYGGSVTAKNSAELAGKPDVDGFLVGGASLKPEFLDIVAAYKHK

SEQ ID NO: 46945 - protein, 87 aa, Zea mays
  misc_feature (32)..(32): Xaa can be any naturally occurring amino acid
  misc_feature (37)..(37): Xaa can be any naturally occurring amino acid
MIKPDGLHRGLIGEIITRFEKKGFYLNAFKLXTWRGXLLEFSTPDHASKPRLQGLVDYIISGPVVAMVREDKSVGTTDLKIIGATNP

SEQ ID NO: 46946 - protein, 279 aa, Vitis vinifera
MTWKTAVVDIPYGGAKGGIGCTPRDLSMSELERLTRVFTQKIHDLIGTHTDIPAPDMGTNAQAIDLGGSLGREAATGQGVVFATEALLAQHGKSIKGLTFVIQDFGNVGSWVARLIHERGGKIIAVSDTGCLTNFSGGDHMDPNELLTHECDVLIPCALGGVLSKENAADVKAKFIIEAANHHPEANEILSKKGVVILPDIYANAGGVTVNYFEWVHCQCEASCLCHDAKGLGSLGWFLFIFFGYVPLLQLKKQIGFSHYLPSKSHYFSLLIMNFSPTH

SEQ ID NO: 46947 - protein, 341 aa, Ralstonia solanacearum GMI1000
MMDQAAAGSPFLTRKLGRPRILIVGCGDVGQRCLAVLQSRFRVLAVTSREAGRAPLQAAGAVPVLADLDRIGTLRRLRGLAPRVLHLAPPPAAGTDDPRTAALLQALSRPGRLRAAGPAKAGSAASRGMKRRILPERRSGTGRLKSRLQPRTLVYASTSGVYGDCGGAWVDETRPVRPATPRAMRRVAAERRVRWFGVGGGWRTSILRIPGIYAGDRLPEARLQRGTPALRREDDVFTNHIHADDLARALIAALFRGRPQRVVHVSDATELRMGDYFDAVAAARGLPRPPRIARAEAVRQLEPALLSFMSESRRLRSVRLARELRLALRYPTVADFLAGGG

SEQ ID NO: 46948 - protein, 91 aa, Glycine max
  misc_feature (65)..(65): Xaa can be any naturally occurring amino acid
MGFTPRVRPMATLAPINVPDWSKILRVDSVVSLNADFTAENESEMVPPHEYLGGSQTMVANSVFXGVGRPFKGRNFNRVCYPVWSQTGFAG

SEQ ID NO: 46949 - protein, 349 aa, Ralstonia solanacearum GMI1000
MAYQINVLPSGRQFQAEDGETILAAALRQGIGLPYGCKNGACGSCKGHVREGSIVQGNHSPNALTAQEATEGRALFCCATPASDVTIEVREVHGAGDVPIKKIPCRVASLEKAAPDVTIVKLQLPATERMQFLAGQYVEFILRDGKRRSYSLANPPHADGPVELHIRHMPGGAFTDYVFGAKEGQPAMKERDILRFEGPLGSFFLREASDKPIILLASGTGFAPIKAIIEHAAFVGIQRPMTLYWGGRRPRDLYMHAMAEEWTRTLPGFRYVPVISDAQPEDGWTGRTGFVHQAVVADHPDLSGHEVYACGAPVMVNAARTDFAAQCRMHPDAFFADAFTSEADLHPAA

SEQ ID NO: 46950 - protein, 530 aa, Aspergillus niger
MAEGFVDASRVEAPVTLKTYLMCAFAAFGGIFFGYDSGYISGVMGMRYFIEEFEGLDYNTTPTDSFVLPSWKKSLITSILSAGTFFGALIAGDLADWFGRRTTIVSGCVVFIVGVILQTASTSLGLLVAGRLVAGFGVGFVSAIIILYMSEIAPRKVRGAIVSGYQFCITIGLMLASCVDYGTENRLDSGSYRIPIGLQLAWALILGGGLLCLPESPRYFVKKGDLAKAAEVLARVRGQPQDSDYIKDELAEIVANHEYEMQVIPEGGYFVSWMNCFRGSIFSPNSNLRRTVLGTSLQMMQQWTGVNFVFYFGTTFFQSLGTIDDPFLISMITTIVNVCSTPVSFYTIEKFGRRSLLLWGALGMVICQFIVAIVGTVDGSNKHAVSAEISFICIYIFFFASTWGPGAWVVIGEIFPLPIRSRGVALSTASNWLWNCIIAVITPYMVDKDKGDLKAKVFFIWGSLCACAFVYTYFLIPETKGLTLEQVDKMMEETTPRTSAKWTPHGTFTAEMGLTANAVAEKATAVHQEV

SEQ ID NO: 46951 - protein, 495 aa, Coprinopsis cinerea okayama7#130
MSDLDADLYGDLYGNDETDFNEQNNEEQQQDVTATDAGTKDSEATTTPATETKPASNGTTAQSSTTNGQTSTTTTTKPATSTPIATYTSQQPQLQQIPTYEEPQPVQSISRPDSGALNKIPSGERTVRPSEMKDEGKMFIGGLNWDTTDEGLRDYFSQFGKVDACTIMRDAAGRSRCFAFLTFEDPASVNAVMVREHILDGKIIDPKRAIPRQEHQRATKLFIGGLPGSVTSESMREFFSQFGKVIDSTVMLDRETGRSKGFGFISFEDTDVRPFLGFGNLEIDGKLIDVKLAQPRYQRDNMNNEDGQNQDGYGGGSGGRFNAQGSSGAGAAGNFGGAAGGAMGGAAGGAGGAGAAGGATFDPQALAALYTRMIQMAGGGAMNPAMMGNMAGMNPMMGAMGAGGFAGGMRPGMGMGMNMGMGMGNPAMGGMGRGGPGMMGGAQGGAGGGAGGVPRGPRGGAPGAQGGPPAAGMGNAGVGPQRSQRGTHNFHPYAR

SEQ ID NO: 46952 - protein, 371 aa, Zea mays
MARVRDRTKHFKGVAMLSHGYIEGIVVNGKSTSELLSGSVSLRSAEVVGTPVGRIVKCEEFLKAAGPVMAVKEIEPALKKQLIISTTLMTVGIAVISWLALLAKFTIFNFGTQKDVSNWGLFFCVAIGPWAGLIIGFVTEYYTSNAYKFKAYKTGAVTNVILGLALGYKSVIIPIFAIAVIIYVSFSIAAMYDIAVAALVTMLVVLLRTDAVDAAGNTTAAIGKGFAIGSAALVSLALFGAFVSRAGVKVVDVLSPKVFIGLIVGAMLPYWFSAMTVKSVGSAALKMVEEVRRQFNTIPGLMEGTAKPDYATYWKISTDASIKEMIPPGALVMLTPLIVGTLFGVETLYGVLAGALVSGVQPSFSLNRKEL

SEQ ID NO: 46953 - protein, 193 aa, Bacillus cereus ATCC 10987
MNLIPTVIEQTNRGERAYDIYSRLLKDRIIMLGSAIDDNVANSIVSQLLFLESQDPDKDIHLYINSPGGSITAGMAIYDTMQFIKPQVSTICIGMAASMGAFLLAAGEKGKRYALPNSEVMIHQPLGGAQGQATEIEIAAKRILFLREKLNQILADRTGQPLEVLQRDTDRDNFMTAEKALEYGLIDKIFTNR

SEQ ID NO: 46954 - protein, 418 aa, Geobacter sulfurreducens PCA
MVNKTILDNGVRIISEYMPHVHSVSIGIWVANGSRHERREHNGVAHFVEHLMFKGTERRNALDIAREIDSVGGVLNAFTSREYVCYYAKVLDKFLPKTIDLLADIFLNSIFDSEEIEKERKVVLQEINMLEDTPDDYVHDLFHRSFWRGHPLGMSILGSVESIEGLSREAIITHLKEKYRSDDIIIAVAGNVRHDELLSLVDGLFGRVPEGSGRDICHLPAYEKQVEVVEKDLEQVHICLGTKAFPQNHPRRFEVYLVNTLLGGSMSSRLFQEIRERLGLAYSVYSYVVSHTDAGSLVVYVGTSPEKLDDVLDITVAELKRLKTELVPLPELESAKEQIKGSIYLSLESSDNRMTKLAKNEIYFGRYIPIHELADGFDSVTSRGILELAGEIFDERYLTLALMGKIDSAAFDVSRLAL

SEQ ID NO: 46955 - protein, 456 aa, Suaeda salsa
MESCSRTHEAAYMGMEDGGLLLKGSGKEIRHGRTAHNVSASSLRKKSDLQSISKIRFGWLRNILANLQEVILGTKLAILFPAVPMAIVAHVYGFGREWVFALSLLALTPLAERVSFLTEQISFFTGPTVGGLLNATCGNATEMIIAILALSQNKIEVVKYSLLGSILSNLLLVLGTSLFCGGIANLNKEQKFDRKQADVNSILLLLGLLCHVLPLLLSFGAKTAVEAAALPTLNLSRVSSIVMLLAYCAYLVFQLWTHRQFFEAQEDSEGDDGEGGEEEVAVIGFWSGFAWLVGMTLVIALLSEYVVGTIEAASDSWGISVSFISIILLPIVGNAAEHAGAVIFAFKNKLDITLGVALGSATQISMFVVPLCVVVSWIMGVKMDLNFNTVETGSLAISIIVTAFTLQDGTSHYMKGLVLLLCYIVIGACFAVIGTPLNPVNNIVNVANTSANNIVF

SEQ ID NO: 46956 - protein, 311 aa, Oryza sativa Japonica Group
MAGGGSRRGAAAAAEEARIGTSNVFAALDTLKRRKKPSSSSKKHAEKEKEVLWAPAPLTTRSWADVEDDDDDDYFATTAPPRPVWGTHHHAADAHDDDHDEQAALEQELESEDEEVDDDAEDEHEHETEDATPAEPAMNKAAAPPAPPKDTERQLSKKELKKKELEELDAILAELELSSKSNNDAQNETNGKKGAEQAADGENKEGAPAPAESKSSKKKKAKKDKSAKEAKETQELNGGVEEAAGAEPDEEVASMDVKDRIKKVASMKKKKSSKEMDTAAKIAASEAAARSAKLAAAKKKEKSHYNQQPVR

SEQ ID NO: 46957 - protein, 289 aa, Triticum aestivum
MAAAQGKLSPEAIDNEVISNGSAKDYLDPPPAPLVDAGELGKWSLYRAIIAEFTATLLFVYVAVATVVGHKRQTDTQACSGAGVLGIAWSFGGMIAVLVYCTAGISGGHINPAVTFGLLLARKVSLPRAFLYMVAQCVGAMCGAALVRAVHGGHHYVLYGGGANELAPGYSRTAGLIAEIAGTFVLVYTVFSATDPKRIARDPHVPVLAPLLIGFAVLMVHLATIPVTGTGINPARSFGAAVVYNDKKAWDDQWMFWVGPFIGAAVAMVYHQYILRNSSIFRSNYDAAV

SEQ ID NO: 46958 - protein, 104 aa, Burkholderia thailandensis E264
MLYTGGCHCGKVRFEVEGEIDAACACNCSMCVRKGSLLWFVPRDAFRLKTPDEDAATYLFNKHVIRHRFCPTCGIHPFAEGTDPKATRWRPSTFAASTASISTR

SEQ ID NO: 46959 - protein, 319 aa, Corynebacterium diphtheriae NCTC 13129
MKKIILDLDTGIDDALALAYTLGSPELDLIGVTATYGNVLVETGVRNDLALLELFGRSDVPVFSGEPHALTKDGFEVLEISAFIHGKNGIGEAEVAEPVGVVQELSAVDFLIESVERYGDELIIVPTGAMTNIAAAMKKSETFARDAQIVFMGGALTVPGNVSQWAEANVNQDPEAADIMVRNAGDITMVGLDVTLQTLLTYAETATWRALGTPAGNFLADATDYYIKAYDTTAPHLGGCGLHDPLAVGVAIDPSLVTLLPINLKVDTEGPTRGRTIGDEVRLNDPHKNCKVAVGVDVDRFLKEFMERITRVAQGSNAR

SEQ ID NO: 46960 - protein, 567 aa, Chlamydia trachomatis D/UW-3/CX
MVKVSLSFKHLVPKLVTCLKEGYSFNTLKKDFTAGITAGILAFPLAIAIAIGIGVSPLQGLLASIIGGFLASALGGSRVLISGPTSSFISILYCIGVKYGEDGLFTITLMAGIFLIIFGLAGLGTFIKYMPYPVVTGLTTGIAVIIFSSQIRDFLGLQMGDGVPLDFIGKWAAYWDYLWTWDSKTFAVGLFTLLLMIYFRNYKPRYPGVMISIIIASTLVWILKIDIPTIGSRYGTLPSSLPGPVFPHISITKMLQLMPDALTISVLSGIETLLAAVVADGMTGWRHQSNCQLIGQGIANIGTSLFAGMPVTGSLSRTTASIKCGASTPIAGIIHAICLSFILLLLAPLTIKIPLTCLAAVLILIAWNMSEIHHFIHLFTAPKKDVVVLLTVFILTVMTTITSAVQVGMMLAAFLFMKQMSDLSDVISTAKYFDESEQPQNDLLFSKNEVPPFTEIYEINGPFFFGIADRLKNLLNEIEKPPKIFILCMTRVPTIDASAMHALEEFFLECDRQGTLLLLAGVKKTPLSDLRRYHVDELIGVDHIFPNIKGALLFAKALIKLESKSSQ

SEQ ID NO: 46961 - protein, 571 aa, Methanopyrus kandleri AV19
MEEKELRDLVRRYALENAARYGGRANPNAVMKKIMKEHEELRPRAKEVLKTVREVVREVNKMSGEEIRRELEELGGPREDVARDKEGLKPLPGAEPGNVRLRFAPNPSGPLHIGHARAAVLNDEYARRYDGTLVLRIEDTDPRRVDPEAYDMIEEDLEWLGVNIDERYVQSNRIELYYMVCEELLEREGAYVCTCDPDEFRRLRDVGRACPCRSRDKEENLELWEEMLDGTFSEGEAVVRVKTEVDHPDPAVREWIAFRIVEEEHPMTGSRYLVWPTMNFAVAVDDHLMNITHVLRGKDHESNTRRQKYVFEHLGWDTPEYVHYGILKVEGAVLSTSEIRRGIDSGEYTGWDDVRVATLRALRRRGIKPEAIRETILEIGLTDVDATFSWEHLYARNRKMIDPESHRYFFVRDPVELRIEGMKESVLARLPLHPDRDEGERVLILHPENGVARALLDGEDAEDLWEGDVVRLMNAVNVEIEEVGDGWLRGRYHSDDYRIAKEEGAQIVHWVPPDQAVRCEVVRPDGSVESGYAEINVEREQAGSTVQFERLYFVRLEEVSSGGVRAVYAHD

SEQ ID NO: 46962 - protein, 386 aa, Leifsonia xyli subsp. xyli str. CTCB07
MCTASRPRIAVIVVAAGSGTRLGAGSPKAFVTLGGRTLLERSLHAVRCMREPAQVVVVAPEERLAEAAALGEAGFGAAVDVVAGGETRQGSVAAGLGALREGVEIVLVHDAARALTPAAQFDAVVAAVDAGGAGVVPGLPVSDTIKRVGADGEVRETVDRSVLSAVQTPQGFPRDQLVAAYAAATTDETDDAELAAAAGHPVTVIPGDARAFKITTPWDLRRAEELLAGLAAPRIGFGTDTHAFDPSAELWLAGLRWEGEPGLAGHSDGDVVAHAIVDALLSAARLGDIGGVFGTGDPRFSGAHGEVFLTETRRLVEEEGFRIGNVSAQIVGNRPKFAPRRAEAETLLSRVLGAPVSVSATTTDGLGLTGRGEGVAVFATALLLAP

SEQ ID NO: 46963 - protein, 592 aa, Vitis vinifera
  misc_feature (10)..(11): Xaa can be any naturally occurring amino acid
  misc_feature (26)..(26): Xaa can be any naturally occurring amino acid
  misc_feature (34)..(35): Xaa can be any naturally occurring amino acid
  misc_feature (364)..(364): Xaa can be any naturally occurring amino acid
MVPSMPSWYXXLPYLRLMKIDHYLWXHVLKGIVXXDEPSCCGIWESKEEAANWGESVAGEKCEKKGNSMDAQNMESNEVSLSRKRMRQVSEDEAFARKLQAEMENDVLVQERSLVTGKSGYSQASTASIPSSHMNSEAIRHFSIPKDNLPLTYRLLRVKDLPAWANTSSVSIRDVIQGDVLIAVLSNYMVDIDWLLSSCPTLAKIPHVLVIHGEGDGTLDHMKKNKPPNWILHKPPLPISFGTHHSKAMLLVYPRGVRVIVHTANLIYVDWNNKSQGLWMQDFPWKVQKELSKGCAFENDLIDYLSVLKWPEFTANLPALGSFNINSSFFKKFDYSNAVVRLIASVPGYHTGSNLKKWGHMKLXSVLQECIFDKEFQKSPLAYQFSSLGSLDEKWMTELASSMSSGSCDDKTPLGLGKPLIIWPTVEDVRCSLEAHITCWIPGYLLGFYMCKFALHQSYYIVQGYAAGNAIPSPQKNVEKEFLKKYWAKWKATHTGRCWFLLTSANLSKAAWGALQKNNSQLMIRSYELGVLFLPSPINRGQGFSCTDNGSPSKMFPGLGTGDTTRRMFVVKFGQDTFSCTVPQIPNLVLIV

SEQ ID NO: 46964 - protein, 324 aa, Oryza sativa Japonica Group
MEKAAGFLSSLLGGGEEVPPEPAATVRSILIYPIKSCRGISVPQAPITSTGFRWDRQWVVVNSKGRAYTQRVEPKLALVEVEMPPEAFAEEWRPTADSYLVGRAPGMDPLKIPLSAEQAIINDVSVWEWSGSAYDEGAEAAEWFSSYFGNPSRLVRFKGGSEIRPTNPDYAQSYKIMFTDCFPFLMASQGSLDALNEVLKEPVPMNRFRPNILVDGCHPYSEDLWKTIKINKLTFQGVKLCNRCKVPTINQENGILGTEPTETLLTFRSDEVLRPNHKNKRQVYFGQNLVCKESLSAKGKGRIIKVSDPVYVLERFPSSDEAPA

SEQ ID NO: 46965 - protein, 163 aa, Bradyrhizobium sp. ORS278
MADARRAPLKDQTDITGARALIVEARFYDDIQDAMLEGATAELKAAGVSYDVLTVTGSLEIPATIAIALDAAAKTGKPYDLAIALGCVIRGDTIHFEIVSQESSRALMDLSVARGLPLGNGILTVNTEDQAWARARVSEMNKGGDAARAALAVLRIKRRLSRG

SEQ ID NO: 46966 - protein, 115 aa, Brassica napus
MSNQKKRNFQIEAFKHRVVVDPKYADKTWQILERAIHQIYNQDASGLSFEELYRNAYNMVLHKFGDKLYTGFIATMTAHLKEKSKLIEAAQGGSFLEELNKKWNEHNKALEMIRD

SEQ ID NO: 46967 - protein, 367 aa, Exiguobacterium sibiricum 255-15
MSILVVDDEFTNLMILERLLENEGYDVVKAMSGEEALELMEDPLFIETLDVVLLDVEMPGISGIDATRLIRKRFGLDELPIVIVSGRSNEEDIADGLDAGASDYTTKPIRKTELLARVRNAMSLKQAIDARKRYEKVLQEDFDLAQKLQQSVLSANIEDEDIRIMATYIPSKKLAGDMYAWYRISPQKYGIILFDVMGHGVSSALITMGMSSILFELVHRIGDPAKVLEELNKQMSRLFPGDETEIYFTAVYLYIELDEMKLSYANAGHPPGLLRMGNQIIPLENTGLPVGMFEDSEYTSQTIDLVSPGCVYLYTDGFMELYSKGIDEGISAIRELIHEQGPAIHQLIQPDQSDDADDLCLVTVEIN

SEQ ID NO: 46968 - protein, 584 aa, Mycobacterium sp. JLS
MFGFTPVRVDLSILFSNLVHMTASSAPTSHATAGTVLRGVPVVPGVQYAPVVRPGRLPVVEDTAAEIADADRPAEAARFSAAATAVATRLRDRAAHSTGAASEVLAATATLAQDRAWLGAAEKRIAGGTPAVRAVREAVAQFVDLFTKMGGLMAERVTDLQDIRDRVLAELSGLPEPGVPLPMVPSVLCAEDLAPADTAGLDPTLIVALATTLGGPTSHTAIIARQLGIPCVVAVDGLDAVPAGAFVLVDGTAGTVTVGPDEVAAAEAVAAARHEAERAAHWAGPGATADGHAVAILANVQDGAAARAARETPAEGVGLFRTELCFLNRDTEPTVDEQAEIYGEVLDAFAGHKVVVRTLDAGSDKPLKFAGHRDEANPALGVRGIRIAHGNPGILERQLAGIAAAAARTGTRPWVMAPMIATAGEAKDFAAAARRHGLTPGVMIEVPAAALLADRILEHVDFLSIGTNDLAQYTMAADRMSADLALLTDPWQPAVLALVAMTVRAGAAAGKPVGVCGEAAADPTLACVLAGLGVTSLSAASAAVPGVGARLAQVTLQQCRDAAEAVLATATAAEARAAALAALG

SEQ ID NO: 46969 - protein, 565 aa, Klebsiella pneumoniae subsp. pneumoniae MGH 78578
MQFTHKKNRSLYIPYAGPVLLEFPLLNKGSAFSMEERSNFNLLGLLPEVVETIEEQAERAWIQYQGFKTEIDKHIYLRNIQDTNETLFYRLIGNHLEEMMPVIYTPTVGAACERFSEIYRRARGVFISYQNRHNLDDILQNVPNHNVKVIVVTDGERILGLGDQGIGGMGIPIGKLSLYTTCGGISPAYTLPIVLDVGTNNQQLLDDPLYMGWRHPRITDDEYYQFVDDVIQAIKARWPDVLLQFEDFAQKNAMPLLNRYRNEICSFNDDIQGTAAVTVGTLIAASRGAGSQLSEQKIVFLGAGSAGCGIAEQIIAQIVREGLSEEEARQRVFMVDRFGLLTDGMPNLLPFQNKLVQKREQLQSWDTTSEALSLLDVVRNVKPNILIGVSGQPGLFTEEIIREMHKHCPRPIVMPLSNPTSRVEATPQNILSWTDGEALVATGSPFSPVTVKGKQYPIAQCNNSYIFPGIGLGVIASGASRVTDEMLMAASETLAQHSPLVNNGEGPVLPELKDIQTVSRAIAFAVGKVAQEQGVAVKTSAEALLQAISDNFWLPEYRNYRRTSI

SEQ ID NO: 46970 - protein, 253 aa, Zea mays
MAAAAGIRSREERWSLAGKTALVTGGSKGIGRAIVEELAGFGVRVHTCARTAADLDERLRAWAADARLPGRVTASVCDVSARGDREALVAAARAELGPRLDILVNNAGQSTFRAATETAAGDYARLMATNLESCFHLAQLAHPLLLAAGAGAGAGAAVLTRSLAAEWAGDGVRVNCVAPGGVQTDMFSSVALEMDPDPETSLRMMEAELARVPLRRFGETEEIASLVAFLCMPASSYITGQVICADGGRTIAA

SEQ ID NO: 46971 - protein, 231 aa, Debaryomyces hansenii CBS767
MSSEESGEVGVPKNGNQDDDSGSTRVSVSDRLAKLQRLKRKKQESEKLNKQELFQDYKQQKLKSIEYKKIEQKKLNAELEQEKLDSIEKGEDFERKQNWDWTIEDCEKWEKKTKQKGRNQKSGFQNFNKMAEQAYNKELLNLKVDKETYDQQKNAINKNKSGNQLQMSKILPVSSKPSAADTNRLVRNIEEANNRRMKRRRNKDDENDVNSYINDKNKQFNLKLNRQYDES

SEQ ID NO: 46972 - protein, 387 aa, Oryza sativa Japonica Group
MAAAASAPPAPADALPKGADSFFRTVISNMEKVYLSRNPTAKTILELVRSYDGDHICYDHFAFRTFGVDGYGIKSLAEFFTDFGYVPREELRFPAKKLRALWFSPPTNDGYTGTGVYGPLPRIFISELLVDELSPQSQDIIQKYIRTSGKGNKHATLASTSGELTWEKPIYSDFQVLSRESEYAAWTLVNGYALNHTTISTHRLISDIRSINKFNKFVEDNGFKLNSEGGILKVSPDGLLQQSSTVADSALFTFADGITESIPRSYIEFAERLVLPQFKDLPNDEQQFKAAFCYLEVQDRCVRWCFPQMLVFDRRIIIWQHQICDLLGSINVAELQPRDVPRFQHCLNLNVKKRTIYLKKIRKGPYLSLNGTTLAKDYIVPFAVSPL

SEQ ID NO: 46973 - protein, 571 aa, Oryza sativa Japonica Group
MVGPPRPPPQPAGGGEGEDDEEGGGVMIGPPRPPPRSSSRGEGEDADGGMIGPPRPPPVKDDDEEDEDDDDDDGDDSDDEMEDDGERYNRIPLSNEVVLRGHTKVVSALAVDHTGSRVLSGSYDYTVCMYDFQGMNSKLQSFRQLEPFEGHQVRSLSWSPTSDRFLCVTGSAQAKIYDRDGLTLGEFIKGDMYIRDLKNTKGHISGLTGGEWNPKSKETILTSSEDGSIRLWDVSDFKSQKQVIKPKLARPMRIPVTSCAWDHEGKRIVGGIGDGSIQLWTVKTGWGSRPDIHVEKTHTEDITGVKFSTDGQILLSRSMDSTLKIWDLRKMKTPLKVFEDLPNHYAETNVAFSPDEQLIFTGTSIEKDGENGGLLCFFDRRKLELVSRVGISPHYSVIRCLWHPRINQVFATVGDKKEGGTHILYDPSISQRGALVCVGRAPRKKSVDDFEVQPVIHNPHALPLFRDQPSRKRQREKILKDPLKSHKPEAPVNGPGFGGRVGTTKGSLLTQYLLKEGGLIKETWMDEDPREAILKYADAAEKDPKFIAPAYSQTQPKPVFAESDSEGEEKK

SEQ ID NO: 46974 - protein, 854 aa, Burkholderia mallei ATCC 23344
MLVAPLTGPVVPLADVPDPVFSGGMFGDGIGIDPLEGRLLAPCAGVVSHVARTGHAVTIAADGGAEILLHIGIDTVELNGLGFTAKIAEGARVAAGDLLIEFDQDAIARAAHSLVSVIAIANSDAFEVVERAGAGVVKAGETPLLALRARGADASADASASASAGAAADASCAQPAAEARKSITLTQPGGLHARPAARAREAARGLDAHVDVHFEGRKAALQSVVGLLGLGAGEHATIELVATGRDAAKALERVAHELLREAHGEAEEKPARIVSPAPAAAGIARAPLEPNTLAGVCAAPGIAVGTLVRWDDAQIVPPELASGTPAAESRLLDRALAEVDAQLETTVREASRRGAIGEAGIFAVHRVLLEDPALVDAARDLISLGKSAGYAWRETIRAQTAVLADVDDTLLAERAADLRDIDKRVLRALGYASASARELPAEAVLAAEEFTPSDLASLDRERVAALVMARGGATSHAAIIARQLGIPALVAVGDALYAIAQRTQVVVDASAGRLEYAPSALDVERARHERQRLAGVREANRRMSGEAALTRDGHRIEVAANIATLDDARVALDNGADAVGLLRTELMFIHRQAAPTASEHQQSYQSIVDALQGRTAIIRTLDVGADKEVDYLTLPPEPNPALGLRGIRLAQVRPDLLDDQLRGLLAVKPYGSVRILLPMVTDVGELVRIRKRIDDFARAMGRAQAVEVGVMIEVPSAALLADQLAQHADFLSIGTNDLTQYTLAMDRCQADLAAQADGLHPAVLRLVDATVRGAEKHGKWVGVCGALGGDPVAVPVLVGLGVTELSVDPVSVPGIKAQVRRLDYQLCRQRAQDLLALESAQAVRAASREIWPAE

SEQ ID NO: 46975 - protein, 249 aa, Leifsonia xyli subsp. xyli str. CTCB07
MSASHALILLRHGNSEWNRQNLFTGWVDVRLSEQGVAEAKRAGELLAESGLVPDILYTSLLTRAIQTANHALDAADRLWIPVVRSWRLNERHYGALQGLDKAETLEKYGPEQFQLWRRSFDVPPPPLADDSEWSQADDPRYADLGADLPRTECLKDVIARMLPFWESDITTSLSAGKTVLVTAHGNSLRALVKHLDGISDDDIAELNIPTGVPLVYKLDDSFKPVEPAAYLDPEAAAVGAAAVAAQGKK

SEQ ID NO: 46976 - protein, 335 aa, Corynebacterium glutamicum ATCC 13032
MSTQVELKTPKSEDRAAYIAALGFPVLVIIGGIIGFTASDVVLNISSWVNPLLGIIMFSMGLTLKPVDFALVAKRPLPVLIGVIAQFVIMPLIALLVVWVLQLPAEIAAGVILVGCAPGGTSSNVVSYLSRGDVALSVTMTSISTLLAPIFTPLLTLWLAGQYMPLNAADMAVSIVQVVLIPVVGGLVVRLIFPTLIGKVLPLLPWISVIAISLIVAIVVAGSRDKILEAGLLVLAAVIIHNTLGYSLGYLAAKFTGQPAAARRTTAIEVGMQNSGLAAGLASQYMSPMSALPGAIFSVWHNLSGALLAALCRASDKRAAEKVASEKAASEKAAS

SEQ ID NO: 46977 - protein, 448 aa, Corynebacterium diphtheriae NCTC 13129
MPLTFAHSFADAVPSLSVPWRAEQWPDPRIIVFNHELGQELGIDEASLLSNITQQGHAQAYSGHQFGQFNPLLGDGRALVLGDCAQTNAPHGQFEISLKGSGPTPFARRGDGRATLGPMLREYLISEALHGLGIPTTRSLAVITTGTDVQRERLLPGAVVVRVAQNHLRVGSVQCAAMRDDDSLAALVRYALSSHEDGVSDAEAAGLLLRRVSTSQAKLVAQWMRFGFVHGVMNTDNVTLSGQTIDFGPCAFIDSFHPQAVFSSIDSHGRYSFGRQPSIMGWNIARLAEALLPLMSIDEARNIVHEFPDMYRRSWLDEMADAVGISPDDDHAAGVLDDLVALLDVHRPDYAQFMRSLSDGTTVSLFPWAQQWEAEVSSLRVAAPRNPVYVPRNYLVEDALEHAMNADMSVFSLLVEAGKNPYLREKRFEKLENPAPETWQDYVTYCGT

SEQ ID NO: 46978 - protein, 220 aa, Brassica napus
  misc_feature (13)..(13): Xaa can be any naturally occurring amino acid
  misc_feature (28)..(28): Xaa can be any naturally occurring amino acid
MPECKLGLNDRVXLEAQGRTTKGKAIDXEDIKFHQCVRLARFENDRTISFIPPDGAFDLMTYRLSTQVKPLIWVEAQIERHSKSRVEMLVKARSQFKERSTATNVEIELPVPADASNPTVRTSLGSAAYAPEKDALVWKIKSFPGNKEYMLRAEFHLPSITAEEATPERKAPIRVKFEIPYFTVSGIQVRYLKIIEKSGYQALPWVRYITMAGEYELRLV

SEQ ID NO: 46979 - protein, 296 aa, Vitis vinifera
MAAGDIPSIDMQDFPRQFRRLREACEEWGCFRVVNHSIPPSLLSEMKSVVGSLLDLPLEVKRRNTDVIAGSGYMAPSKVNPLYEALGLYDMASHQAVDAFCSQLDASPHQRETIKIYAKAVQELAMDIGNKLAETMGLGGDLFKEWPCQFRINKYNFTPETVGSPGVQIHTDSSFLTILQDDENVGGLEVMDKSGAFVAVDPMPGTLLVNLGDIATVWSNGRLCNVKHRVQCKEAAVRLSIASFLLGPKDAAVEAPPELVDSEHPRLFVPVTYEDYRKLRLSTKLQAGEALALEMK

SEQ ID NO: 46980 - protein, 460 aa, Bradyrhizobium sp. ORS278
MDAKSPDLSQLHAMVSPGDGLMTDGWRNARGEPSLGNMFASVRTSAKGSLWRKLIAFLGPGYLVAVGYMDPGNWATSLAGGSKFGYVLLSVALLSNLMAIVLQSLCTRLGVATGRDLAQACRDSTPRWVSVPLWLSAEIAITATDLAEVIGTAIGLSLLFGLPLSIGVCVTALDVFLILALQAFGFRWIEAFVVALLGIIALCFAIQIAMAQPDWAQVIKGFVPSGQLIANPEMLYLALGILGATVMPHNLYLHSGLVQTRGYGDSPEEKREAITLSTIDSTIALCLALTINASILILAAATFHKTGQHDVAELDQAHAFLAPLLGSTLAPTLFAIALLCCGLNSTITATLSGQIVMEGFLQWRIAPWLRRLITRMIAIVPAVVVTIWAGEKATGQLLILSQVVLSLQLPFAVVPLVLITASRSKMGQFVAPRWLTAIAGAIAVAIIVLNAKLVWDLAAG

SEQ ID NO: 46981 - protein, 234 aa, Corynebacterium efficiens YS-314
MERHSELQANLDRVKKRIDDATVAAGRPPGSVSLLPVTKFHPVRDIRILHELGITAVGENREQEARAKHQEFPAMEFHMIGQIQTKKANAVARWAAAVHSVDSVRLAEALDRGVGLALERGDRSVDKLPCFIQLSLDGDTSRGGVAADTAMEVAQALEEAPHLTLTGLMCVPPLGWDPLTAFSQAREVLTGMEQHFDRDMEFSAGMSGDLAEAILHGSTIVRVGTEILGSRPIP

SEQ ID NO: 46982 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPRKGQSVAIFGLGAVGLAAAEGARIAGASRIIGVDLNSQRFAQAKEFGVTEFVNPRDHGKPVQQVIAEMTNGGVDRSVECTGSVQAMIQAFECVHDGWGVAVLVGVPSKDDAFETHPMNFLNERTLKGTFFGNYKPKTDIPGVVEKYMNKELELEKFITHTVPFSEINKAFDYMLKGESIRCIITMGA

SEQ ID NO: 46983 - protein, 558 aa, Oryza sativa Japonica Group
MAMEYDDLKLDGGTASVGDGGNVEQPIRRRRPMVADPVVGSCQRQGRQQRGGSSLPFDRGGVEGRGLTREKGLASIVNASQRRWAMVRSQHHFGRAGVKGKRKTNLEAIQRLKNSKASSKVGISSSEVPELVSGSNFRPSTGKPDTTARRWAERQDGAAGRGAKRASEAKQGEGRQPLHSSLSLPLSACGRQRAQSGSGQSRPVEWSGASGGRQQPRLPAVNPCAHGGGRRRDQVFTAAPPGHGVHCTPHDHHRHGSRLLTILLIVVPFGAVLPLGIAGPIWRGGGERTGRRGGRKCGCRGRRGKSHREACNGHRRRGGALCQYHVGQRPSKRSHVGATSSKTREQYCRGTLFTRFYGPDLSGLVLPARTSEASSTSPFTSPHAPTHPPTEQGGMAMAAARRALLSHLRVPVLARPAAAAGSVPAARLLSSATEEGSKGSFLDKGEVADRIVSVVKNFQKVEPSKLKIAMKRLLAYALIALIETLLWFVDVTCTRLPDTLVTPNAHFQKDLGLDSLDTVEIVMAFEEEFGFEIPDNEAEKIDSIKTAVDFVASHPQAK

SEQ ID NO: 46984 - protein, 706 aa, Kluyveromyces lactis NRRL Y-1140
MAFQDLNAVLLDKKGTPTDTSPSKKYGTGSCIGADTSFNDVQSTSTSTVGLKFSTVSFPENERVTLKDTIPYYLPCFSWIPTYSVKKCMGDFIAGLSLASFQIPLAMSYATSVAHVPPLCGLYSLVFSPAVYTVLGSVPQMIVGPESAISLILGQAIEARLSEDPKLKAINICLVITFISGLVLLTGGLLRLGFLENVLSRALLRGFISGVGVIMVITSLVVELKLNHVTPTRQEHYHSPFEKVLFIMKYGPENYHKPTAILSLVAFVILMSLRIFKKRYGKKFKWLVLLPDILVVVALSIFVSYKMHLKSRYGIEIINDIPKDSMKHLKNPFSNVNVATFKDLFSTGFMVAMLGFFESATASKSLGTSYNLAISSNRELIALGSMNVVGSMFAILPAFGGYGRSKINAYSGAQTTMSGFFMGLVTLFTIQFLLPIIRYIPVCILSVITTVVGLTLLEEAPHDLKFHWRCKGYSELTVFTVTLLATLFYSLEAGIYIGCACSIINVIKHSAKSRIQILGRVPGTETFINADDYQANAAGYFINPQIEEIEGFLIVKIAEPLTFTNADDLKMRLHRLEKHGSAVTHPAAPRSRRKEMTENVIFDMKGMTHIDSSAAQTLEEILSAYNRRDVHVFLTNVPLTEKVRERLVTSGVAELCERNTITNSSYFSTIEDALTAADVIAQRHNQQYHTPPPSIFSNTLLNSSMA

SEQ ID NO: 46985 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLHPGDHVLPIFTGECGDCPHCHSEESHMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAIECVHDGWGVAVLVGVPSKDDAFKTHPMNFLNERTLKGTFFGNYKPKTDIPGVEEKYMNKELELEKFITHTVPFSEINKAFDYMLKGESIRCIITMGA

SEQ ID NO: 46986 - protein, 470 aa, Mycobacterium sp. JLS
MTTDSAAQATQAAQANTDIPATVARLRRTFATGRTRDIEWRKRQLRALERLMVENETEIAAALEQDLGRKPFEAWLADIASVAGEAKDAAKNVRKWTRRRYRMLELSQLPGLGWVEYEPFGTVLIIGAWNFPFALTLGPAVGAIAAGNTVVLKPSEVAPACSALMAELVPRYLDNEAIVVVEGDGSVSQELIAQGFDYLLYTGGTEIGRKVYEGAAPHLTPVTLELGGKSPVIVTADADIDVAAKRIAWTKLINSGQICIAPDYVLADAKIRDQLVDKIKAAVQTFESENPDGKRIVNERHFDRLTTALAATKGDVVIGGGSDASKISIQPTVVVDPDPAEPLMTDEIFGPILPIVTVQSLDQAIDFVNARPKPLAAYLFTKTKAIRERVVKDVSSGGMVVNHLLFHFATHKLPFGGVGPSGMGAYHGRFGFETFSHHKTVMTKPTRPDVGAFIYPPYTEKAWKLARRLF

SEQ ID NO: 46987 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 46988 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFSGNYKPKTDMPGVVEKYMNKELELEKFITHTVPFSEINKAFDYMLKGESIRCIITMGA

SEQ ID NO: 46989 - protein, 391 aa, Pseudoalteromonas tunicata D2
MSVIKMADLDLAGKRVLIREDLNVPVKNGKVTSDARIRASLPTIKLALEKGAKVMVMSHLGRPTEGEYNEEFSLAPVVDYLNDALDCAVRLEKDYLNGVTVNDNEVVVFENVRFNKGEGKDDETLAKQLAALCDVYVMDAFGTAHRAQASTHGVGVFAPIACAGPLLAAELEALGKALDNPARPLVAIVGGSKVSTKLTVLDSLSKIVDQLVTGGGIANTFIAAAGHPVGKSLYEPDLIAEAQKLTADAKANNGDIPVPTDVVVAKEFSESAVATLKDVSEVTDDDMIFDIGPDSAQQLATIIKNAGTVVWNGPVGVFEFDQFGNGTEAIAKAIAESNAFSIAGGGDTLAAIDKYGVADQISYISTGGGAFLEFLEGKVLPAVAMLEARAK

SEQ ID NO: 46990 - protein, 337 aa, Pseudoalteromonas tunicata D2
MAIRLAINGFGRIGRNIVRAIYESEQHDRFKVVAINELAEPQGIAHLLKYDTSHGRFKFPVQLDGDSLNVAGDSIALFALDSPADLPWAELDVDVVLECTGVFHSREHAQIHLAAGAKKVLFSQPADADMDATIVYGINDDELTAAHTIVSNGSCTTNCIVPVIKVIDDAFGIESGAITTIHASMHDQQVIDAYHPDLRRTRAASQSIIPVDTKLARGIERILPKFHGRFEAIAVRVPTINVTAMDLSVTLNTDVNLADINRVIKAAAGGRLTGILDYTEEPLVSVDFNHDPHSCIIDGTQTRVSHKRLVKLLVWCDNEWGFAHRMLDTSFAMMSAK

SEQ ID NO: 46991 - protein, 510 aa, Blastocladiella emersonii
  misc_feature (215)..(247): Xaa can be any naturally occurring amino acid
  misc_feature (257)..(257): Xaa can be any naturally occurring amino acid
  misc_feature (278)..(278): Xaa can be any naturally occurring amino acid
  misc_feature (430)..(430): Xaa can be any naturally occurring amino acid
MLRSTMSRVAGALLRRRAAAAVTARPVAAAPAIAARRSYASGSTAEQSLLTRIEKKRQEALLGGGEKRIAAQHAKGKLTARERLTLLLDEGSFREYDAFVEHTCADFGMEKTKITGDGVVTGHGTINGRQVFVFSQDFTAFGGSLSKTHAAKICKVMDKAMLVGAPVIGLNDSGGARIQEGVESLAGYADIFPAHVLASGVVPQLSLIMGPLRGXXXXXXXXXXXXXXXXXXXXXXXXXXXXXXXXXVHGPRHVALXVTGPEVVKAVTNEEVTFEELXGAKVHTSKSGVAHLAFDNDVEALARLREFVDFLPLSNRHPVPERAAVDPVDRADAALNTLIPTDSTKAYDMKHVVTRVLDDGHFFEVMPDYAKNIIIGFGRMDGRTVAVVANQPMVSSGVLDINSSVKAARWVRFCDAFNIPIVTFVDVPGXLPGTAQEHNGIIRHGAKLLYAYAEATVPKITVITRKAYGGAYDVMASKHLRGDINLAWPTAEIAVMGAKGAVEIIFRGRS

SEQ ID NO: 46992 - protein, 458 aa, Nostoc sp. PCC 7120
MTFDYDLFVIGAGSGGLAASKRAASYGAKVAIAENDLVGGTCVIRGCVPKKLMVYGSHFPALFEDAAGYGWQVGKAELNWEHFITSIDKEVRRLSQLHISFLEKAGVELISGRATLVDNHTVEVGERKFTADKILIAVGGRPIKPELPGMEYGITSNEIFHLKTQPKHIAIIGSGYIGTEFAGIMRGLGSQVTQITRGDKILKGFDEDIRTEIQEGMTNHGIRIIPKNVVTAIQQVPEGLKISLSGEDQEPIIADVFLVATGRVPNVDGLGLENAGVDVVDSSIEGPGYSTMNAIAVNEYSQTSQPNIYAVGDVTDRLNLTPVAIGEGRAFADSEFGNNLREFSHETIATAVFSNPQASTLGLTEAEARAKHGDDAVTIYAPFRPMYHSFTGKQERIMMKLVVDTKTDKVLGAHMVGENAAEIIQGVAIAVKMGATKKDFDATVGIHPSSAEEFVTMR

SEQ ID NO: 46993 - protein, 162 aa, Bordetella bronchiseptica RB50
MNIPFRVGQGFDVHALVEGRPLIIGGVTIAHTHGLLGHSDADVLLHAVTDALLGGAGLGDIGRHFPDTDQAYRGADSRVLLRAAFDKVRAAGWAPVNVDATIHAQAPKIGPHAAAMVANIAADLALDAGAVNIKAKTNEGLGYLGRKEGIAANVVVLLARAG

SEQ ID NO: 46994 - protein, 118 aa, Triticum aestivum
  misc_feature (60)..(60): Xaa can be any naturally occurring amino acid
  misc_feature (72)..(72): Xaa can be any naturally occurring amino acid
MAPAVMASSATTVAPFQGLKSTAGLPVSRRSSGSLGSVSNGGRIRCMQVWPIEGIKKFEXTLSYLPPLSTEXALLKQVDYLIRSKVGACLQFSKGLLRPLSKKPPGLLVEYWDKCWLP

SEQ ID NO: 46995 - protein, 231 aa, Prosthecochloris aestuarii DSM 271
MGEQNTVAETAGYVSRGNKATRQGFGEALQEIGQMDSSVVALCSDLTGSLHMQHFQRDFPERFLQVGIAEANMISMAAGLATTGKKPFAGTFAVFATGRVYDQIRQSICYSNLNVKKKASHAGLTLGEDGATHQILEDIGLMRGLPRMTVIVPCDYSETKRATRALLEHEGPAYLRFGRPNVPDFTLDEDGFEIGKSIELHPGKDVTVIACGIMLWISKEAPRMLEKEGGL

SEQ ID NO: 46996 - protein, 550 aa, Methylococcus capsulatus str. Bath
MRGPLLLNYPLFNKGPAFPEQERRELGLLGLLPPHVDTLETQVERAYEAFRAKPTDLERHIYLRALQDENEVLFYRLMQDYIGETMPVVYTPTVGEACQRFSHIYRHPRGLFIAYPEREHIDELLANTAQREVDVIVVTDGERILGLGDQGAGGMGIPIGKLALYTLCGGIHPARTLPVLLDVGTDNPDLLNDPLYMGWRHPRVRGTEYDEFVERFVQAVMRRYPNVLLQWEDFAQANAGPLLERYRDRLCTFNDDIQGTAAVATGTVLAAVKVTGTRLRDQVVAVFGAGSAGCGIAEQICAAMVRDGLSETEARSRCFLIDRSGLLREGLSGLPPFQQAFAQPAARLAGWRVDRAGTIGLAEVVNNARPSVLIGVSGAAGAFTESIVKAMADYTPRPIILPLSNPTSRCEALPAQILAWTEGRALVATGSPFADVAWEGRTIPIPQCNNSYIFPGLGLGILAIGARRVTPGMFMAAAQALANASPAATDPHGPLLPPLTAIRNVSRLIALAVAKEAVAAGVAAPASDADLERMVDERMWTPAYARLTGC

SEQ ID NO: 46997 - protein, 298 aa, Methylococcus capsulatus str. Bath
MKPRHFVTLRDLSSAEFRALIARAIDLKARKEPYEPLKNKVLGMVFEKSSTRTRVSFEVGMAQFGGSSIFLSPRDTQLGRGEPIEDSARVLSRMVDCIMLRTHAHRTVEIFAEYSRVPVINGLTDRFHPCQLLADMQTYFEHRGDIAGKTVAWIGDGNNMCQTYVHAAGLLDFRLRIACPPGYEPEAELVEAAGKCVEVGHDVRTAVNGADLVVTDVWASMGQESEQTERTGAFRDYQVNAALMALAHADALFMHCLPAHRGEEVSAEVLEGPQSVVWDEAENRLHAQKALLEFLLTA

SEQ ID NO: 46998 - protein, 391 aa, Methylococcus capsulatus str. Bath
MTSNIMPTYARQPVTFTHGEGAWLFDTEGKRYLDAVSGVAVCSLGHAHPAVAKALCDQAGRLVHCSNLYRIGLQEDLAKQLCDLSGMDNAFFCNSGAEANEAALKIARRYGHHRGIDTPKIVVMEGSFHGRTLATLSATGNPKVQEGFAPLVGGFVRLPYGDAEAVAAVDDPDVVAVLVEPVQGEGGVRIPPDDYLARLKSLCERRGWLLMLDEVQTGMGRTGRMFGHQHTGVTPDVMALAKALGNGVPIGACLARGVAAEMLTAGKHGSTFGGNPLACAAALAVIDTLTRQSLAQRAEILGQRLLDGFRTRLSGRPGVIEIRGLGLMIGLELERPCTRLVGMALEQGLLINVTAERTVRLLPPLILTDAQADDLVERLCSLVEAHLDAAG

SEQ ID NO: 46999 - protein, 694 aa, Burkholderia thailandensis E264
MAVDYTTRDGVAVITLNNPPVNGLGLSTRLGIMEGLERAQRDPAIAAIVLAGAGRAFSGGADITEFNTPKALQEPTLHTVIDAVEASGKPVVVAIHSVAMGGGLELALGAHYRVASPGAQIALPEVKLGLLPGAGGTQRLPRAVGLETALNMIVSGAPVPSEQLAKSGLFDAFVEGDLLDAAVAFARKAGAASGPHPRVRDREIVHDNAAGFIQFARNSVKAVAQHYPAPHKCIDAIEAGVLQGFGKGLAFERDCFVALVQTPESRALRHAFFGERAASKIPDVPADTPVREIKSVAVIGAGTMGGGIAMNFLNAGLPVTLLETKQEALDRGLATIRRNYDAQVKKGKLTQEKLDARMALIRPTLAYDDLKDADLVIEAVFEELGVKEQVFRRLDEVAKPGAILASNTSTLDVNKIAAFTKRPQDVVGMHFFSPANVMKLLEVVRGGQTAKDVLATVMQLAKKIRKTAVVSGVCDGFIGNRMVEQYIRQALFMLEEGALPAQVDRAIETFGFAMGPFRMSDLAGNDIGWAIRKRRYVEQPDLHYSKIADRLCEQGRFGQKTGAGWYDYVPGERRAKPSKLVDEMIVAYSSERGLERREIGDDEIVERLVYSLVNEGAKILEEKIASKASDIDMVYLTGYGFPLWRGGPMLYADTVGLYNVERAMRGYAQRANGDAWQIAPSIVELAKSGRGFNA

SEQ ID NO: 47000 - protein, 325 aa, Solanum tuberosum
MAGEKIGIAKDVTELIGNTPLVYLNNVVDGCVARVAARLESMEPCSSVKDRIGYSMITDAEEKGLIKPGESVLIEPTSGNTGVGLAFMAAAKGYKLIITMPSSMSLERRIILRAFGAELVLTDPAKGMKGAISKAEEIKAKIPNSYILQQFENPANPKIHYETTGPEIWKGSNGKVDALVSGIGTGGTITGSGKYLREQNPNVKLYGVEPVESAILSGGKPGPHKIQGIGAGFIPGVLEVNLIDDVVQVSSEESIEMAKLLALKEGLLVGISSGAAAAAAIKVAKRPENAGKLIVVIFPSFGERYLSSVLFETVRREAENMTVEP

SEQ ID NO: 47001 - protein, 113 aa, Triticum aestivum
  misc_feature (56)..(56): Xaa can be any naturally occurring amino acid
  misc_feature (73)..(73): Xaa can be any naturally occurring amino acid
  misc_feature (86)..(86): Xaa can be any naturally occurring amino acid
  misc_feature (102)..(102): Xaa can be any naturally occurring amino acid
MDSSRRPSGIQQLLAAEQEAQQIVNAARAAKTARLRQAKEEAEREIAEYRAQMGGXIFQRKSLETSGDSGRKXVNALEQETNVKIXQLKQQAANISPEVIQXMLLKHSQLVKN

SEQ ID NO: 47002 - protein, 444 aa, Yersinia pestis CO92
MSTDDQKVGLIPVTLMVAGNIMGSGVFLLPANLASTGGIAIWGWLVTIIGALALSMVYAKISSLDDSPGGSYAYARRAFGPFLGYQTNVLYWLACWIGNIAMVVIGVGYLSYFFPILKEPMVLTITCVVFLWIFVGLNIIGPKMITRVQAVATSLALIPIVGIALFGWFWFKGETYMAAWNVSGLGTFGAIQSTLNVTLWSFIGVETASVAAGVVKNPKRNVPIATVGGVLIAAVCYVLSSSAIMGMIPNAELRLSASPFGDAARLALGDTAGAVVSLCAAAGCLGSLGGWTLVAGQTAKAAADDGLFPPIFGKVNKAGTPVAGLLILGVLMTIFQISSISPNAAKEFGLVSSVSVIFTLVPYLYTCSALLLVGHGHLGNQVKTYVGITLIAFVYCIWAVVGSGAEEVMWSFVTLMVITALYTFNYNRTHKNPFPLDAPVKNGQ

SEQ ID NO: 47003 - protein, 331 aa, Yersinia pseudotuberculosis IP 32953
MTIKVGINGFGRIGRIVFRAAQERSDIEIVAINDLLDADYMAYMLKYDSTHGRFDGTVEVKDGHLVVNGKTIRVTAERDPANLKWNEVNVDVVAEATGLFLTDETARKHIAAGAKKVVLTGPSKDDTPMFVMGVNHKAYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLEKPASYKEICAAIKAASEGELKGVLGYTEDDVVSTDFNGEKLTSVFDAKAGIALNDNFVKLVSWYDNETGYSNKVLDLISHISK

SEQ ID NO: 47004 - protein, 359 aa, Corynebacterium glutamicum ATCC 13032
MANTSSDWAGAPQNASADGEFVRDTNYIDDRIVADVPAGSEPIAQEDGTFHWPVEAGRYRLVAARACPWAHRTVITRRLLGLENVISLGLTGPTHDVRSWTFDLDPNHLDPVLQIPRLQDAYFNRFPDYPRGITVPALVEESSKKVVTNDYPSITIDFNLEWKQFHREGAPNLYPAELREEMAPVMKRIFTEVNNGVYRTGFAGSQEAHNEAYKRLWVALDWLEDRLSTRRYLMGDHITEADIRLYPTLVRFDAVYHGHFKCGRNKITEMPNLWGYLRDLFQTPGFGDTTDFTEIKQHYYITHAEINPTRIVPVGPDLSGFATPHGREKLGGSPFAEGVTLPGPIPAGEEVKNPEPFQK

SEQ ID NO: 47005 - protein, 247 aa, Triticum aestivum
LVGACTSPPVFCVITEFLSGGSLRSFLHKQEHRSLPLDKIISVGLDIAHGMGYVHSQGIVHRDVKPDNIIFDGECCAKIVDFGIACEEAYCDPLANDPGTFRWMAPEMMKHKPYGRKVDVYSFGLILWEMLTGSVPYEDLTPFQAAFAVFDKNVRPAIPGTCPAALRVLIEQCWALQADKRPEFWQIVQLLDKFKMVLERDGTLDNMPSSNCQESHDPKKWLAHWLHKLKHPHHHHDLSGPPPPKLL

SEQ ID NO: 47006 - protein, 463 aa, Corynebacterium diphtheriae NCTC 13129
MNNQQPRHYDLIIVGSGSGNSIPGPEFDDKSIAIVEKGKFGGTCLNVGCIPTKMFVYASEIAQVIVDSERFGISASIDSVQWPDIVERVFAHRIDPIAASGEEYRRGDKTPNIDVYDQHARFIAPKTLQIGDGENAPIISGDTIVIATGSRPFIPSYIEESKVTYYTNETIMRMPDLPRSMVVLGGGYIAMEFAHVFSALGVNVTVVNRSPQLLRVLDEDISHRFTEITKTKMDCRLGRTVSSVDQDSNGVTLTLDDGSTATGEVLLVATGRIPNGDQMNLDSAGIDMDGKRIKVDDFGRTTADGVWALGDVSSPYQLKHVANAEMRAVKHNLLHPEDLKSMPHQHVPAGVFTHPQIATVGLTEQEARDAGYSITVKIQNYGDVAYGWAMEDTQHFAKLIADKKTGRLLGAHFIGPQASTLIQQLITVMAFDLDVREVATKQYWIHPALPELTENALLGLDFS

SEQ ID NO: 47007 - protein, 389 aa, Campylobacter jejuni subsp. jejuni NCTC 11168
MLTKRSQVLEESITLAITALANELKAKGEDIISFSAGEPDFDTPQTIKNAAISAIEKGCGKYTAVAGIPEVLKAIQTKFKKDNNLDYETNEIITNVGAKHSLFECIECLVEKDDEVIIPSPYWVSYPEMVKFAGGKPVFIEGLEENGFKITAEQLKKAITAKTKVLMLNSPSNPVGSIYSKEELTQIAKVLEGTQITVLSDEMYEKLRYDGFDFVAFASVSKDALKRTVTINGLSKCGAMPGWRFGYMASKNKALISAVKRLQGQSTSNICSITQHAAIPALNGECDKDIEKMRQAFEKRRNLALDILKQIPNISVYKPEGAFYLFVNIQKIEKDSMKFCQKLLEQEKVAVVPGVGFGMDGYFRLSYATSDELIKKGLERIANFIKNYK

SEQ ID NO: 47008 - protein, 130 aa, Picea sitchensis
MAGEVPKEVPKVPSSDPPTTQNNGNNNSGVWKQAYYPNPPESGGNWKQAQYPNPPDRHIPDPSTLKEQWKFAIRQYSRWYSQAWGTAILAGVSFFALGWFIKGSNPLPSLSTSKNNENNNNGDNKPRPTS

SEQ ID NO: 47009 - protein, 294 aa, Corynebacterium diphtheriae NCTC 13129
MAITREPLKPGHPTPIREVPAYIDRPEYVWKDEVQEAIGEPFIQTPETIEAMREASKIAANALHVAGAAVAPGVTTDEIDRIAHEYMCDHGAYPSCLGYRGFTKSSCVSLNEIVCHGIPDTTVIQDGDIVNIDITAYKNGVHGDTNATFLAGNVSEEHRLLVERTYEATMRGIRAAKPGREINVIGRVIESYAKRFGYSVVTDFTGHGIGTTFHNGLVVLHYDSDAYRDVLEPGMTLTIEPMINLGGLDYRIWEDGWTVQNTDFKFTAQFEHTLVITDDGNEILSIPDDDVKVF

SEQ ID NO: 47010 - protein, 212 aa, Campylobacter jejuni subsp. jejuni NCTC 11168
MNFWGIIKEDFSQPKAQDPAFNSCIELFFNYPGVWAVVNYRFAHFFYIRNFKRIARMISGISQFLTGVDLHPGAELGRRIFIDHANGVVIGQTAIIEDDVLIYQGVTLGGTSLEKGTKRHPTIKKGVIIGSGAKVLGNITIGENAKIGSNAVVVKDIGANLTAVGIPAYIIEERKNKNIRAIDANCDDKLEKLEKKILELENLILKQPESQK

SEQ ID NO: 47011 - protein, 250 aa, Bordetella bronchiseptica RB50
MAAQRRGAYERYRMTEVDSMPHRLAAIQARIKAACERSARPPESVALLPVSKTFPVEAIRHAAALGLRRFGENKTQEIRHKAPELADLDLQWVMIGHLQTNKAKDVARDVAEVQSLDRLELADALQRRLEMEARSLDVLVQVKTSPEPSKYGLAPELLPGFLRTLVSDFPALRVQGLMTMAVNDEDPQAVRACFRLLRELRDRARDSVPGVALDRLSMGMSGDFEIAIEEGSTEIRIGSALFGARPASAP

SEQ ID NO: 47012 - protein, 322 aa, Oceanobacillus iheyensis HTE831
MTTNTQEINFQQQELKGRDFLTLADYTKDEINYLIDLADYLKKQHKDGVIFEPLKGKTLGMIFEKSSTRTRVSFETGIYQLGGLGIFLSSKDIQIGRGETIADTAKVLSGYLDGIMIRTFAQEDVEELAKHASIPVINGLTDLYHPCQVLADLQTIKEVKGKLHGVKLVYIGDGNNMTHSLMLGAAKTGMHMVAVTPDGYTPNKEVLTKAKSIANQHGAIIEWTSDIATAVQEADVIYTDVWASMGQEEEQQQREKDFENYQVNESLLEKAKTDVIFMHCLPAHRGEEVTAGVIDGKQSVVFQQAENRLHAQKALMTALMAD

SEQ ID NO: 47013 - protein, 158 aa, Vitis vinifera
MAQKTEKEETEFKVPETLALCVNNCGFTGNPATNNMCQKCFSASASAAAAAAAGALKSSHKLRERMDSLAETSLDRTKDAASAAAVEEVGKVKREVNRCSGCRRKVGLTGFRCRCGDLFCAEHRYTDRHECSYDYKTAGREAIARENPVVKAAKIVRV

SEQ ID NO: 47014 - protein, 379 aa, Arabidopsis halleri subsp. gemmifera
MSTTGQIIRCKAAVAWEAGKPLVMEEVEVAPPKKHEVRIKILFTSLCHTDVYFWEAKGQTPLFPRIFGHEAGGIVESVGGGVTDLQPGDHVLPIFTGECGDCPHCHSEESNMCDLLRINTERGGMIHDGESRFSINGKPIHHFLGTSTFSEYTVVHSSQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 47015 - protein, 403 aa, Coccidioides immitis RS
MSFTTMLNKLQGQPESYEKKAQYKFGRTLGAGTYGIVREAEGPNGKAAVKIILKKNVKGNEQMVYDELDMLQRLHHPHIVRFHDWFESRDKYYIVTQLATGGELFDRICDYGKFTEKDASQTILQVLDAVNYLHERNIVHRDLKPENLLYLTRAQDSQLVLADFGIAKMLHSPSEVLTNMAGSFGYAAPEVMLKQGHGKAVDMWSLGVITYTLLCGYSPFRSENLQDLIDECRSGHIVFHERYWRDVSKDAKDFILALLQTDPTKRATSAEALQHRWLKGETATDHNLLPELKAYMAKARLKRGIEIVKLANRIEALKMQGEDDDDIPSAIPDNTTPSSNSGPADQTSPVTAPTNKKRSLSRAAKSAIFREVVLAKVREMRQEEQKEKVEKEALERAEKEKHK

SEQ ID NO: 47016 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPDCHSEESTMCDLLRINTERGGMIHDGESRFSINGKPIHHFLGTSTFSEYTVVHSGQVAKINPDAPLDKVCIVSCGLSTGLGATLNVAKPKKGQGVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEIKKAFDYMLKGESIRCIITMGA

SEQ ID NO: 47017 - protein, 157 aa, Coccidioides immitis RS
MFANKRLGKELLKMQSSLPPGISIVNADNFHEWEMDIQVLDSNPLYQNDTYRLHFTFTRNYPIEAPEVIFISLPQSSPTPRRIPIHPHVYSNGIICLDLLGSTGWTPVQTVESVCMSIQSMLTGNTRNERPPDDGDFPPGSRPRPRDLLFEYDDDGV

SEQ ID NO: 47018 - protein, 498 aa, Coprinopsis cinerea okayama7#130
MATDFWASSHYTRWIVNRAVLKQARADDLVYVSDPEHLDFLAIYFANIITRLGKKLQLRQRVIATATVFFRRFYLKNAYCETEPFLVISACIYVAAKAEESPVHIKNVIAESRSLFSHHYGVKNFPSDNSKLAEMEFYLVDDLESDLVVYHPYRTLLALCRTSSGEDSDGEEGEEGEEEEAGELGGNHGAGVGIDKGSRYWGTGEGKLVLSKEALQIAWSIINDTYRSELCLLYPPHLIAIAALYLTFILHPPDRTSSTDTADSHEDEKRQPRRSSRQAHHHHAPKPPAKNPDPITFLAQLNVSLPLVATIAQEIISLYTLWERYKEDGAADAPVAGLASSSSKKSIASRSSSHTDLKAGLLSSKGKPRSGVHVTSVSSETTIPVRSSLERESQSALALPSAPAPAPITTAFLSQILLDMRESRLLDLAYGGEGELLGLPPSMASSVALPGPGGVPLGGLHAHDQGSGTSSAASSVMTGVSMNQQYHLNRVLGMNAYG

SEQ ID NO: 47019 - protein, 379 aa, Arabidopsis halleri subsp. gemmifera
MSTTGQIIRCKAAVAWEAGKPLVMEEVEVAPPQKHEVRIKILFTSLCHTDVYFWEAKGQTPLFPRIFGHEAGGIVESVGEGVTDLHPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKGFDYMLKGESIRCIITMGA

SEQ ID NO: 47020 - protein, 511 aa, Glycine max
  misc_feature (306)..(306): Xaa can be any naturally occurring amino acid
MYRNAASRLRAIKARSCSSSSRVPASARFASSVATQQSSSSGLGGLFGWLTGDRTSSLPSLGFPLPGVTLPPPLPDYVAPGKTIITTLPNGLKVASETSPSPTASIGLYVDCGSIYESPISFGATHLLERMAFKTTRNRSHFRVVREVEAIGGNVQASASREQMGYTFDALKTYVPEMVELLVDCVRNPVFLDWEVNEQLLKVKAEIGEASKNPQDLLLEAIHSAGFSGALANPLLASESALNRLNGTILEEFVAENYTAPRIVLAASGVEHEELLSVAEPLLSDLPSVPRLEEPKSVYTGGDYMXHSESGRTHFALAFELPGGWHKLKDAMILTVLQMLLGGGGSFSAGGPGKGMYSRLYLNVLNEYPQVHSISAFNNIYNGTGIFGIQVTTGSDFVSKAIDIAANEILAVATPGQVDQVQLDRAKQATKSAILMNLESRMVVSEDIGRQILTYGERKPVEDFLKAVDEVTSKDITSISRKLICSPLTMASYGDVLYVPSYESVSLKFRA

SEQ ID NO: 47021 - protein, 230 aa, Coprinopsis cinerea okayama7#130
MSSLTPEAPKPPCAPPQPANASNTNLAHLNPLPPSVFTLPQTAQLEALYTIIRDKETSRGDFLFYSDRIIRLLVEEGLNHLPVVKRTVETPTGATYEGVGFEGKICGVSILRAGEAMEAGLREVCRSVRIGKILIQRFPPDIASRYVLLLDPMLATGGSAIKAVEVLIEHGVPEERIIFINLISSPEGLTAFTSRFPSLKVITGWIDQGLNEKAYIIPGLGDFGERRYCT

SEQ ID NO: 47022 - protein, 699 aa, Oryza sativa Japonica Group
MSPDADAAAAAAAGGEGAAAAGVGTAGEGRGVIRWDQILPRRSLRVLLVEHDDSTRQVVTALLRKCGYRVAAVADGMKAWGVMRERAYAFDLVLTEVTMPTLSGIELLSRIVASDECKNIPVIMMSSQDSIGTVLRCMQKGAVDFLVKPVRKNELRNLWQHVWRRHAMNSQTNASENNAASNHLSANGGNGSKTGEHSDEESDAQSSGSKREVEIQSAEKLPEVVADGGAGSSREHKIQNGFIDGMNTKSHALKGNDDAPSGNACGDSELQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRKDSLTHPSYGFIPVPIPVGAAIPYHYGAIMQPMYYPQGAFMHCDSAAINKTAIQHVSCQSNYHENLGKPPQIDEHKQPEENHQLHHSRQILRESGEPVDLAKAHMERINQSASCSQDIRKGSGCTGSGETDANTNTVIALESGNESGVQNCSNNVLDGDRSRREAALLKFRMKRKDRCFEKKVRYHSRKKLAEQRPRVKGQFVSQKLKSAITTEAETD

SEQ ID NO: 47023 - protein, 377 aa, Oryza sativa
MASSSRVRVGNLVPLNEGNASSSNGSVSSIPIYLGANVVGRNHLVVVDKRVSRKHLSLHASADGSIEAVVEGPNPIIVRSEGQRRKVCAQERVKIAHDDVLELIPGEYFVKYLNVGDNHKSSTSMGSSDFKKGKRLCEDDTVVIKRNRQIMEDEALARSLQKSFAEESSTISGLGCDQMLSSLDSAGSSERNNERIHSVDYLKDVLSLTFRLMRVQGLPSWTNTSSVTIQDVIQGEVLLAVLSNYMVDMEWLLTACPSLRKVRHVLVIHGEDGASVELLKKVKPANWILHKPPLPISFGTHHSKAMLLVYPQGIRVVVHTANLIHVDWNNKTQGLWMQDFPWKDAKDVNRSVSFENDLVDYLSAIKVAASRALVFAS

SEQ ID NO: 47024 - protein, 353 aa, Mycobacterium tuberculosis CDC1551
MKTTDVRVRRAITAMAGGHAVVLTGDPNGDGYLVFAAQAATPRLVAFAVRHTSGYLRVALPGAECERLHLPPMCDRDTTHCVSVDVRGTGTGISASDRAWTIAALASATSVAADFQRPGHVVPVQAQADGVLGRRGPAEAAVDLARLAERRPAAALCEIVSPDNPVQMAHHAESVEFAVEHGLAMVSIGELVAYRRRIEPQVVRFTAATLPTWAGASRVIGFRDVYDLGEHLAVIVGAVGAGVPVPLHVHIECLTGDVFGSTACRCGEELNGALARMSAQGSGVVLYLRPPGPAQACGLFARGDAATDVMPETVTWILRDLGVYAIRLSDDVPGFGLVMFGAIREASTLAAAG

SEQ ID NO: 47025 - protein, 412 aa, Rickettsia akari str. Hartford
MKENFNVSKLKNGLTILTYNMPYVNSVAINLIAKVGARYENAEEEGISHFLEHMAFKGTKTRTAKQIAEEFDSIGGHFNAYTGHENTVYYVRVLSENCDKAVNILADIIQNSIFADEEIAKEYQVIMQEIAHHQDNPDDLVYEKFYNKVYRDQPLGKLILGTTKTIAAFTQEHFLTFIGKHYNAENLYLSIAGNIDHDKIVIIAEQLFSSLKQGVKSSFIPAKYIGGNGFIHKELEQTSLVLGFEGTSYINLEKLYQTHLLSIIFGGGMSSRLFQTIREKLGLAYAVGSYNSAYFDSGVFTIYASTAHDKLELLYREIKNEIIKMTETVSAEEIIRAKTQLRSNLQMAQEKNAYKSEEIGKNYSVFGKYISPEEIMEIITNIKTDDIINTANKIFSGTTTSAIIGPNGLREV

SEQ ID NO: 47026 - protein, 372 aa, Mycobacterium chelonae
MPVTWLVRKEREESALSTSVLISGGAGFIGSALSNRLVQAGYDVAVMDVLHPQVHARGRDIDLPPSVRLFTGDVTHAPDWDAVLRLFEPSQVVHLAAETGTAQSLSEATRHGSVNVVGTTQLLDALSRAAFVPDQLVLASSRAVYGEGAWQSGTEVFYPRPRSHAQLLAGRWDPKGPTGESSEPLASCASRTEPRPTNIYAGTKLAQEHLLASWAAAHDTNLSVLRLQNVYGPGQSLTNSYTGIVTLFARLAREKQSLEVYEDGRIVRDFVFIDDVVDALFAAVHTPAVERRTLDIGSGTATTIHELARKVAEICAAPEPTVVGKFRDGDVRAASCDVEPAIEQLAWSPKWTLEDGLHALLEWIDKDCPNRF

SEQ ID NO: 47027 - protein, 615 aa, Debaryomyces hansenii CBS767
MHTKKLAELPKTTSFTKYISPDGRIPKPEDAMANKDNIIHVPRVLQKGGFSWSLPEKRAKYRYLTSSDKALNDLGIDSKEVENPEYQKLVTGEFYLNKEDFQKKGYPFPYSQAYAGWQFGQFAGQLGDGRVVNLFEVPKNVPDKNNRHKYELQLKGAGMTPYSRFADGKAVIRSSIREYIISEHLNAVGIPTTRALSLSYLPETFAQRHRAEKCAIVSRFAELWVRLGTFDLYRWRSDRDGIKELSDYVINELFTIDGEKFGFLNKVLSERNDFFDSSKETIGELTDYDKMYLETIVRNASTTAIWQSYGFLNGVLNTDNTSVLGLSIDFGPFSIMDKYDPNFTPNSEDHELRYSYRNTPTAIWWNLTRMGENLAELIGAGSEILNDQFFKENGIKKEWEDRIITRATKLIEAGGELYQYAFTKKYVETIFNRLGLESSLINAKDPEVNHKELIDPMLDMLYKVQCDFNKFFLILQSSNLESGYDPKQIAETILLPGHNALESKYSTQELIDEICNWLKIYDGYLSKSGNAKRKSISKYYNPLFLPRNWILNQVIEFTEEHNAEDLSYLKKLEKMCFNPYDKSKWGNELKELEQEWLLQSDIGADYSMLQCSCSS

SEQ ID NO: 47028 - protein, 454 aa, Pseudomonas fluorescens Pf-5
MKISVFGSGYVGLVQAAVLAEVGHDVICMDIDEQKVKQLQQGHVSIFEPGLASLVKENLEAKRLHFTHDEKLAVQHGQVLFIAVGTPSSEDGSADLRYVLSVGDAVARHREQPVILVEKSTVPVGTGDTLKAHIEKVLDGRALQFDIVSNPEFLKEGSAVTDCRRPDRIIIGCEREEVRDVMRDLYAPFNRNHDRIMFMDLRSAELTKYAANCMLATKISFINQIAELAEHLGADIEAVRLGIGADTRIGYHFIYPGCGYGGSCFPKDMRALIHSAQQAHCSSDLLQAVEAINERQKHKLFERIKAFYKGDLKGKTFALWGLAFKPNTDDMRDAPSRVLLDALFAAGAQVRAFDPEAMQETQRLYPDESRLMLMGTPESVLVGADALVICTEWQQFKAPDFDLIQQRLKAPVIFDGRNLYDAERLARNGFTYFPIGRGESRNLPIPHQQWSAEA

SEQ ID NO: 47029 - protein, 605 aa, Vitis vinifera
MDTKISVTDASVPTNSNVGCPSNGIVSSILSSVPPSVISSSEATLGRHLARRLVQIGVSDVFSVPGDFNLTLLDHLIAEPGLKNIGCCNELNAGYAADGYARSRGVGACVVTFTVGGLSVLNAIAGAYSENLPVICIVGGPNSNDYGTNRILHHTIGLPDFSQEFRCFQTVTCYQAVVNNLEDAHEQIDTAISTALKESKPVYISISCNLPGIPHPTFSREPVPFCLAPKVTNQMGLEAAVEAAAAFLNKAVKPVMVGGPKLRVAKACEAFVELADACGYPVAVMPSAKGLVPECHPRFIGTYWGAVSTAFCAEIVESADSYIFAGPIFNDYSSVGYSLLLKKDKAILVQPERVVIGNGPAFGCILMKDFLKALSKRLKCNTTAYENYHRIYVPEGQPLRSDPKEPLRVNVLFQHIQKMLSSETAVIAETGDSWFNCQKLKLPKGCGYEFQMQYGSIGWSVGATLGYAQAVPNKRVISCIGDGSFQVTAQDVSTMIRCEQRTIIFLINNGGYTIEVEIHDGPYNVIKNWNYTGLVDAIHNGEGKCWTTKVVCEEDLINAIETATGSKKDCFCFIEVIAHKDDTSKELLEWGSRVSAANSRPPNPQ

SEQ ID NO: 47030 - protein, 172 aa, Corynebacterium glutamicum ATCC 13032
MANSDVTRHILSVLVQDVDGIISRVSGMFTRRAFNLVSLVSAKTETHGINRITVVVDADELNIEQITKQLNKLIPVLKVVRLDEETTIARAIMLVKVSADSTNRPQIVDAANIFRARVVDVAPDSVVIESTGTPGKLRALLDVMEPFGIRELIQSGQIALNRGPKTMAPAKI

SEQ ID NO: 47031 - protein, 337 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFLGDSRSSIFDAKAGIALNDHFVKLVSWYDNEWGYSNRVVDLIRHMFKTQ

SEQ ID NO: 47032 - protein, 418 aa, Prosthecochloris aestuarii DSM 271
MGFSSLNIIDPIARALREEGYATPTPIQAEAIPVILEGSDLLGCAQTGTGKTAAFAIPLLQLLSERNTYEKKRKIRALVVTPTRELAIQIGESFKAYGRHTGLTNRVIFGGVNQNPQAASLRNGVDIVVATPGRLLDLMGQGHLHLRDVEILVLDEADRMLDMGFIHDIRKILAALPEKKQSLFFSATMPSEIVRLAGTILHNPAKVSVTPVSSTVETIQQQVYFVDKGNKNRLLVHLLKDQSIKTALVFTRTKHGADKVVKFLLKHDITAEAIHGNKGQNARQRALNNFKKQSTRVLVATDIAARGIDVDALAYVINFDMSNMAETYVHRIGRTGRAGAEGTAISFCDAEEKAYLCDVEKLIAKKIPVIDRHPFPLTDLNPVKTVAPQGRGGSGRPGAKPSHKANSKRWSVNPRKAR

SEQ ID NO: 47033 - protein, 353 aa, Oceanobacillus iheyensis HTE831
MTWQGLLKEYADLLPVTDQTPSLSLMEGNTPLLSFPTLSKELGIELYGKFEGLNPTGSFKDRGMVMAVAKAIEEGSKSIICASTGNTSAAAAAYAARAGIRAIIVIPKGKVALGKLAQAVMYGAEIVEIDGNFDEALQMVRKISEKSAVTLVNSVNPYRIDGQKTAAFEVCDQLGSAPDILAIPVGNAGNISAYWKGFKEYNEKHQSGLPKMMGFEAEGAAAIVKNKVIEQPETVATAIRIGNPASWELALKAKEESNGSIGYVTDEEIVNAFKLLPQKEGIFAEPGSAASIAGVIQQVKSGTIPKGSKVVAVLTGNGLKDPQTAIDQLSIDPVSLPNNEKAVMDYLEELITS

SEQ ID NO: 47034 - protein, 272 aa, Oryza sativa Indica Group
MARRRVAALASQLLRRQLLMRRPPPRFLSSAAAAASGPLDRLRSPPFARTAARHGSPALSPWSRFGGQKRGMFIQTQSTPNPQSLMFYPGKPVMEVGSSDFPNARTAMTSPLAKALFAIDGVTRVFFGSDFVTVTKSEETSWDYLKPEVFAAIMDFYSSGQSLFLDSSTAASMDTAIHEDDSEIVAMIKELLETRIRPAVQDDGGDIEYRGFDPETGIVKLKMQGACSGCPSSSVTLKSGIENMLMHYVPEVKGVEQELDGDEEAELTGQLE

SEQ ID NO: 47035 - protein, 284 aa, Thermotoga maritima MSB8
  misc_feature (15)..(15): Xaa can be any naturally occurring amino acid
  misc_feature (17)..(17): Xaa can be any naturally occurring amino acid
  misc_feature (47)..(47): Xaa can be any naturally occurring amino acid
  misc_feature (67)..(67): Xaa can be any naturally occurring amino acid
  misc_feature (100)..(100): Xaa can be any naturally occurring amino acid
  misc_feature (129)..(129): Xaa can be any naturally occurring amino acid
  misc_feature (134)..(134): Xaa can be any naturally occurring amino acid
  misc_feature (145)..(145): Xaa can be any naturally occurring amino acid
  misc_feature (160)..(160): Xaa can be any naturally occurring amino acid
  misc_feature (175)..(175): Xaa can be any naturally occurring amino acid
  misc_feature (191)..(191): Xaa can be any naturally occurring amino acid
  misc_feature (193)..(193): Xaa can be any naturally occurring amino acid
  misc_feature (197)..(197): Xaa can be any naturally occurring amino acid
  misc_feature (199)..(199): Xaa can be any naturally occurring amino acid
  misc_feature (204)..(204): Xaa can be any naturally occurring amino acid
  misc_feature (216)..(216): Xaa can be any naturally occurring amino acid
  misc_feature (235)..(235): Xaa can be any naturally occurring amino acid
  misc_feature (240)..(241): Xaa can be any naturally occurring amino acid
  misc_feature (246)..(246): Xaa can be any naturally occurring amino acid
  misc_feature (253)..(253): Xaa can be any naturally occurring amino acid
  misc_feature (260)..(260): Xaa can be any naturally occurring amino acid
  misc_feature (275)..(275): Xaa can be any naturally occurring amino acid
  misc_feature (278)..(278): Xaa can be any naturally occurring amino acid
MGSDKIHHHHHHMKXEXVEERIREILRPGWDLLTEEAMLYSATVGGXRIRPLLVLTLGEDLGVEEEXLLDVAVAVELFHTASLIHDDLPPIDNADFRRGXPSCHRTYGEDIALLAGDGLFFLAFSQISXIGNSXIFEEFSETAYXLLLGEAMDVEFERRXMEVSQEMVERMYAFXTGALFAFCFSAPFILXGXDHTXMXLLGEXFGVAFQIYDDLXDILGSFEKVGKDLGKDTEXVTLVXXVGIQXAREMADXYYEEVLXGIESEGLFRTLFLLXELXQMVEER

SEQ ID NO: 47036 - protein, 265 aa, Picea sitchensis
MEMEGGDYEEHPPAPLLDSLELKLWSFYRAVIAEFVATLLFLYITMTTVVENKQSKGTCGGVGLLGEAWAFGGMIFVLVYCISGISGGHVNPAVTFALFLARKVSLPRAVLYVVAQCLGAVCGTALVKGIQGSFYASNGGGSNSVSPGYSKGTALLAEIIGTFVLVYTVFSATDPKRKARDSHVPVLAPLPIGFAVFLVYLATNSITGTGINPARSFGPAVIYGHKKPRDDLWIFWVGPLIGAAVATAYHRYLLRAGAFGSKNLG

SEQ ID NO: 47037 - protein, 475 aa, Idiomarina baltica OS145
MSDKIKAQVVVLGSGPGGYSAAFRAADLGLETVLVERYSTLGGVCLNVGCIPSKALLHLAKHIEDAKVLANEGVEFGEPKIDLDKIRKHKEKVVGQLTGGLGQMSKMRKVKVVNGYGKFTSSNTLNVEGEDGNTEIEFENAIIAAGSQPIKLPFIPHDDERIWDSTDALELKEIPEKMLLLGGGIIALEMGQVYSSLGSKVDVVEMTDQLVPPADADIMKSFNKQVKGRFENVMLSTKATKVEAKKDGIYVTFEGKGAPEKPVKYDVVLTAVGRAPNGKKIDADKAGVKVTEQGFIEVDSQMRTNVDNIFAIGDIVGQPMLAHKAVHESHVAAEVIAGKKHFFEPKVIPSIMYTDPEVAWAGVTEKEAKEKGIEYEAVTFPWSASGRAIASNAQQGMTKLIFDKNNRIIGGSMCGSNAGELLGEVCLAIEMGCDAEDIALTVHAHPTLHESVGLAAEIQEGSITDMPNPKAKKKK

SEQ ID NO: 47038 - protein, 274 aa, Oceanobacillus iheyensis HTE831
MSRQATLDKEAMKVLKETSRTFYIPIKLLNKTLRKTVGSAYLCMRAIDEMEDHEALDSSSKQELLIQTSQLLQAETFDNVAYQSLIDPYRDILPEVTIRLNDWLLFCPSDIVTQVKSSTSEMAEGMAKWVARDWEVNTKEDLDEYTYYVAGLVGVMLSDIWKWYDGTETDRELAIGYGRGLQAVNILRNIDEDAERGVGFFPDDWTKKEMFEYANMNLHMGEQYMEQISTKNILLFCRIPLALAQKTLTALEKGKEKISRDEVENTVDHIINSK

SEQ ID NO: 47039 - protein, 580 aa, Idiomarina baltica OS145
MADKIELKVPDVGGEEVEVIEILVSAGDTIEKEDGVVTVESDKASMDIPASEGGKIVELKVKEGDTIKEGDVLAIIEAASDDSTDDDDDSDDDKAEDTTEESSSDDSSSDAPEDDDDAQDDQEQEAASGGESEVIDVEVPDIGDEEDVEIIEILVNKGDSVEKEDGLITLETDKATMDVPCPEDGEVEEMLVKVGDKVSQGSKIAKLKVTRSGGSSSSTKDESKSASKSEDKAEQAPSKSESDDKASAKSNSTPTSERQPPVPDHPTERKDGSPIHASPAVRRVAREFGVDLSQVKGTGPKSRILKEDVQEYVKYELSRPKAVAGQTSQGGGGLQVIDGPKVDFSKFGEVEEVQLSRIQRKSGPNLHRNWVTIPHVTQFDEADITELERFRKSENEVAKKQDLGFKITPLVFIMKACAKALREFPNFNSSLSESGEALIMKKYVHIGIAVDTPNGLVVPVIRDVDKKGIYELSEELVDVSARARDGKLKAADMQGGCFSISSLGGIGGTAFTPIVNAPEVAILGVSRNEMKPKWNGKEFEPKLMLPLCLSYDHRVIDGADAARFTAYLSQVLGDIRKLVL

SEQ ID NO: 47040 - protein, 328 aa, Bradyrhizobium sp. ORS278
MGLLVDGQWHDVWYDTAASGGRFVRKDSAFRSFVTSDGSPGPTGSGGFKAEAGRYHLYVSLACPWAHRTLIMRTLKGLEGMISVSVVHWLMRERGWTFAEGPGVVADEINHAEVLHQVYTAADPHYSGRVTVPVLWDKAQRTIVNNESSEIIRILNAAFDGIGAKPGDHYPQALRGEIDAINARVYDTLNNGVYKCGFATTQAAYEEAIGPLFATLDWLDERLAMRRFLLGDAVTEADIRLFTTLIRFDAVYVGHFKCNIRRIADYPNLSAYTRDLYQWPGIAETVNFQHIKGHYYESHRTINPTGIVPLGPQQDFTAPHGRARLATS

SEQ ID NO: 47041 - protein, 938 aa, Magnaporthe grisea 70-15
MKKANGAGLAADSTTRSGTSRSRMNSTANNINNNNNNNNNNNNGNNPNDTSFRSERERHNARYKEASPQPDSQSNSQTSHGYAQTSHKRSASGNLRPVSKLEERRTEKVKVTTRETVVSRTRSPDRRGVQPPHREQRGSDLGKHRVATELRPKDNRPEQPQTVWEPEASLLPLTTAPLASRISIPPLASHQPAALQPRPLYELPLAAQEALILEDLLYVFMGIEGQYIRYAKVYNPNEERDRLTGPTFRILPGLDPSLQDLTASMLRMATHYSALMEFVDVQSRDEFGTVNHALCASIRKLLQDYLVLIAQLETQFLTDDGFTLQVLNIHLLPTSHMMLQLHGLAHELLKKNALLDDESDESSDDDDPNDYDKIVNQLREGGDIIPGNMGGKKISKGGAVLGIITSRLDTMSGDPAARALLTTLLKDASRPYMAMLNEWLHHGAINDPHAEFLVKEQRSIRRDRLEQDYTDEYWERRYTIRDQDVPPQLQGLKDKVLLAGKYLNVVRECGGVDVSKQVKDVPLTFDDPRFLDNVHNAYAHANESLMQLLLTAHSLPARLGSMKHYFFLDPSDYFSYFLELGAAELKRPVKSVNTSKLQSLLDLVLRQPGTVVSLDPFKEDVKVEMNEVPLIKSLQRVVNITGLDVGETFQPSTSMPSETDKSAIGFNCLQLDYAVPFPVSLVISRKTVWRYQALFRYLLSLRHLESLLSNHWQAHNQWALWTRRSSSHRIEVFKRRVLTLRARMLVFVQQLLYFCTAEVIQPNWHKFMQSLEKKEGAKGLTRTVDELMQDHVGFLDTCLKECMLTNSKLLKINAKLMHTVLLFATYSRWFNQELKKADPDLAGPTKPAGMSDRDWALIQALPTESKSSSGGEKPRDNMFEILAKWEVNFSRHLHIMLDSLNHYAATETVVLLSLCARLSAASEGIETPGAREPDNDST

SEQ ID NO: 47042 - protein, 379 aa, Arabidopsis thaliana
MSTTGQIIRCKAAVAWEAGKPLVIEEVEVAPPQKHEVRIKILYTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 47043 - protein, 657 aa, Coccidioides immitis RS
MAPHPGLEADHIKEKSKKDLLDLLEAVRGKKNLVISKALAGPVGVFVKFSVLQEYGVDRVFLLENENVDSSQRNIIFLVNAEKPSHVQFVSAQIRKLQRNDTVEHEFSIFWVPRRTLVSDRILEEEGIIGDVNIAELPLYFFPLENDLLSLELPESFSDLYLHRNPGAINLSAKALMQFQRRHGLFPRIVGKGDNARKLADQLLRMRKELDAEESSGLVDRLGRGLMVSSTMENLIIIDREVDFATVLMTQLTYEGLVDEFFGISNNQTEVDSTIIGVGPPGQASQGSASGASSAPKQSLKRKIQVDSSDPLFSQLRDANFAIVGGLLHKVARRLESDYESRHGAKTTSELREFVNKLPAYQAEHTSLKIHTNLAEEIMRQTRSDVFRRILEVQQNIAAGADPATQHDLIEELIARDVPIASVLRLLCVESCVCGGFRPRDLDNFKRQILQAYGYQHLLTLDALEKMELLQSRSSATAMILPTGGGGGGASGLKTNYNYLRKALRLIVDEVDEQNPDDIAYVYSGYAPLSIRLIQCILQKSHILSLTKSLPAPAAAASGGTPSPGWLGFEDIVKSARGSTFNIVQKAEEKVTRAKQTLTGAGGIKTVFIFFLGGITFTEIAALRFIAQQEAARRRIMICTTGILNGTKMMEAAIEKS

SEQ ID NO: 47044 - protein, 539 aa, Beta vulgaris
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAAGSYSRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGFKGGALAIFSVLGIPLAITFSIPFALASIFSASSGSGQGLSLGVLNLAIVVPQMFVSVTSGPWDALFGGGNLPAFVVGAVAATASAILSFTLLPSPHRKPKSEGQWVAIKNKEAVLIFNFLFFI

SEQ ID NO: 47045 - protein, 391 aa, Triticum aestivum
  misc_feature (95)..(95): Xaa can be any naturally occurring amino acid
  misc_feature (108)..(108): Xaa can be any naturally occurring amino acid
  misc_feature (114)..(114): Xaa can be any naturally occurring amino acid
  misc_feature (130)..(130): Xaa can be any naturally occurring amino acid
  misc_feature (152)..(152): Xaa can be any naturally occurring amino acid
  misc_feature (167)..(167): Xaa can be any naturally occurring amino acid
  misc_feature (199)..(199): Xaa can be any naturally occurring amino acid
  misc_feature (273)..(273): Xaa can be any naturally occurring amino acid
MASATLLKSSFLPKKAEWGVARQVAAPRVSMVVRAGAYDDELVKTAKTIASPGRGILAMDESNATCGKRLDSIGLENTEANRQAFRTLLVSVPGXLGNHISGAILFEXETLYQXSNVDGKKIVDILVEQXSVPGIKVDKGLVPLTGSNDESXARGLDGLASREGGLXYRQGARFAKWRTVVSIPNGPSELAVKEAAWGXLARYAAISQDNGLVPIVEPEILLDGEHGIERTFKVAQKVWAETFYQMAQNNVMFEGILLKPSMVTPGAKCKDRXATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 47046 - protein, 546 aa, Oryza sativa Japonica Group
MSAAQQLPASLRAALSYSLGVFALRRPLLHKVLDYEDEFFALLMAVLESHSLRTTDGSFSESLYGLRRRPVKVSVKRSSSGAESNDKAYDSVLRKRQKVLSVVFLVVLPYFKSKLQSIYNKEREARLQASLWGQGDVRFDEADLVSDQGETSQAQVEATTGEVSNMARIKKNFAALIGVCYPWIHATNEGLSFAYQLLYLLDGTAFYSPALHALGLHVCRATGQELMESSSRVSRIRNRELERLRGPPWLKTMQRVLLNCMYTSLDYAQTGLIAAVFFFKMMEWWYQSAEERMSAPTVYPPPPPPPLPKVAKDGLPLPPDRTLCPLCCQKRNNPSVLSASGFVFCYSCIFKSVSQSKPKPGAAWGTSLRKAYTFDTVEEFWGGYAVGISGGVDRGVLIIPMRAHSRMIRGLYDQIFRPSKVTVNADFHLFKAGVEPKWEDPECANGGKWTVPCSRKTTLENMWLETLMALIGEQFDESEEICGVVASVRQRGDKLALWTRTASNEAVQVNIGKKWKEIVDYNDKMVYSFHDDAKREKPSRGGRYNV

SEQ ID NO: 47047 - protein, 523 aa, Sulfolobus tokodaii str. 7
MSMYEKPPVEKLIEELRQLKEKAYKGGGDERIQFQHSKGKLTARERLALLFDDGKFNEIMTFATTRATEFGLDKQRFYGDGVVTGWGKVDGRTVFAYAQDFTVLGGSLGETHANKIVRAYELALKVGAPVVGINDSGGARIQEGALSLEGYGAVFKMNVMASGVIPQITIMAGPAAGGAVYSPALTDFIIMIKGDAYYMFVTGPEITKVVLGEEVSFQDLGGAVVHATKSGVVHFMVDSEQEAINLTKRLLSYLPSNNMEEPPYIDTGDPADRDATGVEQIVPNDAAKPYNMREIIYKIVDNGEFLEVHKHWAQNIIVGFARIAGNVVGIVANNPEEFGGSIDIDAADKAARFIRFCDAFNIPLISLVDTPGYVPGTDQEYKGIIRHGAKMLYAFAEATVPKITVIVRKSYGGAHIAMSIKSLGADLVYAWPTAEIAVTGPEGAVRILYRKEIQQASNPDDVLKQRIAEYRKLFANPYWAAEKGLVDDVIEPKDTRRVIVAGLEMLKTKREYRYPKKHGNIPL

SEQ ID NO: 47048 - protein, 395 aa, Triticum aestivum
WIQRWRPTVNEREFIEQALQSDLRVDGRRPFDFRPFDFRKLKIAFGREDGSAEVELGETRVMGYVTAQLVQPYKDRPNEGTLAIFTEFSPMADPAFEPGRPGEAAIELGRVIDRGLRSPDGCLVVLFLSKSLSVEFNEDSRWCHRESRAVDMESLCVVAGKHVWSVRVDLHILDNEGNLIDAANIAALAALSTFRRPECTVGGDDGQQVTVHDSEVRDPLPLTIHHLPIAVTFAYFGDGNIMVIDPTYKEEAVMGGRMTATINSNGDVCAIQKAGGEGVMSSVIMQCLRIASVKAADITSKIKTKVDKYTTDKALQKVKRTPALVAKEVDVPDVTMKESTHTALENQTSKAPNDGQQISEGDDDHQDTKMISPLTVDRTVKHKQTSTFVGGPSNW

SEQ ID NO: 47049 - protein, 125 aa, Triticum aestivum
DETKNRMMETKELFDWVLKQRCFEKTSFMLFLNKFDIFERKIQKVPLSACEWFKDYQPIAPGKQEVEHAYEFVKKKFEELYFQSSKPDRVDRVFKIYRTTALDQKLVKKTFKLIDESMRRSREGT

SEQ ID NO: 47050 - protein, 759 aa, Glycine max
  misc_feature (515)..(515): Xaa can be any naturally occurring amino acid
MTVTPKISVNDGKLVVHGKTILTGVPDNVVLTPGSGRGLVTGAFVGATASHSKSLHVFPMGVLEGLRFMCCFRFKLWWMTQRMGTCGRDVPLETQFMLIESKESETDGENSPIIYTVLLPLLEGQFRAVLQGNDKNEIEICLESGDNAVETDQGLHMVYMHAGTNPFEVINQAVKAVEKHMQTFLHREKKRLPSCLDWFGWCTWDAFYTDVTAEGVEEGLKSLSQGGTPPRFLIIDDGWQQIENKAKDATECLVQEGAQFATRLTGIKENTKFQKKLQNNEQMSGLKHLVHGAKQHHNVKNVYVWHALAGYWGGVKPAATGMEHYDTALAYPVQSPGVLGNQPDIVMDSLAVHGLGLVHPKKVFNFYNELHAYLASCGVDGVKVDVQNIIETLGAGHGGRVSLTRSYHHALEASIASNFTDNGCIACMCHNTDGLYSAKQTAIVRASDDFYPRDPASHTIHISSVAYNSLFLGEFMQPDWDMFHSLHPAADYHAAARAIGGCPIYVRFCIYDVFXSDKPGNHNFDLLKKLVLPDGSVLRAQLPGRPTRDSLFVDPARDRTSLLKIWNLNKCSGVVGVFNCQGAGWCKIEKKTRIHDTSPGTLTASVCASDVDLITQVAGAEWLGDTIVYAYRSGEVIRLPKGVSIPVTLKVLEFELFHFCPIQEIAPSISFAAIGLLDMFNTGGAVEQVEIHNRAATKTIALSVRGRGRFGVYSSQRPLKCVVGGAETDFNYDSETGLTTFSIPVSPEEMYRWSIEIQV

SEQ ID NO: 47051 - protein, 252 aa, Prosthecochloris aestuarii DSM 271
MRKKIVVGNWKMNKTIAEAVELSSAIIDQLGEVSASCEVGIAPAFPALSGVHGVISGTGIHLAAQNCHYEDDGAFTGEVSVRMLDEAGCSYVIVGHSERRQYFGDTNPVVNLKVKKALSAGLNVILCVGETLDEREKGITTEVVTCQVKEGLEGVADIGDIVIAYEPVWAIGTGKTASSLQAQEVHASIRATVAGLYSEPAAAGVRIQYGGSVKPSNAEELFAMPDIDGGLIGGASLNAEDFVAIVKAAEKS

SEQ ID NO: 47052 - protein, 514 aa, Solanum tuberosum
MDGTAVQGTSSVDSFLRNYKLGKTLGIGSFGKVKIAEHTLIGHKVAVKILNRRKIRNMDMEEKVSREIKILRLFMHGHISRLYEVIETPSDIYVVMEYVKSGELFDYIVEKGRLQEDEARNFFQQIISGVEYCHINMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGYITLPSHLSAGARDLIPRMLIVDPMKRMTIPEIRLHPWFQAHLPRYLAVPPPDTMQQAKKIDEEILQEVVKMGFDRNNLTESLRNRVQNEGTVPYYLLLDNRHRVSTGYLGAEFQESMEYGYNRINSNETAASPVGQRFPGIMDYQQAGARQFPIERKWALGLQSRAHPREIMTEVLKALQELNVCWKKIGQYNMKCRWVPSVPGHHEGMGVNSMHGNQFFGDDSSIIENDGDTKLTNVVKFEVQLYKTREEKYLLDLQRIQGPQFLFLDLCAAFLAQLRVL

SEQ ID NO: 47053 - protein, 590 aa, Oryza sativa Indica Group
MNSAAAAAACASAPAWVVGGGAGGGARSARGPCGIRVCGLGGEAVALRSLRISQGAAVRRAAVAARAAAENGVAGSGGFDYDLVIIGAGVGGHGAALHAVEEGLKTAIIEGDVVGGTCVNRGCVPSKALLAVSGRMRELHDEHHMKSLGLQVSSPGYDRQAVADHANDLASKIRSNLTNSMKALGVDILSGFGAIVGKQKVRYGKVGFPGKEITARNIIIATGSVPFVPKGIEVDGKTVFTSDHALKLESVPDWIAIVGSGYIGLEFSDVYTALGSEVTFVEALDQLMPGFDPEIAKLAQRVLINPRNIDYHTGVFASKITPAKDGKPVQIELIDAKTKEHKETLEVDAALIATGRAPFTKGLGLENINVVTQRGFIPVDERMRVMDADGNVVPNLYCIGDANGKLMLAHAASAQGISVVEQISGRDHILNHLSIPAACFTHPEISMVGLTEPQAREKADKEGFEISVVKTSFKANTKALAENEGDGLAKLIYRPDTGEILGVHILGLHAADLIHEASNAIALGTRLQDIKFAVHAHPTLSEVLDELFKAAKLQPREGPERKPKHPPQPLLKVLSFVTRLLTSQKRNRQP

SEQ ID NO: 47054 - protein, 767 aa, Oryza sativa Indica Group
MALIGTVAAEVLIPLAAVIGILFAVLQWYVVSRVAVPPHDGVGGAGKGDRENDGGGDVDDDEEDGVDYRGVEARCAEIQHAISVGATSFLMTEYKYLGAFMAAFAAVIFVSLGSVGRFSTSPEPCPYDAARRCRPALANAAFTAAAFLLGATTSVVSGYLGMRVATFANARTALEARRGIGRAFAVAFRSGAAMGFLLASSALLVLFAAVNAFGLYYGDDWGGLYEAITGYGLGGSSMALFGRVGGGIYTKAADVGADLVGKVERNIPEDDPRNPAVIADNVGDNVGDIAGMGSDLFGSYAESSCAALFVASISSFGADHDFAAMMYPLLVSAAGIVACAATTLVATDAGELGAADEVAPALKRQILISTVLMTAAVAAVTFLSLPRSFTLFDFGERMLVKNWHLFICVSAGLWAGLVIGYVTEYFTSNAYGPVQTVAQSCRTGAATNVIFGLAVGYKSVIVPIFAIAGAIYASFRLAAMYGIALAALGMLSTIATGLTIDAYGPISDNAGGIAEMAGMPRLVRERTDALDAAGNTTAAIGKGFAIGSAALVSLALFGAYVSRAGIRTVNVVSPRVFVGLLAGAMLPYWFSAMTMRSVGSAALRMVEEVRRQFDEIPGLAEGLAAPDYATCVRISTDASLREMVAPGALVMASPLVAGTLFGVEALAGLLAGALVSGVQVAISASNSGGAWDNAKKYIEAGATEEARSLGPKGSEAHKAAVIGDTIGDPLKDTSGPSLNILVKLMAVEALVFAPFFAAHGGIVFNHL

SEQ ID NO: 47055 - protein, 490 aa, Oceanobacillus iheyensis HTE831
MKLYENLNKNFISGEWRDGQGETTYEVKNPYNDEVLQEIKMASKEDIDEAYKSAEQAKKKWAKFNPFERSSIMEKAVQIIDARREEFVNHLIREGGSSHLKANVEIDFVIAITREAASFPLRMSGEIVPSLIPGKENRIYRSPLGVVGVIGPFNFPMYLAMRSVAPALAVGNGVVLKPDDQTAVTGGILLAKVFEEAGLPKGVFNVVVPNIEDIGDAFVEHPIPRLISFTGSTPVGRHIGEICGRNIKKVALELGGNNPLVVLEDAKVENAVNSALFGKFMHNGQICMAINRIIVHKDIYEEFVEKFVEKAKKIKVGNPSEKDNLIGPLINRQAIDRILEQIESAKEQGAEVVLEGKVEGNVMHPYILTGSNDVATAQNEMFGPVATIISAESDEEAIRIANDTPFGLSGAVHAGSPERGVEVAKQITSGMVHVNDQSVNDEPLIAFGGEKASGLGRFGGKWSLEEFTTVQWISVQTEERENPFHTDYLE

SEQ ID NO: 47056 - protein, 424 aa, Campylobacter jejuni subsp. jejuni NCTC 11168
MYLQISDLKKELILKKGILHFDFTASALALKCVEKEILKILPTYANTHSDSSLNSFKTQQTYEQARKDIKKSLSLDENFALIACGTGSSSAIKKFQELIGIYIPPLVKERYFTQIDKNTLPLVIVGPYEHHSNELSFREGLCECIRIPLDKNGEIDFDFLEKTLQKNKKRKIIASFSLASNVTGILSDYKRISEMVRKFKGIVAFDASSFIPYKNISCQYYDALFISSHKLIGGIGGSGLLAIKKDLCGNKPSFAAGGTVGYVSRTSQCYLCNEEALEEGGTPGILQLIRASLAFKIKDSIGVKNIEKKEEILKDYFFEKLKTIPNLILYAKNLKTRLPIFAFNIKGISPFDIAYELSKKYHIETRAGCACAGPYGHDLLGLKDNQKLKTKPGWLRISLHYTHEKEDIDYFFNALNKTIVKLSH

SEQ ID NO: 47057 - protein, 501 aa, Monascus purpureus
MAEAAARILEALPAVCEYRWSCKDASKRFTVVNPATGEPITVVQAGNLDTVQGAIQASHRAFESWRWKTRQERSLYLLQAADELQKHSHELAVLLCLENGKPVKDASFDVGFLVQVFRYFGSIVDKLPSEFFDQGSIYSSVIYEPHGVCVGILPFNWPPVHAGGKLAPCLAAGNTMVLKPGEQAPLTLMRIVEILQSVFPADVVQAVPGLGPEIPQALINHPLVKMVSLTGSTASGSQAAQTAAVTLTPTVLELGGKNAFVVFEDADLELVVRDAIDGAFFNKGESCTAASRILVHKDLYPTLVSRLTAAVKKLRTGDGLDETTHIGPVVSRERQQEVLSYIEQGKREGATLAAQGDPPTAGRLSGGFFVPPTLFTDVTADMTIAQREIFGPVVTVGSFETEEEAVKTVNSSQYGLFAGVYSSDFTRAMRVTRKLDVGVVLVNNYFRALLGTPFGGVKDSGYGREHWIGTLREWSRVKNVRFPSGLSPIPAWGGAVDVCKL

SEQ ID NO: 47058 - protein, 621 aa, Exiguobacterium sibiricum 255-15
MMICDIQHLSKQFGGDDILTDVSLFIQSHDRIGLIGRNGSGKTTFLRLLARLDSPDAGTIYQKSGLSIGYLEQLPVYDHHMTGLDVLWTAFASLLDLRQSLHQLEQEMATKTDQLESLLVQYTKVTEAFERQGGYLLESKVDRMINGLRLHPLLNRPFNQLSGGEQTKICLGRMLLSEPDLLILDEPTNHLDLEAVEWLESFLAHYAGAVLLVSHDRVFLDTVVTSIAELEDGEVRLYQGNYTYYMMEKERLLLEQFHAYQEQQKKIKQMKDAIRRLRQWANEASPPSEKLFRKAKSMERALERIERIKRPKLEAETPDLIFTAQGKTSRTVYRLEDVGVSFTESPLFHSLTVDIVAKDRLAIVGANGSGKTTLLQLLLGHIQPTSGLISQGPSVKIGYLSQHIDFPDDQRLIDVFRSNIVCDEGTARKRLAQFLFFGPRVFLPVTALSGGERMRLMLSILVNSELNVLILDEPTNHLDIESRDALEEALESFNGTLIAVSHDRYFLNRLFTKTLWLGQTPTLYHGPYAYAVSKRTVASPSAEPKQLSLNKKSPQPTPSMIPMQTSRQLEETIQQAEQELFLLESQLEQTSDYERLMKLSTSREELVQKIDELYEQFLAVE

SEQ ID NO: 47059 - protein, 100 aa, Triticum aestivum
  misc_feature (3)..(3): Xaa can be any naturally occurring amino acid
  misc_feature (15)..(15): Xaa can be any naturally occurring amino acid
  misc_feature (17)..(17): Xaa can be any naturally occurring amino acid
  misc_feature (19)..(19): Xaa can be any naturally occurring amino acid
  misc_feature (22)..(23): Xaa can be any naturally occurring amino acid
  misc_feature (28)..(28): Xaa can be any naturally occurring amino acid
  misc_feature (30)..(30): Xaa can be any naturally occurring amino acid
  misc_feature (32)..(32): Xaa can be any naturally occurring amino acid
  misc_feature (38)..(38): Xaa can be any naturally occurring amino acid
  misc_feature (46)..(46): Xaa can be any naturally occurring amino acid
  misc_feature (54)..(54): Xaa can be any naturally occurring amino acid
  misc_feature (65)..(65): Xaa can be any naturally occurring amino acid
  misc_feature (72)..(72): Xaa can be any naturally occurring amino acid
  misc_feature (74)..(74): Xaa can be any naturally occurring amino acid
  misc_feature (81)..(83): Xaa can be any naturally occurring amino acid
  misc_feature (88)..(88): Xaa can be any naturally occurring amino acid
  misc_feature (90)..(90): Xaa can be any naturally occurring amino acid
  misc_feature (93)..(93): Xaa can be any naturally occurring amino acid
MKXNIANPTTGCQKXVXIXDNXXLRNLXDXRXSHEVLXDLLGEEFXGYIFTINXWCDKQGFPMMXGLLTSGXVXLLLQQGXXXFRWFXKXNGXPRESFLC

SEQ ID NO: 47060 - protein, 456 aa, Bacillus cereus ATCC 10987
MYSYIFYCIFLCEKEMKITIIGTGYVGLITGVGLAVLGHSVTCFDIDDEKIERIKQGDLPIYEAGLYELIHDACENNRLTFTASKEEAFHDAEFIFIAVGTPSLLDGTADLTYIQNACFDIGAYATKDIIVVTKSTVPVGTNGAMRGWIEEALQNRHELHIVSNPEFLREGSGIYDFFQGDRIVIGADNEEAARKVENLYSKLHLQTYVTDIKSAEMIKYASNAFLATKISFINEISNICEKVGANVLDVAKGMGMDKRIGASFLNAGIGYGGSCFPKDTKALVQIAGNVAHDFRLLKAVIEVNNKQQLLLIEKAKKVVNMNKKRIAVLGAAFKPNTDDIRDAPSLIMIQELIHMGADVVLYDPKAIHNMKNIFGETIQYSECIDESIRGASAAFIVTEWEAIRAYPLEKYAQLMREPILFDGRNCYTNEDVKKQGIDYYSVGRESIHKRDFSVIR

SEQ ID NO: 47061 - protein, 165 aa, Brassica napus
  misc_feature (160)..(160): Xaa can be any naturally occurring amino acid
MAKATTTLFAISSVSTRFSLLRRSKSLKPSAPSARLAVPMAMAASAKKVAPAVIVGGGRVGRALQEMGSGGDLLVKRGEAVPVDFEGPILVCTRNDDLDAVLDATPQSRWKDLVFFQNGMMEPWFESKGLGDADQVLAYFAVSKIGEPPVDGITDTNPEXLTAAY

SEQ ID NO: 47062 - protein, 3707 aa, Mycobacterium chelonae
MESADHPNNPAPRFAIIGYAARFPGAANADEFWDVLREGRDAISEVPADRWDADEFFDSEPGAPGKVVTRRAGFVDDVTGFDAPFFGMSTREVRLMDPQHRLLLEMAWRAVEHSGIAPTDLAETNAGVFVGLATHDYLGMASDELTFPEIEAYMAIGTSNAAAAGRISYRLGLQGPSVAVDTACSSSLVAIHQACQALQLGECDLALAGGANVLLTPATMITFSHAHMLAPDGKCKTFDAAADGYVRGEGSGVIVIKRLEDAIRDGDRIRAVIRGSAINQDGASGGLTVPNGVAQQRVIADALKRAGVAPSDVGYLEAHGTGTSLGDPIEAQAAGAAYGIGRAANDPLLIGSAKTNIGHLEAAAGIAGVIKVVLSLENELLPQHRNFQNPSPHIPWDRLPVEVVKEATAWERNGRPRIAGVSSFGFAGTNAHVILEEAPVAAEIETAEEPESTGDRFSILPLSARTPAALVQIADQYRSWLNGHPEATLADLCFTAGVGRAHLEHRAALVVNSREAAVELLGAVADDRPAPGLGRGESHDTPKTAWLFTGQGSQYPGMARELFDTEPVFAETLKRCAAVVADVLEKPLLDVIFDVDGPDAEATLRQTAYAQPALFAVEMGLARLWQSWGFEPDVVLGHSVGQYAAACVAGVFSLEDGAALMAERGRLFGSLPAGGRMAAIFAAAERVESLTDDFPSLSVAAYNGANTVLSGPAQDLEKAVAGLVAEGIRCDFLETSHAFHSALLDPILDEFEVYAGKFNYKTPQRILIDNRTGTALGRSVKLDGAYWRRHARQPVEFAKSVRTLADMNCKVLFEIGPQPVLTAAALRAWPDPATAPRAIASLRRNTADHRQITEAAADAYVLGHLPDFGAFRHGHARKLDLPTYPFEHRQYWFSDKRNADNRDATKQQQPASGSRTEAVRLLEDGKIEELANLLGGTSGDQQTLAVLTKLAAQHNQQRTTQTIADDRYQFRWDKSPMPLAGADTSTATTWLLVGDVAGAAAPLVDALTARGQQYRILGLPTSDADEQQLADEFRSAVSGDSALRIVHVAALDGGASSARSLLRMQHQILGGTRRLFRAAAAAELRAPIWVITRGAQRITDTDTVAPEQSALWGFGRAAALELPQVWGGLADLADASAAEWSQFISRASASSDAAAREDQIALRDQSVYVPRLVRRENLPSGTPLEVRDNATYLVTGGLGSIGLEIAGYLAARGAKNLVLTSRREPNETAQQRIDALGAQHGCEVRVVTADVADAHDVARLLAGVQADLPPLAGIVHAAGEIGTTPLSDLDDSEVDRVFAGKVWGAWHLSEAAADLKLDFFISTSSIASVWGGFGQTAYSAANAFLDGLAWRLREQGIAGTSVNFGPWTAGMADAESRARLEQRGIKTLSPSDALAGLADVVAASQSNGGAQGVVARIDWTRFLPLYQQAGRRAFLAELEREVPSHLAASQGVPQSGTTQLVERLAGAPVQQRKKLLTDYLRDAVAEVTRVDVSEIREDAGFFDLGMDSLMAVELRQRMEQGVGKEIPVTLVMDHPRISDVADYLLGEVLGLSEQAKPAPQRVSAVTDRTDEPIAIVSVSCRFPGAPDPEAFWEVLSGGVDAIREVPEDRFDIDEFYDPDPETAGKTYTRFGGFLDGIDGFDPEFFGISPREAVWIEPQQRLMLETVWEGLERAGYSPAALRGSRTGIFAGVGANEYAHLLSSESIDKIEPYFITGNALNAISGRVAFALGFEGPAVAVDTACSSALVAVHQAVQALHSGDCDLAVAGGVNVLLSPVTVIAASRARMLSPVGRCKTFDASADGYVRSEGCGILVLKRLSDAERDGDRVLAVIPGSAVNQDGASSGLTVPNGGAQQRLIGTVLARAGLAGGDVDYLEAHGTGTPLGDPIEVQAAAAAYGGSREADRPLLMGSVKSNIGHTESASGAAGLIKVVLSLQNGVLPQSLHFEKPSPHIPWESLPVRVVDKAIPWEPNGRPRRAGVSSFGFTGTNAHVLIEEAPRRAVATDEGGPDETAATPEAQGDKVNVLPLSARSPEALAAVAQRYESWLSAHPEVDIEDVCLTAGSGRSHFEHRAALVVDSVESAREGLAELVQNRLRPGVIRGEHTNHPTTAWLFTGQGSQYPGMARELFDAEPVFAEIVTRCAEAVKDIVERPLLEVMFATDRETGGEAGKVLRHTSFAQPAIFAVEMGLARLWQSWGIEPDVVLGHSVGQYAAACVAGVFSLEDGARLIAERGRLFGSLPAGGRMVAVFSDAKHVEQIASDFPRVSVGAYNGPNTVLSGPGEDVEQAVARFEEEGIRCTWLETSHAFHSELLDPVLDEFESYAAQVQFATPTLPLVCNRTGAVLTAQTPIDAQYWRRHSRQPVQFAESVRTVAALGCSVLMEIGPQPVLTGAAVQVWPEHLAAPRAIVSLRKGVGDRRQIAEALAAAYVGGHRPNFAALQRHPRNTLELPTYPFQRRRFWPKSSGAAIEGGGGLSAGILGRGEDLASGDSVYISRLSVRSQPWLSDHVIYGTVVVPGATYAAMALAAVGTPARAKDVFFYEPIILPEKSSREVQLTLHPLEDGSGSKFQVHSRPYGERDVDWSLNAEGTVVPGIDDSADDAAGQTSEAEPVDAAIERMERMRPHELFETFADLELSWGPTWSGSLKSLWLGQGEAIGDVLVGEELAEQLGTEPMHPVLMDLCTGVAFPAFPALLAAEQGINDLFLPLRYGQVTLKEKMPRRFYCRARWHESALDSETQVFDLEYLDRDGRHLGGIREFTVKRAPREALLRGLGGDATRLLYTLGWHEVPVPPSEDGTAAASGTWLIAGFDELAARVPGCIPFDRTSNPELLGQVLAEAKERGVPFSGVVWRAAAPGAQESSTDEIARLETEIANLLSAVHTVQNGAQNGVKLPDGLWIVTERAVATESGEPVDPVQASLWGFGRTTINEEPALRAKLVDGDGSPEAVQALANLLATPVEEPEIAVRQGKLLASRLLPWSRSGNLTVPRGSDYALLPTERGAIDNLRITEKEVEAPDEGYVQVRVEAAGLNFRDVLNVLGLYPGDPGPIGGDFAGVVTQLGEGVTEVAVGQRVYGSMQGAFASRFNAPAQFLAPIPDGVSAVEATTIPAAALTVRLAFDWAQLKPGDRVLIHAASGGVGLAAIQMAQQCGAEVYATASTFKRATVRKLGVKYVYDSRTTDFADQILADTDGHGVDVVLNSLTSEGFVEATVRATAKNGRFAEIAKRDIWTSEQMAEARPDIAYEIVALDTVMFQEPERIRGLLTEVSDGLAKGEWTPLPAEIYPLTEARTAFRRMQQARHIGKIVCQMPNPLAPQPDRTYLITGGLGAIGLHTASYLAQLGAGDIVLTSRRAPDVDAQRLIEEISERSKARIHVFTADVGEESEVVKLLERIRAELPPLGGIAHLAGVLDDALLGQQSVERFRTTLAPKAFGADYLDRLTKDEDLDFFIVSSSVSSLFGSPGQSNYATANAWLDGLIARRRSQGLPATGVNFGPWGQGGMASSEAATANISAQGLIPLDPSAALAALAEVIANGVGQATVIKANWQRAAKVLGSSRPPILDLVLPSAVGEVTGDSELLKQLMEIPVPQRAGFVTEFLQREVQNFLRLAQPPAATSRFLDLGTDSLMAIELRNRLHSQFGGKFTINATAVFDYPTIGGLGEYLVAQLPDAESESQEEQPAVEAAQSESESESDTDTVPAPSDEVSEPAR

SEQ ID NO: 47063 - protein, 389 aa, Sulfolobus tokodaii str. 7
MIQKEKKLLMHVGPVNILDRVLYAGLKNNVGFTSQEFVEAFQFSLKKTRELFQADNTYQPFLIPGGGTSAMESVTSLLKEGEKVLVVTNGVFGDRWINIFRKYPVKVNVLSAEPGYYVEPETVEKEVKKDKYTLVTFTHVETSTGVRQPIKDSVKAVRDYVDLVVVDGVSSVGAEEVKAKDWRVDVYLTASQKALGVPPGLGILVLSERAMERLKDEKSIAGYYLDLRNWLPVMNSMENGKASYFSTPPVHTILMLSEALKIIIDEEGLESRIKRHEKVASAIRAGIEGMGLEIVAKKPEAYSNTVTGVVVKKVNAGNVLSEIVSEGVELAPGVHPKLQGKYFRIGHMGWVTENDAIVTIASIERVLNKLGEEIRLGEGIKATQLYLAK

SEQ ID NO: 47064 - protein, 500 aa, Triticum aestivum
MRIPRRKAGVPLGVPSRRAQIAAVFALAVLLGVSVLYDSAHIAASLRRHSGYNRLSPTREAPAGAGPRATPAQAVESAGAATDRTDPPPRLGAEGVSKSNPGTAADGSSPETGVLKEVVAEGGEATCDMYKGRWVHDEENAPMYKESDCEFLTEQVTCMRNGRRSDEYQKWRWQPDACDLPRFDAKLLLEKLRNKRMMFVGDSLNRNQWESMVCLVQSVAPWDKKKLVKNGSLNVFRLNEYNATIEFYWAPFLVESNSDDPDIHSITDRMITPTSIAKHAANWIGVDYLIFNTYIWWMNTPKMKIVPDGSFTRKPVKYDELDRVVAYRQILETWSGWVEENVDPKRTMVLFMSVSPVHMQSEGWGSPDNIKCFSETQPVLNYTKTLDVGTDWDLFTESHEVTKAMKKVPVHFINITALSEIRKDAHTSVHTLRRGKILRNEQNANHASIASESNGASMAGGHREGLPCTGTLRGPVERGRSRMTGTSDHDHIRAPKPAAG

SEQ ID NO: 47065 - protein, 570 aa, Oryza sativa Japonica Group
MAGGGVEDTYGEDRATEDQLITPWSFSVASGYTLLRDPRHNKGLAFSEAERDAHYLRGLLPPSIVSQELQEKKLMHNLRNYTVPLQRYIAMMDLQERNERLFYKLLIDNVEELLPVVYTPTVGEACQKYGSIYRRPQGLYISLKDKGKILEVLKNWPERSIQVIVVTDGERILGLGDLGCQGMGIPVGKLSLYTALGGVRPSACLPITIDVGTNNESLLNDEFYIGLKQRRATGEEYHELLEEFMTAVKQNYGEKVLVQFEDFANHNAFDLLAKYSKSHLVFNDDIQGTASVVLAGLIAALKVVGGTLADHTYLFLGAGEAGTGIAELIALEMSKQTEIPINDCRKKVWLVDSRGLIVESRKESLQHFKQPFAHEHEPVKTLLEAVQSIKPTVLIGTSGVGKTFTQEVVEAMAAFNEKPVIFALSNPTSHSECTAEEAYTWTKGSAVFASGSPFDAVEYEGKTYVPGQSNNAYIFPGFGLGVVISGAIRVHDDMLLAASEALAEQVSEDNFARGLIFPPFTNIRKISAHIAAKVAAKAYELGLASRLPRPDDLVKYAESCMYTPAYRCYR

SEQ ID NO: 47066 - protein, 504 aa, Pseudomonas syringae pv. phaseolicola 1448A
MLEHYVKKILTSRVYDVAVETPLHGARQLSERLGNRVLLKREDLQPVFSFKIRGAYNKLAQLTAEEAARGVVTASAGNHAQGLALAARELGILATIVMPRTTPEIKVEGVRSRGATVVLHGDSFPEALAYSLKLVDEQGFVYIHPYDDPDTIAGQGTVAMEILRQQPGQLDAIFVPVGGGGLIAGIAAYVKYLRPEIKVIGVEPDDSNCLQAAMAAGERVVLSQVGLFADGVAVAQIGHHTFEVCRHYVDEVITVSTDEICAAIKDIYDDTRSIAEPSGALGVAGIKKYVEQRGISGQTLVAIDSGANVNFDRLRHVAERAELGEGREAIIAVTIPEQPGSFKAFCEAIGKRQITEFNYRYHTDREAHIFVGVQTHPENDPRSALITSLTGQGFPVLDLTDNELAKLHIRHMVGGHAERVNDEVVLRFEFPERPGALFNFLNRLGGRWTISMFHYRNHGAADGRVVAGLVVSEEERHLVGTALDEIGYPYWDESENPAYRLFLG

SEQ ID NO: 47067 - protein, 243 aa, Synechococcus sp. CC9311
MRKPVIAGNWKMHMTCAQARAWIGTFLPLIAELPNDRHLVVAPPFTAISTLAELSEGTRLELSSQNVHWEGEGAYTAEISPSMLKEHNVQYAIVGHSEPRKYFSESDEQINHRARSAQTNGLIPIVCVGESDEQRSRGEAERVIRRQVEQGLEGLDPSQLVVAYEPIWAIGTGKTCEASEANRICGLIRSWVGSPDLIIQYGGSVKPGNIDQLMGMSDIDGVLVGGASLDPEGFGRIANYVKS

SEQ ID NO: 47068 - protein, 349 aa, unidentified eubacterium SCB49
MSNFHTLTVSEVKKETPNSVVVSFVVPNDLKQVFKFEAGQYITFKHVLNGEEVRRAYSLCSMPGDDVIKVGIKKVEGGTFSVFANEILKEGDSLEVMAPDGKFVCKTDKDASKNYAAFVAGSGITPVLSIIKTVLKEEPNSRFLLAFGNQSQQETMFYNELMGLVRDNNERLQIEWVYSRERLDGARQGRIDGDIVNYLLKNKFEYTTFSDFYLCGPEPMIDAVASTLKEQGINEKQIHFELFTTAEEGLLLEAHDGDTEITVVLDDEEKTFTMPQDKTILEAALAEDLDAPFSCQGGICSTCIARVKEGKAEMKKNQILTDGEIADGFILTCQAHPTTAKLVVDFDDV

SEQ ID NO: 47069 - protein, 189 aa, Allium cepa
DFMACMGAFFGVVFVSVEIGLLIAVAISIARILFHVTRPRTALLGNLPRTKLYRNIDQYPDARKVPGVVIVRVDSAIYFTNSNYIKDRILRWLRDEEETLETEGLPRTDFLIVELSPVTDIDTSGLHALEDLFKALKKRDIELLLANPGPVVIEKLRTSKFTEIIGQEKIFLTVDEAVMFCAPKAKEEA

SEQ ID NO: 47070 - protein, 469 aa, Oceanobacillus iheyensis HTE831
MNDSDKLLKSLGKKETFALAFGAMIGWGWVVTSGLWITEAGALGAIIAFLLGGLLVVFVGLTYAELSSALPFVGGEHVYTYKAMGRVTSFIATWAIILGYVSVIAFEAVALPTVFEYLVPNYSQGYLYTIAGWDVTLTWAGVGIIGSVLVAWINYRGIKLSSIINFILTILILIAGIMLITGSTFSGNMSNMNPLFETGMTGIMTVLMMTSFMFVGFDVIPQAAEEINLPNKKIGQLLILSVVVAVIWYIAIIFGVSRMLTPSEINASNLVTADAVAKAFGNSEMMGNFLVLGGIGGILTSWIGFYVGGSRAIYALAKAGMLPKSLGQLHPKYNTPHKAILLIAVLSTAAPLLGRPALVWLVNAGGLGLVVAWLMVTISFIILRKKAPEMQRPFRLPGGTTIGWIATIMAIGVTILYLPGMPSALIWPYEWLIIGTWIILGFVLYNYSMRKYGKKNTDDYMKKEVNKSA

SEQ ID NO: 47071 - protein, 449 aa, Oceanobacillus iheyensis HTE831
MEDLFELDKKHFIHPTSSIIQQQTDGAKSIMAKGDGIYVTDTNNKEYIDAVSSLWNVNIGHGRTELAEVASEQMKKLAFSSAFSTFSHEPAIRLAKKISELTPQGLNAVFFTSGGSESNDSAVKLSRHYWKIQNKASKRKIISLKRGYHGVAAASTSITGIPEFWDMAGHLMNDFLHAETPYRSTTEKAIESLQSMIEQETADTIAAIFVEPVQGAGGVLIPPADYLEAVREICDFYNILFIADEVITGFGRTGTMFGMENWNVVPDAMTFAKGVTSGYIPMGGVVVSDHIHTVLKEKSKGTLFHGFTYSGHPTAAAVALKNIEIIEKESLVTNAKERGLELQNGFQKIKKESSIVGEVRAIGLIGAIELMQDSATGQPFTPDVGVTPAVINALHERGVISRGVTYDGSNILCFAPPLIITKQEVNELISRISDAILFVQHQLGVSQNY

SEQ ID NO: 47072 - protein, 322 aa, Magnaporthe grisea 70-15
MSSTSNSIKLLSGNSHMLLGRLVADRLGIEIAKTLSLNYSNQETSVTVGESVRDEDVFIIQSTMPGDINDGLMELLIMTHACRTASARRITCVLPNFPYARQDKKDRSRAPISAKLIANMIQTAGCNHVITMDLHASQIQGFFNIPVDNLYAEPSVLRWIRENLPVEKCVIVSPDAGGAKRATSIADRLDLGFALIHKERPRPNVVGRMVLVGDVKDKIAILVDDMADTCGTLSKAAQTVKDHGAAEVVAIVTHGILSGNAIENLNNSCLSKVVVTNTVPLGNKVDRCPKIRVIDVSATIAEAIRRTHNGESVSHLFTHVPV

SEQ ID NO: 47073 - protein, 361 aa, Triticum aestivum
  misc_feature (210)..(210): Xaa can be any naturally occurring amino acid
  misc_feature (244)..(244): Xaa can be any naturally occurring amino acid
  misc_feature (252)..(252): Xaa can be any naturally occurring amino acid
  misc_feature (280)..(281): Xaa can be any naturally occurring amino acid
  misc_feature (302)..(302): Xaa can be any naturally occurring amino acid
MGSIAAGADEDACMYALQLVSSSILPMTLKNAIELGLLETLMSAGGKFLTPAEVAAKLPSAANPEAPDMVDRMLRLLASYNVVSCRTEEGKDGRLSRRYGAAPVCKYLTPNEDGVSMSALALMNQDKVLMESWYYLKDAVLDGGIPFNKAYGMSAFEYHGTDLRFNRVFNEGMKNHSIIITKKLLELYKGFEGLNTLVDVGRGPSAPPVXAAITAHYPAIKGINFDLPHVISEAPPFPGVTHVXGGDMFQKXVPSGDAILMKWILHDWSDEHCGKLLKDXXDALPAHGKVVLVECILPVNPXEATPKAQGVFHVDMIMLAHNPGGRERYEREFEALAKGAGFAAMKTTYIYANAWAIEFTK

SEQ ID NO: 47074 - protein, 484 aa, Oceanobacillus iheyensis HTE831
MAELKAITTYQMYINGEFVNASNNETLEVTNPATEEIVSTVPKASLEDTRRAIDGSAKAQKDWANLPSSKRASYLFAISKEIRSNIDEYAKIISEEMGKPLDQAVVEVSVTADYFEYIAGWARKYEGEIVPSDREKENILVFKQPIGVVAGILPWNFPFFLIARKAAPAILTGNTIVLKPSSVSPNNALAFAKILDKVGLPKGVINIVTGAGSIVGEELSKNEKIGMISLTGSTEAGSRVMEKASKNITKVSLELGGKAPSIVMEDADIDLAVKSVLDSRIINTGQVCNCTERVYVHEDVADEFIEKITKAMSNVSYGNPLGNEQIDMGPLSNEAGLKNVEDMVKRAVENGATVLTGGNRVNTEAGYYYEPTVLSNVDNSFEIMKEEVFGPVLPIATFTSLDEAIELANDCQYGLTSAIFTNNVNYMMRASNELEFGETYVNRESFEAIQGFHAGWKKSGIGGADGKHGLGEFLQTHVVYIQYK

SEQ ID NO: 47075 - protein, 451 aa, Desulfitobacterium hafniense DCB-2
MSISTQFSVPQRMERLPLTSYQKKIFYIIATAWFFDSMDLGMLTFVLGSIKTDLGLTTVQAGLLSSFSFLGMFFGAASAGMAADKFGRKIVFQTSMILWGAASIACAFTQNVEQLALARFFLGLGMGMEFPIGQSLISEFIPAKNRGRYIALLEGFWPIGFIAAGILSYFLLPIGGWRLVFLCEGIPAIFVLIIRRMVPESPRWLADTNQDEKADVVMTAFEKNVEKAYGKELPPPIKDDNLVIGKHEKKFSFLQLWAPGYKKRTIMVWLLWFFALLGYYGLTTWLSAFLQEAGYSVTKSVYYTIMISLAGIPGFFSAAYFIEKNGRKPTLIVVLIGCAVFAYLYGTASSLQTLIGFGLGMQFFLFAMWSSLYAYTPELYPTRARATGTGFASSVGRFGSLLGPYIVAVVLPTLGNSGVFALGAACFIAAALSVAILGEETKGRVLEEISA

SEQ ID NO: 47076 - protein, 567 aa, Bacillus licheniformis ATCC 14580
MNNMRRTKEGHLETSLRGKDVLSIPTLNKGVAFSLEERKNLGLEGLLPPTVLSLDQQAERAYEQFSRQPDRLRQNVYLNDLQNRNEVLFYKLLQNHLREMLPVVYTPTVGEAIQEYSHEYRRPHGVYLSIDDMDGIETAFKNLQASADDIDLIVATDSESILGIGDWGVGGINIAIGKLAVYTAAAGIDPSRVIPVVLDVGTNNEKLLNDPLYIGNRHPRVEGERYEQFIDAYVETALKLFPNALLHWEDFGNKNARNIMSKYNHKIATFNDDIQGTGAITLAAILAAVKKTGTSLKDHRVVIFGPGSAGIGIADQIRDTMVLEGLSEEEANRAFWTVDYRGLLTTGMDQIMDFQEPYLRDTEEVKDWKRNEKGEISFEEVIRQVKPTILIGTSGVAGAFSEEIIKEMAAHTERPVILPMSNPTHLAEAVPEDLFKWTDGKALVATGSPFEAVEYNGVKHEIGQSNNAFVFPGLGLGTIVAKAKVITNGMFAASANAVANMVDHEKPGAGLLPKIDDLQDVSVQVAIDVVKAAIKDGVAQVQPEDVEKAVREAMWRPEYKTIVAKQD

SEQ ID NO: 47077 - protein, 505 aa, Schizosaccharomyces pombe 972h-
MDASVSLLPEGESLHRSLSASQIQMLAFGGIIGTGLFLGIGSSLAESGPASLLISFSVLGVSVYCTMLALGEMSVYMPVAGSFCTYVGRYVDEALSFSLTWNYWLNDTIALASHVLATRLVVDFWLIPTEGDPVSASLSLPPWKEAVRIITPITSLSANIILNMLPVGGFGEIEYWLSSIKVFTVAAFIVNGILCNLGVNNEKKFIGFRYWKDPGAFNNGIIGVISSFVNAAFAYAGTESIALTAGEAKSPITTLPKAIRFTAHRVLLLYIISVLVVGINLPYNTPGLDGDSVRMSPFTFVFKKFGVPGAASIMNLVILSSALSAGNHSLYAGTRLLYSLAKSGHAPKVFSKCNKHGIPWLSVLATSATAILCLMSSQAGKTWGFLLNVIAVSNQISWIFIAVSSLRFRKALRVQGKTHRLYFPNWTYPVGPYIIILLNGVFLFLQGYKSLYPFRLSLFVSYYMEIPIVLGLYLIWKIYKKTKLVSSSEADLETDWKSLEDTDSA

SEQ ID NO: 47078 - protein, 312 aa, Pseudomonas fluorescens Pf-5
MYLVCGEALFDFFSADEAGAPASKVAFQAIAGGSPFNVAVGLRRLGVDVALLAGVSRDYLGQRLRRVLENEGVDTRYLREFDAPTTLAMVAVGADGSPHYSFRGEGCADRQLQEEHLPQLDAQVRGLHIGSFALVVQPIADTLLALVRRERGQRLISLDPNVRLNPQPDIQLWRQRIAELAGHADLIKVSDEDLAQLYPGQAPETLIRGWLQGNARLVFLTRGSQGATVFSRGHGSWSVDAPRVEVADTVGAGDTFQAALITWLTEQGLDSPQGLEQLDREQTDALLRFAVNAAAQTCTRTGPDLPYRHQLP

SEQ ID NO: 47079 - protein, 194 aa, Legionella pneumophila subsp. pneumophila str. Philadelphia 1
MKNLVEEKEAFRFGVSGDIGSFSEEAALLYARKKGLNAHLVHLLDMEGVLNAIENETIDLGILPVVNLLGGLVKPAFQAMGKYSFTPIDEIWHDINQCLLVKTNTQNHKITHIVSHPQGFAQCKKFLRNKFKNAKKIEWIDTAKAAKDLAEGILPPHAAVIASARCAPLYDLKISARNIQDSHLNRTAFILVKK

SEQ ID NO: 47080 - protein, 113 aa, Zea mays
  misc_feature (101)..(101): Xaa can be any naturally occurring amino acid
GADQAVRQPFQSRFDLLLLLAGPNTTRLASKLARGPTVIMASSETAVAPFKGLKSAAGFPVSRRRTRSLGNLRNGGGIRSMQVWPAYGTKKFKTLSYLPPXLSTDNLLKQVDY

SEQ ID NO: 47081 - protein, 450 aa, Pseudomonas fluorescens Pf-5
MEVSVFGTGYVGLVQAVALADVGHNVVCVDIDSHKIAQLQRSIPPIHEPGLATLIEENQKAGRLHFTTQASDAVGHGKVIFIAVGTPSNEDGSADLDHVLAVARNIACLMFSDKTLVIKSTVPVGTADLVIETVAEQLADLGKSELRVHVVSNPEFLKEGSAVADCMRPDRIIVGCADDLPRQQLSELYAPFNHNHDRLMFMDNRSAELVKYAANAMLATRISFMNEMANLAERLGVDINAVRKGIGADPRIGYHFIYPGAGFGGSCFPKDLRALIHTAESHGLEPHMLKTVRDVNEQQRHVLFRKLKAHLGDNLQGKVIALWGLAFKPNTDDMREATSRYLMQALWEAGAKVQAYDPEAMTECRRLYGYRDDLQLCATRDDTLQGADALVICTEWKAFRVVDFTLLRETLRDRLVVDGRNLYNPQQAADAGLHYLSIGLPYRVPEALRA

SEQ ID NO: 47082 - protein, 96 aa, Solanum melongena
SGGGGGGNGGNGQGRCPRDALKLGICANVLNLVNVTVGAPPTLPCCSLLQGLVNLEVAACLCTAIRGNILGLNLNVPVAISIILNNCGMNNSGFTC

SEQ ID NO: 47083 - protein, 339 aa, Pseudomonas fluorescens Pf-5
MNILITGAAGFIGAHTALRLLKDGHQVTGLDNFNDYYDPQLKRDRVRWVERQVGHFPLQRLDLADSEGLERLFAEVRPQVVINLAAQAGVRYSLENPKAYLDSNLSGFLNLLEMCRRYPVQHLIYASSSSVYGANQQTPYKVSDNVDHPLSLYAASKKANELMAHSYSHLFGVPATGLRFFTVYGPWGRPDMSPILFADAISQGRPLKLFNYGMHQRDFTYIDDIVESLVRLLGKPPVRDPLWDREQPDPSTSMAPWRLFNIGGQRPVELKDYVATLEKLLGHKAQVEYLPLQPGDVLNTCADVSALENLTGFGPQVPLEEGLREFVQWYLSYYPGAAS

SEQ ID NO: 47084 - protein, 579 aa, Yersinia pseudotuberculosis IP 32953
MQKKSLRYWMPGLTQLMAYERDWIKPDLRAGLSVAAVALPIAIAYAELTGVSAAVGLYSCILPMIAYAFFGSSRQLIVGPDAATCAVIAAVVAPLAAGNSEVHWQLTIMMTLMMGSWCLVASRFKLGALADLLSRPILTGLLNGVAITIIVDQLGKVFGFMTRPPQLIERVLALPYNMFNSHLPTVAISLLTFVVLYGVKWLRPNWPAPLLAIVIATFVSWAANMQQFGVDVVGGFEGGLPIVHWPDFQPGLLRDMVIPALNLAVVSFVSMMLTARSFAAKNGYDVDADVELRALGITNIVSALSQGFAISGASTRTAVNDANNGKSQLVSIIAALVIAMVLLFLTRPLQFIPIAALGVVLIYAAWSLLSFKSLWQLRKRNTQAFYLAIFTFVSVVLVGVISGIGLAVLLGLLQFLRTVFRPTEQLLGVNADGMIHSMGNGNGIKAVPGVMIYRFNSPLTYFNVAYFKRRILNLVDSTPHPADWVVIDAVASFTYADISVLAAIDELKRDLKQRNIKLILAGRRTELTRWFRINRLKSHDDDLVLVPDLYLALKLIQSKRRVAEKQEHESETGLEPEIG

SEQ ID NO: 47085 - protein, 430 aa, Staphylococcus aureus subsp. aureus MW2
MAFEFRLPDIGEGIHEGEIVKWFVKAGDTIEEDDVLAEVQNDKSVVEIPSPVSGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESAASATSEEVAETPAAPAAVTLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 47086 - protein, 1110 aa, Lolium perenne
GSTSPRASPQSIHRSFLRSKFVIFFCFLSSPRRSEYGTKHGLGKLGAGIRIWAGINPDLLLAVFLPALLFESSFSMEVHQIKKCMAQMVLLAVPGVVISTVLLGTAVKLTFPYDWNWKTSFLFSGLLSATDPVAVVALLKDLGASKKLSTIIEGESLMNDGTAIVVYQLFYRMVLGTTFDAGSIIKFLSEVSLGAVALGLAFGIASVLWLGFIFNDTIIEISLTLAVSYIAFFTAQDALEVSGVLAVMTLGMFYAAFAKTAFKGDSQESLHHFWEMIAYIANTLIFILSGVVIADGVLQDNIHFERHGASWGFLLLLYVFVQLSRAVVVIVLYPLLRHFGYGMDVKKATVLVWSGLRGAVALSLSLSVKRASDAVQLYLKPEVGTMFVFFTGGIVFLTLIVNGSTTQFLLHLLGLGKLSATKLRVLKYTRYEMLNKALEAFGDLRDDEELGPADWITVKKYITCLNNLEDEQAHPHDVPDKDESVHTMNLKDTRVRLLNGVQAAYWGMLEEGRITQSTANILMRSVDEAMDLVSGQSLCDWKGLRSNVHFPNYYRFLQMSRLPRRLVTYFTVERLQLGCYICAAFLRAHRIARRQLHDFLGDSEVARIVVDESTAAGEEAKKFLEDVRVTLPQVLRALKTRQVTYAVLTHLSEYIQDLGKTGLLEEKEMAHLDDALQTDLKKLKRNPPLVKMPRVSELLNTHPLVGALPAAVRDPLSSNTKETIKVHGTVLYTEGSRPTGIWLVSTGIVKWTSQRLSTRHSLDPIFSHGSTLGLYEALVGKPYICDIITESVVHCFFIEAEKIEQLRQSDPSIEDFMWQESALVIARIFSPSDIEKMAMHEMRVLISERSMLNIYIKGEDIEPGHNYVGILLEGFLKMNNHLITPPAVLLPSNTDLNVFGLQSSVMNHIDYCYTATSYQVEARARAILFEIRRPEAESDLQRSASLLSPTLGPSRTQSKEHVGLVRWPESFRRSRGPGNPSLVDIGSQSFSARALQVSMYGSMMDDMHPAQRRQRPHPVKANQEHSASYPKVPSRVMSNSRPLLSVQSEGSNLMNRKSAPAPAIAPFPPRRQRRAIAEEDNSSDESVEEEIIVRVDSPSMFTFHPPSQGS

SEQ ID NO: 47087 - protein, 466 aa, Synechococcus sp. CC9311
MSRSSMVISSARSVSRDQFSLLHVSRSKASAPAHNSLGLCHGTMNEIASGPGLQHQRLNNGCRTVCAEMPDADLTCLDFWCRGGSTWEGHGEEGLAHFLEHMVFKGSETLQAGEFDRRIEALGGSSNAATGFDDVHFHVLVPSNCAQNALDLLLDLVLNPALREDAYGMERDVVLEEIAQYRDQPDEQVFQTLLSKGFGQHPYGRPILGWEQSLINSTPEGMRQFHNRRYRGPNCCLAISGAVTSSVLEQIHSSRLTELEGSLDPEDEIASSSSSLAFQSGRQTLRFPRLEAARLLMAWPMAAANDQYSVMGADLATTLLAEGRRSRLVQRLREDLQIVESIDMDVTVMEQGSVVMLEACCPEDQIEQVEAVIEEELKRVTVDAIADDELHRAKQLVGNGLRFSLEAPGSVAAIAGSQSLWGRTQTLLSPLSHLQTWTAERLQQSLLTRLQPNQAFTLLALPEDSE

SEQ ID NO: 47088 - protein, 239 aa, Ginkgo biloba
MAAAFSALVLPKWTDDSSLKSAISWVHNHQLRPINFSTHICVSRAPILRRGNQFKRPVCQSANPAVEIKKQSAVAKSAPVLPFRVGHGFDLHRLEPGLPLIIGGIDIPHDRGCDAHSDGDVLLHCVVDAILGALGLPDIGQLFPDNDPKWRGAASSVFLKEAVRLMHEAGYELGNLDATLILQRPKLSPHKEAIRTNLCELLGSDPSVINLKAKTHEKVDSLGENRSIAAHTIVLLMKK

SEQ ID NO: 47089 - protein, 525 aa, Oryza sativa Indica Group
MASLARRRAAEAALLRRAPAAAWAWRGYAAAAAGEESDVVVIGGGPGGYVAAIKAAQLGLKTTCIEKRGTLGGTCLNVGCIPSKEVMNHFDPFYLAVPSIYYELRSTMGALLHSSHMYHEAKASFAHHGIKFSNLEIDLPAMMSQKDKAVAGLTKGIEGLFKKNKVEYVKGFGKFVSPSEVSVDLLDGGSTTVKGKNIIIATGSDVKSLPGVTIDEKKIVSSTGALALSEIPKKLVVIGAGYIGLEMGSVWNRLGSEVTVVEFASDIVPSMDGEIRKQFQRMLEKQKMKFMLKTKVVGVDTSGSGVKLTVEPAAGGEQSVLECDIVLVSAGRVPYTSGLGLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPNAGEIIHEAVLALQYGASSEDIARTCHAHPTVSEALKEACLQTYLKAIHI

SEQ ID NO: 47090 - protein, 548 aa, Synechococcus sp. CC9311
MARRRLALVNGFSWRHWRGDLLGGLTAAVVALPLALAFGNAALGPGGAIYGLYGAIITGFLAALFGGTPAQVSGPTGPMSVTVAGVIGTLAAVGISRELGSNELLPLVMGAVLIGGLIQILMGVLRLGRYITLVPYSVVSGFMSGIGVIILCLQIGPLLGIKSQGGVITSLGTVFSQFTPNLAALLVGALTLAVVFLTPNRISTWVPSPLIALVIITPLSMLLFQDGIPRIGTIPEGGLNFSMPNIKDHFPVLLRAGLVLAVLGAIDSLLTSLVADNISQSRHQSNRELIGQGIANSVAGLFNGLPGAGATMRTVINIKSGGRTPISGMAHSVFLLVLLLGAGPLAESIPEALLAGILIKVGLDIIDWGFLLRAHRLSIKTALVMWGVLLMTVFWDLIGAVLVGMFVANLLTIESITTHQLESMNSEDSSQLDQEEQQFLNRCGDALMLFRLQGPLSFGAAKGISERMTQIRQYKILLLDVTDVPHLGITATLAIERMVEEAEHHERQVLIAGANAKVKARLEQFRIHQLTGSRKEALAHAAHELNPA

SEQ ID NO: 47091 - protein, 453 aa, Synechococcus sp. CC9311
MEQSFDLVVLGAGSGGLAAAKRAASYGAKVAIVEGDRVGGTCVIRGCVPKKLLVYGSLLSEQLEGASSYGVSVEGARFDTSVLLRNVRHEVDRLNARHIEFLAKAGVELVTGWGRFLDPHRIGVSREREGEIDQVLQAKRVMISVGGRPVRPDVPGAELAWVSDDMFLQERFPDQVVVVGAGFIACEFAGILRGLGVGVTQLVRGEQLLRGFDSELSGVVLEGMQEKGINLRFGQGLAAIEGRPKDLTVVTKSGDRLPCGGVLLATGRQPFLSGLGLDAAGVVVEGRRIPVDADLATNHSHIFAVGDVTDRICLTPVAVDEGRAFADSVFGSTPRQVNYDLVASAVFSQPELATVGLSEEEAIAKLGADQVVVHRARFRSMAQALPQQGPRCLLKLVLEASSKKVLGCHMVGEHAAEIIQMAAIAVGMGATKADFDRTMALHPTVSEEFVTMA

SEQ ID NO: 47092 - protein, 592 aa, Arabidopsis thaliana
MNSVQLPTAQSSLRSHIHRPSKPVVGFTHFSSRSRIAVAVLSRDETSMTPPPPKLPLPRLKVSPNSLQYPAGYLGAVPERTNEAENGSIAEAMEYLTNILSTKVYDIAIESPLQLAKKLSKRLGVRMYLKREDLQPVFSFKLRGAYNMMVKLPADQLAKGVICSSAGNHAQGVALSASKLGCTAVIVMPVTTPEIKWQAVENLGATVVLFGDSYDQAQAHAKIRAEEEGLTFIPPFDHPDVIAGQGTVGMEITRQAKGPLHAIFVPVGGGGLIAGIAAYVKRVSPEVKIIGVEPADANAMALSLHHGERVILDQVGGFADGVAVKEVGEETFRISRNLMDGVVLVTRDAICASIKDMFEEKRNILEPAGALALAGAEAYCKYYGLKDVNVVAITSGANMNFDKLRIVTELANVGRQQEAVLATLMPEKPGSFKQFCELVGPMNISEFKYRCSSEKEAVVLYSVGVHTAGELKALQKRMESSQLKTVNLTTSDLVKDHLCYLMGGRSTVGDEVLCRFTFPERPGALMNFLDSFSPRWNITLFHYHGQGETGANVLVGIQVPEQEMEEFKNRAKALGYDYFLVSDDDYFKLLMH

SEQ ID NO: 47093 - protein, 567 aa, Corynebacterium efficiens YS-314
MAFSVEMPELGESVTEGTITQWLKAVGDTVEVDEPLLEVSTDKVDTEIPSPVAGVILEIKAEEDDTVDVGGIIAIIGEEGEEGAESTEAPAEQEEAPAEEAPKEEPKKQAPASSGAATDVEMPELGESVTEGTITQWLKAVGDTIEVDEPLLEVSTDKVDTEIPSPVAGTIVEILAEEDDTVDVGAVIARIGDANAAPAEDAPAEEEAPAQNEAPVEETPDVTKDEAKKVEQDEPKAEKAEKKSEPKAAPQKTNTDNVPYVTPLVRKLAEKHGVDLNSVKGTGIGGRIRKQDVLAAASGESAPAEKEAASAAPASAASTKSVDPEKAKLRGTTQKVNRIREITARKTVEALQISAQLTQLHEVDMTRVAELRKSNKPAFQEKHGVNLTYLPFFVKAVVEALVAHPNVNASYNAETKEMTYHASVNMSIAVDTPAGLLTPVIHNAQDLSLPEIAKAIVDLADRARNNKLKPNDLSGGTFTITNIGSEGALSDTPILIPPQAGILGTGAIVKRPVVITEDGIDSIAIRQMVHLPLTYDHQVVDGADAGRFMTTIKDRLETANFEGDLEL

SEQ ID NO: 47094 - protein, 388 aa, Legionella pneumophila subsp. pneumophila str. Philadelphia 1
MNHYEKMSLLKDSATVAINSLAQQKINAGIKIHNLSAGEPKLPPHPSIINAVTQAMEQGHTLYPPIMGIPELRHMGCEWMYRSYDCSFQNEQCLVVNGGKLGIYLLMQLLLQPNDEVIIPSPYWVSYPAMVSLFGGTPVPVETTEAEEWKLTPQALQKACTTKSKILILNNATNPTGALYTQSELIHLLQTAKKHNLLVISDEVYSELTYDGHHYVSCGSLPQFRERVIIIQSCSKNFSMTGWRVGFIFAPEIFIKPLSALVSQSTSGVTTLSQWAAVAALQEVNQVNIWVQQNMEKRRNCLLRTLHDYLGLTITPPISSLYVFLSLKDIGCKNQNSEEFCKQALDKANVAMVPGIAFGKEGYVRLSFGGNEDDLKSGIYALAQWLHR

SEQ ID NO: 47095 - protein, 192 aa, Schizosaccharomyces pombe 972h-
MSLQIGKPAPDFKGTAVVNGAFEEIKLADYKGKWVFLGFYPLDFTFVCPTEIVAFSEAASKFAERNAQVILTSTDSEYSHLAFINTPRKEGGLGGINIPLLADPSHKVSRDYGVLIEDAGVAFRGLFLIDPKGVLRQITINDLPVGRSVDEALRLLDAFQFVEEHGEVCPANWHKGSDTIDTKNPEKYFSKH

SEQ ID NO: 47096 - protein, 253 aa, Schizosaccharomyces pombe 972h-
MAESAPRGFGRGGRGGRGRGRGRRGAKRDEEKEWVPVTKLGRLVKAGKIKSIEEIYLYSLPIKEYQIVDYFLPRLNDEVMKVVPVQKQTRAGQRTRFKAFVVIGDSDGHVGLGIKCAKEVATAIRGAIIMGKLSIMPIRRGYWGTALGDPHTVPVKVSGKCGSVTVRLVPAPRGAGLVAAPVTKRFLQLAGIEDCYTQSRGSTKTLGNFVKAAFAAASLTYGILTPNLWAERPFGQTPIEEYADILMQTEKKY

SEQ ID NO: 47097 - protein, 301 aa, Triticum aestivum
  misc_feature (148)..(148): Xaa can be any naturally occurring amino acid
  misc_feature (174)..(174): Xaa can be any naturally occurring amino acid
  misc_feature (206)..(206): Xaa can be any naturally occurring amino acid
  misc_feature (239)..(239): Xaa can be any naturally occurring amino acid
  misc_feature (248)..(248): Xaa can be any naturally occurring amino acid
  misc_feature (252)..(252): Xaa can be any naturally occurring amino acid
MGLKAAVFLSVPAAVTPTLRRHNLSPSSFRSSRASASRISAAVMATAVQPAVVVGGGRVGQALLSMGPSSGGDLLLRRGEALPPAAPAGPILVCTRNDDLDGVLDATPKSRWQDLVFFQNGMLDPWLESKGLAGANQVLAYFAVSKLXGEPPIDGITDANPEGLTAAFGNWGAXVAARLQNGGLTCKVLDKGAFEKQMLEKLIWIXPSMLGGARHPGAPVAAVEKEYRSEVSSLIAELXSAAAAERGXTFDXGMEESLPYSQTLAHFPTAVKDFKVADGWFYSSTEKPPKEPDSRPTLSKN

SEQ ID NO: 47098 - protein, 640 aa, Saccharomyces cerevisiae
MRRERQRMMSFEDKDKDDLDNSNSNNSSEMTDTAMMPPLKRLLITGSSDDLAQGSSGKKKITMATRSPSSSPDLATNDSGTRVQPLPEYNFTKFCYRHNPDIQFSPTHTACYKQDLKRTQEINANIAKLPLQEQSDIHHIISKYSNSNDKIRKLILDGILSTSCFPQLSYISSLVTHMIKIDFISILPQELSLKILSYLDCQSLCNATRVCRKWQKLADDDRVWYHMCEQHIDRKCPNCGWGLPLLHMKRARIQQNSTGSSSNADIQTQTTRPWKVIYRERFKVESNWRKGHCRIQEFKGHMDGVLTLQFNYRLLFTGSYDSTIGIWDLFTGKLIRRLSGHSDGVKTLYFDDRKLITGSLDKTIRVWNYITGECISTYRGHSDSVLSVDSYQKVIVSGSADKTVKVWHVESRTCYTLRGHTEWVNCVKLHPKSFSCFSCSDDTTIRMWDIRTNSCLKVFRGHVGQVQKIIPLTIKDVENLATDNTSDGSSPQDDPTMTDGADESDTPSNEQETVLDENIPYPTHLLSCGLDNTIKLWDVKTGKCIRTQFGHVEGVWDIAADNFRIISGSHDGSIKVWDLQSGKCMHTFNGRRLQRETQHTQTQSLGDKVAPIACVCIGDSECFSGDEFGCVKMYKFDLND

SEQ ID NO: 47099 - protein, 162 aa, Mycobacterium leprae TN
MQFDVTIEIPKGQRNKYEVDHKTGRVRLDRYLYTPMAYPTDYGFIEDTLGEDGDPLDALVLLPEPLFPGVLVEARPVGMFRMVDEHGGDDKVLCVPVNDHRWDHIHGIIDVPTFELDAIKHFFVHYKDLEPGKFVKAADWVGRDEAEAEVQRSVERFKAGGH

SEQ ID NO: 47100 - protein, 426 aa, Mesorhizobium sp. BNC1
MTSHEPASSAPTTTPVRALSMSTIAFTVCFAVWTIFSIIGVRIKEELGLSETQFGLLVGTPILTGSLVRLALGIWTDRYGGRLVYTVTMLAAAIATFLLSFAHTYAHLLLAGLGVGLAGGSFAVGVAYVSRFYPAQKQGTALGIFGVGNVGAAVTKFLAPFVLVAWGWEAVAQVWALALAAMAILFWFTTGDDPVIRARRAGQGAQHSFAADFEPLKNLQVWRFALYYFFVFGGFVALSLWLPRYLIGVYGFDIATAGMIGAAYSIPASVFRAYGGALSDRSGARTVMYWTFAVSAVCALILSIPPTDYVVRGVNGPIAAHFEIGPWAFIAVIFVLGFFMSLGKAAVYKHIPVYYPQNVGAVGGLVGMIGGLGGFFLPLLFGWLNDVTGLWTSCFMALFVIVAGSLVWMHIAIRQMERRQAGLQPA

SEQ ID NO: 47101 - protein, 363 aa, Francisella tularensis subsp. holarctica
MGFKCGIVGLPNVGKSTLFNALTEAGIDAENYPFCTIDPNVGIVSVPDQRLNELAKIVKPERIITTTMEFVDIAGLVTGASKGEGLGNKFLANIRETDAIAHVVRCFEDDNIIHVSGKVDPIDDINIINMELILADIEYCDRTVQRFAKMKKSGDKEALAKADFYTRLKEHLESEKHARTFEMNEDETKWLKQTPLLTSKPVLYIANVNENGFENNPLLDKVVEYAKAENSNVVPVCAAMEQEISQLEADEKLEFLADMGLSETGLDRVIKAGYALLNLHTYLTAGVKEVRAWTIPIGATAPQAAGVIHTDFERGFIRAEVIAYDDYIKYNGEKGAKEAGKARLEGKEYIMKDGDVVNFRFNV

SEQ ID NO: 47102 - protein, 472 aa, Burkholderia xenovorans LB400
MKNDLPEVAALEALLRDQRHAYLRAPYPSWETRAAHLKALRKVMLDNRDALADAMNVDFGNRAKQEVLLAEFLLVKEEIDAALRHGKRWMKSQRRSTSKWLLPARAKVVPQPLGVVGIIVPWNYPVLLAVGPLISALTAGNRAIIKMSELTPRTSALFEQLIGQTFARDHVAVVNGDAALAAAFSAQPFDHLLFTGSTRVGHEVMRAAAEHLTPVTLELGGKSPAIIGAHARFDNAVDNLVAGKTLNAGQTCVAPDYVLVPRGKEQAFVERARARMARMYPNFANNPDYTTIISARHFARLERLADEAQAAGAQLHPLTDSSPDAASRRFPLIAVTNAPDACALMQEEIFGPLLPIVPYDTLDDAIAWINARPRPLALYLYADDAATIGRVTHETIAGGMAVNETLMHLACESLPFGGVGASGMGAYHGYEGFVTFSKMKPVLTQARLNARGWISPPYGKRVNALLKLMMRF

SEQ ID NO: 47103 - protein, 274 aa, Mesorhizobium sp. BNC1
MVTYLDADTAPLRNTGQIRLYGKDGFEGMRRACQLTARCLDELVSIVKPGVTTNAIDQFVFEFGMDHGALPATLNYRGYTKSTCTSINHVVCHGIPDDKPLREGDIVNIDVTYVLDGWHGDSSRMYPVGQIKRAAERLLEVTHECLMRGVEAVKPGARTGAIGAAIQTYAENQRCSVVRDFCGHGVGRLFHDAPNILHYGSPNEGVEMRPGMIFTIEPMINLGRPHVKVLSDGWTAVTRDRSLSAQYEHSVGVTETGCEIFTLSPAGLDRPGLP

SEQ ID NO: 47104 - protein, 452 aa, Burkholderia thailandensis E264
MRKMTATHTGPRTSPMPLPTVPTAPFCPAEVKGSITIDAGVSGLAKLRRFAGPGLLVAIGYMDPGNWATDIQAGSQFGYALLWVVVFSSVAAIFLQMLAARLGLVAGRDLAQASYERYGPFGRIVQWVTAEVSIIACDIAEVLGCALAFKLLLGVPLAWGIVLTALDTMIVLGLQGKGFRQVEAIVLGLIGTMAFCFVAQVAMVPPDWRAVLHGLAPGLPGHDRKDAVVLALGIVGATIMPHNLYLHSSVVQTRRVVGGVGDVIKETLAMVRIDTWISLAVAMLVNAAILILAGAAFHASGQTGVVDIEQAYKLITPIVGGAAAWLLGIALLASGQSSTLTGTIAGQVIMDGFLRMKIPCYQRRLITRGLALMPALVGVLWLGDGAVGRLLVWSQVLLSLQLPFAMWPLIRSVGDRSVMRDYTIGRGAKIIAWALFVLISGTNLLLVAGFAG

SEQ ID NO: 47105 - protein, 178 aa, Zea mays
MAGATTPASGALVRLCLPSLLLFLYRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDEL

SEQ ID NO: 47106 - protein, 481 aa, Mycobacterium tuberculosis CDC1551
MVGPRTRGYAIHKLGFCSVVMLGINSIIGAGIFLTPGEVIGLAGPFAPMAYVLAGIFAGVVAIVFATAARYVRTNGASYAYTTAAFGRRIGIYVGVTHAITASIAWGVLASFFVSTLLRVAFPDKAWADAEQLFSVKTLTFLGFIGVLLAINLFGNRAIKWANGTSTVGKAFALSAFIVGGLWIITTQHVNNYATAWSAYSATPYSLLGVAEIGKGTFSSMALATIVALYAFTGFESIANAAEEMDAPDRNLPRAIPIAIFSVGAIYLLTLTVAMLLGSNKIAASDDTVKLAAAIGNATFRTIIVVGALISMFGINVAASFGAPRLWTALADSGVLPTRLSRKNQYDVPMVSFAITASLALAFPLALRFDNLHLTGLAVIARFVQFIIVPIALIALARSQAVEHAAVRRNAFTDKVLPLVAIVVSVGLAVSYDYRCIFLVRGGPNYFSIALIVITFIVVPAMAYLHYYRIIRRVGDRPSTR

SEQ ID NO: 47107 - protein, 466 aa, Francisella tularensis subsp. holarctica
MEYNYDIIIIGSGPGGEGAAMKATRNGQKVAIIEDDAIGGGCNNWGTIPSKALRQLSREVWYNKKNFDFPEMLDTAYEIVIKQREIKRNRFANNEIDVFYGFASFIDKHKIKISRKNGSTEIITAKKFILSTGSRPYHPDDIDFTHPRILDSDKLLELKDKNIKSITIYGAGVIGCEYASILGTLDIQVNLINTRNKLMSFLDDEIIETLTNHFTINQRINLIHNETYKSIKARGDKVVTTLNSGRIIESDYVLFALGRSGNTNGLNLDKIGVEYDPQRGLVKVNDNYQTTQENIYAVGDVIGFPSLASSAFNQGRFAATHIIDGSCNDKLVEDIPTGIYTRPEISCIGKTEEQLTAENIPYEVGRAYFKDLARAQISGSETGMLKILFHKETLEILGIHCFGHRVSEIIHIGQAIKSMPGKHNTIRYFLNTTFNYPTMAEAYRIAGIDGLNKLKPKNKQFVPEYQ

SEQ ID NO: 47108 - protein, 492 aa, Mycobacterium avium subsp. paratuberculosis K-10
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATAIVADWPTNDARFLFHPAMKELTLDIASLVFMGHEPGTDHDLVTTVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESARLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 47109 - protein, 275 aa, Staphylococcus aureus subsp. aureus MW2
MALYGFAQGLIQEAGIRIKQLMEQNLTIETKSNPNDLVTNVDKATEDFIFDTILETYPNHQVLGEEGHGHDIDTSKGTVWVVDPIDGTLNFVHQQENFAISIGIYIDGKPYAGFVYDVMADVLYHAKVGEGAYRGSQPLKPLNDSNLRQSIIGINPNWLTKPILGEIFKEIVNDSRSARAYGSAALEIVSVATGNLEAYMTPRLQPWDFAGGLVILYEVNGQASNLLGEPLTISGPNSILVGNRGLHQEISNDYLEPHHDALIQLHEQRFKRKSK

SEQ ID NO: 47110 - protein, 396 aa, Wolbachia endosymbiont of Drosophila ananassae
MNIALKHRPSSFKDLVGQYILVRVLENAFILNKIPQSILLSGSSGVGKTTTARIIALCLNCSLGPIFEPCGSCENCLAIKNSSHPDVIEIDAASHTSIDDIKVILGDICYSPISSKFKVYIIDEVHMLSSSAFNALLKTLEEPPSSVKFILATTEIKKIPITIIARCQRFDLHNIPVAKIVERLNDVAQKESYSIEKGALELIARHSGNSMRNALFLMNQAVLYSKDGAISTKNVTDILGLVDKDIIFDLLGAILEGDLQKALSVFDKAVKTANPLSIFEGLLQTIQLVCRFLITKEIDNAVTEHEKNRIKDLSIKRSLIFFSRLWKMLLKGIQDIKTSTCNDVAAEMMLISLCYLSDLPSPEQVIKKVLSQNVEQGNRQGRPVAPSPSVIQVADY

SEQ ID NO: 47111 - protein, 514 aa, Triticum aestivum
MEITINSLTYKGSIPDAINQSRRKKKLFVIYISGQDETSSSLEQSTLVDEHVAAVISRCCIFLQLKQGDVDALQFSAIYPQKSVPSISVVGLSGAMLWNHEGYISPEDLKESIDKAWAALQLQETAATLLAASLASRMSEPANTASTTMPGEDGSSTSENHSNSSGQSSESSAVRGFANSTALVAQPPSSTSHAELLKTSKIPKSDSAPCNITAEEKLDSACQALLPDFPASSNVDSSTDPNQTGSTPSPKRKNMVDGNSPKVPSKPASSIPTRSTPQLPVEQDKATTSRAIEVTTDSAKKDDIQLAIRMPDGPSLQIKLTKEDVLRKVKTFVDENQDSGIGSYNLAMLYPRKVFTEQDLETTLYELGIETRQALVVVPNRQSVKVARHQSSLPSSDLDRTGDTDRSGGWGFLGAALSYVNPLSYLRGNPTPSNPDQLGNEGSQQYRPNSESQPLRSDGSQQTATHSSGNTLRRRPRQFGGNIHTLSSEEQDPSDNRNVFWNGNSTEFGGDEKK

SEQ ID NO: 47112 - protein, 578 aa, Opitutaceae bacterium TAV2
MHQFDLILTLTGGFITALVLGLGTQRLGLSPIVGYLLAGIVVSPHTPGFVANKEMAEQLSEIGVILLMFGVGLQFHFKELLAVRRVAIPGALVQSAVATLLGAVVVHWFGWSWPAGIVFGLALSVASTVVLTRVLVDNNHLHTPTGHIAIGWLVVEDLLTVFVLVLLPALFGPGGHAGGGGISLAMGVAALKIGALVAFTFAVGNWLIPRLLTAIAATGSQELFTLGVLAIALGIAVGSAALFGVSMALGAFLAGMVVGRSDFSLRAATDALPMRDAFAVLFFVSIGMLFDFGSLLATPWIALATLGVVLIGKPVAALVLVVAMRYPFRVALSVSVALAQIGEFSFILAAMGRQLGVLPEQASNILVAAAVVSITLNPLLYRTVKPVEAWVSRMPWLWHWLNVHDHGARAATRTPKVDARHRAVVVGYGPVGQTVVRLMKDNDIESTVVELDLKTVQHLRSEGVEAVYGDAGRPETLRQAGLRQAAVLILSASSIEAGREVIRIARELNPRIRVLARTASLHEVAALRIAGADRVFTGEGEVALAMTEFILGQFNATREQIDRERERIREELFDKRTG

SEQ ID NO: 47113 - protein, 150 aa, Glycine max
  misc_feature (16)..(16): Xaa can be any naturally occurring amino acid
  misc_feature (20)..(20): Xaa can be any naturally occurring amino acid
  misc_feature (50)..(50): Xaa can be any naturally occurring amino acid
  misc_feature (65)..(66): Xaa can be any naturally occurring amino acid
  misc_feature (73)..(75): Xaa can be any naturally occurring amino acid
  misc_feature (77)..(78): Xaa can be any naturally occurring amino acid
  misc_feature (81)..(81): Xaa can be any naturally occurring amino acid
  misc_feature (86)..(89): Xaa can be any naturally occurring amino acid
  misc_feature (92)..(93): Xaa can be any naturally occurring amino acid
  misc_feature (95)..(98): Xaa can be any naturally occurring amino acid
  misc_feature (100)..(104): Xaa can be any naturally occurring amino acid
  misc_feature (106)..(106): Xaa can be any naturally occurring amino acid
  misc_feature (108)..(108): Xaa can be any naturally occurring amino acid
  misc_feature (111)..(111): Xaa can be any naturally occurring amino acid
  misc_feature (115)..(115): Xaa can be any naturally occurring amino acid
  misc_feature (118)..(118): Xaa can be any naturally occurring amino acid
  misc_feature (120)..(124): Xaa can be any naturally occurring amino acid
  misc_feature (126)..(127): Xaa can be any naturally occurring amino acid
  misc_feature (129)..(130): Xaa can be any naturally occurring amino acid
  misc_feature (132)..(136): Xaa can be any naturally occurring amino acid
  misc_feature (138)..(138): Xaa can be any naturally occurring amino acid
  misc_feature (140)..(140): Xaa can be any naturally occurring amino acid
MSQTKKLTPNLDQQSXRWCXNFTVLQRIDPFIEEILFSAAHVSFYDFNIXSNHWSLKDVEGSLFXXPWRNSQXXXQXXVLXLRNSXXXXENXXDXXXXLXXXXXLXLXALXMLTXAWXNXXXXXEXXAXXYXXXXXAXPXMMALFASGKC

SEQ ID NO: 47114 - protein, 870 aa, Salinibacter ruber DSM 13855
MMPASGRPWVVCKFGGTSVSSRARWDTIVEVVRTHRAEGRAPFLVCSALQGISDQLEALCAQLASAEPGAPESTLNTIRERHRALGQDLGVEAEAVLSGEFARLERWVDEIQATDGPSPRQRAAVLATGELLSTRLGAAYLSAQGLPAEWLDAREFLRATDDPHLPPRRQYLAANCTSHADPGLQARLADAPETVYLTQGFIASNALDETVLLGRGGSDTSAAHFAAKLEAERTEVWTDVPGLFTANPGEVPSGRLLRRLDYDEAQELATMGARVLHPRCLDPARRHQIPLHVRSTEAPSLDGTIVSGEGPDVGPQVKAISAKTDITAVSMDTLGMWQEVGFLADVFQVFKHHGLSVDLMATSESNVTVTLDPVANALDPDILDRLLHDLNRYCDAELIDPCAIVSLVGRHIRSLLSELGPAFEVFDEQKVHLVTQAASDLNMSFVVDEDQASRLVRELHAQFFGHRAPDAVFGPRWQELVEDGTPEETPDVWWRERREALLRLADDESPRYVYDPEVVTARSDEVQGLGPIDQSFYAVKANPHPEVLRLLERRGLGFECVSPGELDRVFEACPGLDPARVLFQPNFAAPAEYADAFERGVHVTVDNVQPLAEHPDVFAGEELFVRVDPGQGEGHHRKVRTAGAQSKFGVVPDDLGRLRAAVDQAGATVVGLHAHVGSGITDESTWAGLVDLLASLAAEFPAVRALNVGGGLGVPNASGGRPLDLDALDAALGKAAARHPQYDLWMEPGRYLVAEAGVLLARVTQTKTKDAAAYVGLDTGMNSLLRPALYGAHHEIVNLSRLDEPPAMTADVVGPVCETGDVLGHDRRLPPTEPGDTLLVATTGAYGASMSNRYNLREPASEVMLAPEPA

SEQ ID NO: 47115 - protein, 132 aa, Mycobacterium leprae TN
MADRMELRGLIVRGRHGVYEVERANGQDFIVDVILWIDLADAAANDNLADTYDYVVLAERTAAIIAGPPRNLIETVGSEIADFVMDDERVHAVEVVVHKPQAPIPQQFSDVAVVVRRSRRGGRGSMIPASGV

SEQ ID NO: 47116 - protein, 235 aa, Mesorhizobium sp. BNC1
MTDAKTLKIEAARVALGYVEDGMKLGIGTGSTAEEFVRLLATRVSSGMKIVGVPTSERTAALCRELSVPLSTLDETPELDLTVDGADEVGPDLTLIKGGGGALLREKIVAAASRRMIVIADESKVVDVLGTFPLPIEVNPFGLRATRIAIEAAAARLGLAGEMRTRMAGQEPFVTDGGHFIIDASFGRIQAPRALAEALNAIPGVVEHGLFIGLAGAAIIAGRNGVRTLDAGSRI

SEQ ID NO: 47117 - protein, 460 aa, Mesorhizobium sp. BNC1
MAKYDLDLFVIGGGSGGVRAGRVAASMGKRVAIAEEYRFGGTCVIRGCVPKKLFVYASQFPEHFEDAAGYGWAVGESRFDWATLIANKDKEIARLEGLYRKGLENAGARLIDGRAVLVDSHTVRVGGETFTAEHILVATGGRPNPHVALPGREHCITSNEAFHLEELPASIAIEGGGYIAVEFANIFHGLGVKTTLIYRGREILSRFDGDLRKGLHEAMEAKGIRILCQDIIEQVEKQPDGRLAAHLMSGGVETFDKIMLAIGRVPNTEGLGLEAAGVETGVRGEILVDGYSRTNVENIWAIGDVTDRVQLTPVAIHEAMCFIETAFKDNPTTVDHRDIATAVFSQPEIGTVGLAEEEAGKHFEELEIYRASFRPMRHTLAGRQDKMIMKLVVDAASKRVVGAHILGPDAGEMAQLLGIAIKGRLTKDVFDRTMAVHPTAAEELVTMYQPSYRVRNGERV

SEQ ID NO: 47118 - protein, 345 aa, Pseudomonas fluorescens Pf-5
MSRPSRSATPQPSVDMALLERYVKMILAAPVYDLAIRTPLQAAPALSERLGNQILLKREDLQPTFSFKIRGAYNRLAHLTPEQKLRGVVTASAGNHAQGVALAARELGIKASIVMPASTPELKVLGVRSRGAEAILHGQSFPFALEHALDLAQRTGSTFVSPFDDPHVIAGQGTVAMEILRQQQGELDAIFVPVGGGGLIAGIAAYVKYLRPQIRIVGVESEHSNCLQQALAAGQRVVLPEVGTFADGVAVAQIGEHGFQICRHHVDQVISVSNDQLCAAIKDIYDDTRSITEPSGALAVAGIKEYVAQSGVRGQTLVAIDSGANINFDSLRHVAERAALSNAAL

SEQ ID NO: 47119 - protein, 552 aa, Burkholderia xenovorans LB400
MVKPTLEEIRASDLTPLERELALASFGAEALADVPDAVMPAAAAVAAIDAALRDSAHTHPAEGVAAIRDAAASSPASAASAHAIHAPYDPALDSNPYMQAWRGRLDALRARNAIARPMRACGRLTRAAGLVLEAVGLRLSVGAEVMIELPQGSSLPMAEAEVVGFSGDKLFLMPTTEVMGLLPGARVFPLESAPIADPMAGAKRLPVGWELLGRVLDASGRPLDGLGPLGAHADAPLSAPVINPLNREPIHKVLDVGVRAINALLTVGRGQRMGLFAGSGVGKSVLLGTMARYTSAEVIVIGLIGERGREVKEFIEQILGEEGLARSVVIAAPADVSPLLRMQAASYSTSLAEYFRDQGKHVLLLMDSLTRYAMAQREIALAVGEPPATKGYPPSVFAKLPALVERTGNGPAGGGSITAFYTVLTEGDDQQDPIADSARAILDGHIVLSRSLAEAGHYPAIDIEASISRAMTALIDDNHLEKTRMFKQMLSRYQRNRDLINVGAYSSGRDALLDRAIALYPRMEAFLQQGFRECANFEPSLEMLDALFAQGG

SEQ ID NO: 47120 - protein, 254 aa, Pseudomonas fluorescens Pf-5
MTQALIKTPEQLALMREAGRLLAQVFTYLDGFVAPGLSTLELDAAVEHLIRHELKARPASKGQYNYPYCINTSINEVVCHGMPHPKAVLKDGDIINIDITLEKNGYIADSSKMYLIGTVGPKARRLVDTTFEAMWAAIKVVRPGARLGDIGHAIQAHAEAKGYSVVREYCGHGIGRQMHEEPQILHFGRPGTGLELREGMVFTIEPMLNQGSARVRGLKDGWTVVTRDNGLSAQWEHTVAVTRDGFEVLTLQPQ

SEQ ID NO: 47121 - protein, 307 aa, Pseudomonas syringae pv. phaseolicola 1448A
MSFPRVALIGECMIELQQHADGSLRQSFGGDTLNTAVYLARLLGERAKVDYVTALGDDSFSDAMCRIWADEGIGLGKVQRLPGRLPGLYCIQTDANGERRFLYWRNEAAVRDCFMTPAAEPILAALASYDVLYFSGITLAVLGEQGRARLLEALDRARQRGVRVAFDNNYRPRLWASVEQAREAYQACLQHVDLALLTEDDEQALYGYADSEQLLAAYRGRGIGEIVVKRGAQSCLVEAGGERFDIASQKVEHVVDTTAAGDSFSAAYLAARLMGEHPRQAAEAGHRLASVVIQHPGALVPKSVMPV

SEQ ID NO: 47122 - protein, 412 aa, Debaryomyces hansenii CBS767
MYCRVFTHFSLYRLYTLLDNININKTNHNKLIGLHQHRVNYMPRSMTASSSQLKRIETRIESLSESLSKSNARKPLGKFQLNTFDNNKITKLQNEKVRPLKSSHIPVKLPIRKKGHSPAQVLQNERMDTKLLLQKLPSASRHMTLDDFEIGKVLGKGKLGKVYCVKHKTSGYIAALKVMAKKDLIDLKLEKNFRREIEIQSNLIHPKISRLYGFFYDHKNVYLILEYSIHGELYHHLKVQRRFNDATASHYIYQVALALDYLHTKHIIHRDIKPENILLSTDNCIKLSDFGWSVKSLPSSSTKRLTICGTLDYLPPEMIESNEHDYTVDIWSLGILCYEFLVGKPPFEEIDKNSTYKRIAKVDLKIPSFLSSEATDLILRLLQKSPKKRITLAEVMNHPWIMNNQQYWPNEN

SEQ ID NO: 47123 - protein, 464 aa, Oryza sativa Indica Group
MAVIALKCPAIEVVVVDISKPRIDAWNSEQLPIYEPGLDEVVKECRGRNLFFSTDVEKHVAEANIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGKKAVQALKEVYAHWVPEDRIITTNLWSAELSKLAANAFLAQRISSVNAISALCEATGANVAEVAYSVGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCHGLLGDKAQISIYDPQVTEDQIQRDLAMSKFDWDHPMHLQPTSPTAFKQVSVVWDAYEATKGAHGVCILTEWDEFKTLDYQKIFDNMQKPAFVFDGRNVVDAEKLREIGFIVYSIGKPLDAWLKDMPAVA

SEQ ID NO: 47124 - protein, 3697 aa, Mycobacterium abscessus
MDSAENPIESTPRFAIIGYAARFPGAADAEEFWDVLREGRDAISEVPADRWDAEEFFDPEPGAPGKVVTRRAGFVEDVTGFDAPFFGMSTREVRLMDPQHRLLLETAWRAVEHSGIAPTDLAETNSGVFVGLATHDYLGMASDELTFPEIEAYMAIGTSNAAAAGRISYRLGLQGPSVAVDTACSSSLVAIHQACQALQLGECDLALAGGANVLLTPATMITFSHAHMLAPDGKCKTFDAAADGYVRGEGSGVIVIKRLEDAIRDGDRIRAVIRGSAINQDGASGGLTVPNGVAQQRVIADALKRAGVAPSEVGYLEAHGTGTSLGDPIEAQAAGAAYGIGRETNDPLLIGSAKTNIGHLEAAAGIAGVIKVILSLENELLPQHRNFQNPSPHIPWDRLPVEVVREARPWGRNGRPRIAGVSSFGFAGTNAHVILEEAPVVSRDAVEPPAPAGGRKFSILPLSARTPAALAQLADKYRAWLNAHPEAALADLCFTAGVGRAHLEHRAALVVNTREAAVELLSAVADDRPAPGLGRGESHDTPKTAWLFTGQGSQYPGMARELFETEPVFADTLNRCAAAVADVLEKPLLDVIFDVDGPEAEETLRQTSYAQPALFAVEMGLARLWQSWGFEPDVVLGHSVGQYSAACVAEVFSLEDGARLIAERGRLFSSLPAGGRMAAVFTDAERAERLTDEFPSLSVAAYNGANTVLSGPAQDLEKAIAALVADGVRCDFLETSHAFHSALLDPILDEFEAYANQFNYKTPQRILIDNRTGTALGRSVKLDGAYWRRHARQPVEFAKSVRTLADMNCKVLLEIGPQPVLTAAALRAWPDPATAPRAIASLRRNTADHRQITEAAADAYVLGHLPDFGAFQHAPARKLDLPTYPFERRQYWFSDKRDGDNRDAGNRQQNNGGPRTEAVRLLEDGKIEELANLLGGVDGDQQTLNVLTKLAAQHNLQRTTQTIADDRYQFRWEKSPTPLSGSQAAGGVTWLLVADAAGAAQPLLDVLTARGQQHRVLALPVSDADEAELVEALRSAADEDSALRIVHVAALAGQGSSSAQSLLRIQHQVLGGTRRLFRAAAAAELRAPIWIVTRGAQHVIEGDTVAPEQSALWGFGRAAALELPQVWGGLADLSDAGTDEWAQFIGRVSVSGEASTREDQLALRGQAVHVPRLVRREELPSGKPLEVRSDATYLVTGGLGSIGLEIAGYLAGRGAKHLVLTSRREPGEAARQRIDALAAQGCEVRAVTADVADGHDVARLLAGIQAELPPLAGIVHAAGEIGTTPLSDLEDAEVDRVFAGKVWGAWHLSEAAAGLKLDFFINTSSIAAVWGGYGQTAYSAANAFLDGLAWRLREQGIAGTSVNFGPWSAGMADAESRARLEQRGIKTLSPTDALAGLADVVAASGSNAVQGVIARIDWARFLPLYQQAGKRGFLAELDREVPSHLAGVAGAQSGSTQLVERLANAPVQQRKKLLTDYLRDAVAEVTRVDVSEIREDAGFFDLGMDSLMAVELRRRMEQGVGKEIPVTLVMDHPRISDVADYLLGDVLGLAEQAKPAAQLASAVTGRTDEPIAIVAVSCRFPGAPDPEAFWDVLSGGVDAIREVPEDRFDIDEFYDPDPEVAGKTYTRFGGFLDGIDGFDPEFFGISPREAVWIEPQQRLMLETVWEGLERAGYSPAALRGSRTGIFAGVGANEYAHLLSSESIDKIEPYFITGNALNAISGRVAFALGFEGPAVAVDTACSSALVAVHQAVQALHSGDCDLALAGGVNVLLSPVTVIAASRARMLSPVGRCKTFDASADGYVRSEGCGILVLKRLSDAERDGDRVLAVIPGSAVNQDGASSGLTVPNGGAQQRLIGSVLARAGLVGGDVDYLEAHGTGTPLGDPIEVQAAAAAYGGSRDADRPLLMGSVKSNIGHTESASGAAGLIKVVLSLQNGVLPQSLHFDNPSPHIPWESLPVRVVDKAIPWQANGRPRRAGVSSFGFTGTNAHVLIEEAPQPQATPDEDDASTPQSAPVSVLPLSARSPEALAAVAQRYESWLAAHPDVDLEDVCLTAGRGRSHFEHRAALVVDSIQTAREGLLELAQNRLRPGVVRGEHTNHPTTAWLFTGQGSQYPGMARELFDAEPVFAETVTRCAEAVKDIVTRPLLEVMFATDRETGGKAGEALRHTSFAQPALFAVEMGLARLWQSWGIEPDVVLGHSVGQYAAACVAGVFSIEDGARLIAERGRLFGGLPAGGRMVAVFSDAKHVEQIAGEFPRVSVGAYNGPNTVLSGPGEDLEQAVARFQEEGIRCTWLETSHAFHSELLDPILDEFESYAAQVQFAAPTLPLVCNRTGAVLTAQTPIDGQYWRRHSRQPVQFAESVRTVAALGCSVLMEIGPQPVLTGAAVQVWPEHLAPPRAIVSLRKGVEDRRQIADALASAYVSGHRPNFAALQRHPRRTVELPTYPFQRRRFWPKSSGTAIEGGGGLPSGILGRGEDLASGDSVYISRLSVRSQPWLSDHVIYGTVVVPGATYAAMALAAVGTPARAKDVFFYEPIILPEKSSREVQLTLHPLEDGSGSKFQVHSRPYGERDVDWSLNAEGTVVTGIGDDAEPAPEAAEPAEPVDAAIERMERMRPMELFEIFADLELAWGPTWSGSLKSLWLGEGEAIGDVLVGEELAEQLGTEPMHPVLMDLCTGVAFPAFPALLAAEQGVNDLFLPLRYGQVTLKEKMPRRFYCRARWHESPLDSETQVFDLDYLDRDGRHLGGIREFTVKRAPREALLRGLGGDATRLLYTLGWHEVAVPPVAGEGEESAASIGTWLIAGFDELAAKVPGCIPLNRETDPELLGEVLVAAKERGVPFSGVVWRAAGPGATESTTESAARLEGEIAHLLSAVHTVQNSAQNGVKLPGGLWIVTERAVATESGEPVDPVQAALWGFGRTTINEEPALRAKLVDGDGSPEAVQALARLLVTPVDEPEIAVRQGKLLASRLLPWSRTGHLTVPRGSDYVLAPTERGAIDNLRITEKEVPAPDEGYVQVRVEAAGLNFRDVLNVLGLYPGDPGPIGGDFAGIVTQLGEGVTGVEVGQRVYGSMQGAFGSRFNVPAQFLAPIPDGISGVEAATIPAAALTVRLSFDWAQLKPGDKVLIHAASGGVGLAAIQMAQQFGAEVFATASTFKRATLRKLGVKYVYDSRTTDFADQILADTDGAGVDVVLNSLTSEGFIEATLRATAKNGRFAEIAKRDIWTTEQMAQSRPDIAYEIVALDTVMFQEPDRIRVLLTEVSEGLAKGEWTPLPAEIYPLTEARTAFRRMQQARHIGKIVCQMPNPLAPRPDRTYLITGGLGAIGLHTAAYLAQLGAGDIVLTSRRAPDTDAQRVIGEITERSKTRIHVFTADVGAESEVAGLLERIRAELPPLAGVAHLAGVLDDALLGQQSVERFRTTLAPKAFGAEYLDRLTKGDDLDFFIVSSSVSSLFGSPGQSNYATANALLDGLIAQRRAQGLPATGINFGPWGQGGMASSEAATANISAQGLIPLDPSAALAALAEVVANGTGQATILKANWQRAAKVLGSSRPPILDLVLPSAVGEVTGDSELLKQLMEIPVPQRAGFVTEFLQREVQNFLRLAQPPAATSRFLDLGTDSLMAIELRNRLHSQFGGKFTINATAVFDYPTIGGLAEYLVGQLPDADAESAEAPPAVESAEAESGAGPAAASDAVSELKE

SEQ ID NO: 47125 - protein, 464 aa, Oryza sativa Indica Group
MAVIALKCPAIEVVVVDISKPRVDAWNSDQLPIYEPGLDEVVKECRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGKKAVQALKEVYAHWVPEDRIITTNLWSAELSKLAANAFLAQRISSVNAISALCEATGANVSEVAYAVGKDTRIGPKFLNASVGFGGSCFQKDILNLVYICECNGLPEVANYWKQVIKINDYQKSRFVNRVVASMFNTVSGKKIAVLGFAFKKDTGDTRETPAIDVCHGLLGDKAQISIYDPQVTEDQIQRDLSMAKFDWDHPRHLQPTSPTAFKQVSVVWDAYEATKGAHGLCILTEWDEFKTLDYQRIFDNMQKPAFVFDGRNVVDPEKLREIGFIVYSIGKPLDAWLKDMPAVA

SEQ ID NO: 47126 - protein, 351 aa, Bordetella bronchiseptica RB50
MSQARPATLRVAVLGAGSWGTALAAAASRRHPTVLWARDGAQAQAMAARHENTRYLPGVALPPALQVSADLAQALAHLAHDPAHALIILGVPVAGMTPLCTELAARLPALGLQAVPLVWTCKGFEEQTARLPHETVQAALGAMPGLAAGVLSGPSFAREVAQGLPVALTVASESSAVRDAVTTALHGAAVRIYASTDVVGVEVGGALKNVIAVACGICDGLALGTNARAALITRGLAEMARFGAALGAQQETFAGLTGLGDLVLTATGELSRNRRVGLEIGAGRKLADILASGMTAEGVRCARAARDRARALNIELPITEAVCAVLFEGLSPMTAVSALLAREARPESPTP

SEQ ID NO: 47127 - protein, 619 aa, Auricularia polytricha
MALLPLLLLAAYAAPGLGALVEKWWDITFVNANPDGLFERRVVGVNGSWPPPPIELTVNDTLRVHATNKLDKPTTLHHHGMFFNGTSYFDGAAGVSQCGIPPGETFTYDVDVANSGQWGTYWVHSHASGHYVDGLRAPVVIHNVPETHVYDDEFTVVIGDWYHDQHEDLLKQFISRGNPGGAEPVPDSALIYFTHNGQYLRSSTNPNAVGFSENATLPFEPGKTYRLRIVNTSAFSMFFFWIDGHDMRVIEVDGTDVQEFPASLLSLTVAQRYSVLVTARNDTSSNFLLHANMDTDMFDVVPDGLNPNTTATIVYDKNAATADGVDKDAYFDFPDISLVPIIQEPQQKATHQIVLNVLFDTMTDGTNRAMFNNITYNTPVVPSIFSELSLGQDAVQAQLYGPTSFVLNQFDVVEIKVVNFDAGKHPIHLHGHKFQIVHKSTDFTSDDPTLNPPLMEGQLNPVRRDTVQVPSMGSASLRFVADNPGAWFLHCHIEWHLEAGLAVTFFEAPLEAQQKLKPPQFMFDQCKAMGVPTAGNAAGHTGADLSGLKVGPFQQKLGWRPKGIVAMTGCVLTATLGMLTVAWYAWGGHISDEEVEDEVRRRQEARSARPSIFSRMKKN

SEQ ID NO: 47128 - protein, 352 aa, Rhodococcus sp. TK6
MRVFAVQPDDTAIHDLEVPTPSPEGRQVLLKVVRAGVCHTDTHLRAGGYDLGSRGMMSMKARGIEYPMVLGHEVVGVVEKVGDSVESVRVGDVRLIYPWIGCGECRQCREGHDNRCAAGKNLGVARHGGYAEYILVPDEKYLVDIDGLDPSWAATLACSGLTAYSAVDKVLPLEPDEPVVVFGAGGLGLTAIAILRSRGHRNICAVDVAERNLALAQDMGASSTVLSGPGSGADDIRRAAGGPASAVIDFVNNGVTATAAFEVLAKAGIMVQVGLFGGEVTLPTALLALRMIRIEGSFVGTPAQMQELVRLAQRGALPHIPLVERPLSAAAVSQALDDLTAGGVAGRIVLTA

SEQ ID NO: 47129 - protein, 620 aa, Auricularia polytricha
MALLPLLLLAAYAAPGLGALVEKWWDITFVNANPDGLFERRVVGVNGSWPPPPIELTVNDTLRVHATNKLDKPTTLHHHGMFFNGTSYFDGAAGVSQCGIPPGETFTYDVDVANSGQWGTYWVHSHASGHYVDGLRAPVVIHNVPETHVYDDEFTVVIGDWYHDQHEDLLKQFISRGNPGGAEPVPDSALIYFTHNGQYLRSSTNPNAVGFSENATLPFEPGKTYRLRIVNTSAFSMFFFWIDGHDMRVIEVDGTDVQEFPASLLSLTVAQRYSVLVTARNDTSSNFLLHANMDTDMFDVVPDGLNPNTTATIVYDKNAATADGVDKDAYFDFPDISLVPIIQEPQQKATHQIVLNVLFDTMTDGTNRAMFNNITYNTPVVPSIFSELSLGQDAVQAQLYGPTSFVLNQFDVVEIKVVNFDAGKHPIFHLHGHKFQIVHKSTDFTSDDPTLNPPLMEGQLNPVRRDTVQVPSMGSASLRFVADNPGAWFLHCHIEWHLEAGLAVTFFEAPLEAQQKLKPPQFMFDQCKAMGVPTAGNAAGHTGADLSGLKVGPFQQKLGWRPKGIVAMTGCVLTATLGMLTVAWYAWGGHISDEEVEDEVRRRQEARSARPSIFSRMKKN

SEQ ID NO: 47130 - protein, 647 aa, Yarrowia lipolytica CLIB122
MSFPQQVIAPGQRLNELLEAIKQEFDSVTNEASVYRLHKDEFDVKVNQQTSDLGQIRQSVYELEMAHRKMKERYEEEIMRLKSELEARGGPAANPAHSQQQQQQQQQQQQQQQQNQQAQDQQARAAQQQAAQQQALAQQQAAQQQALAQQQAQAQQQAQAQAHHMGGVPPSQGQPPSLLRPSSNVFSGIMSGQPGTSSLAPPQGQPGQPQPGQPQPGQPQPYSGYVGANGYTSSPHNGPPVISAMASPNSKKRQVSTPVPGKASPQVAPQEMQQQQQQQGPPQQQQPPQQQQQSPEEMGNYLGDMDIERVPPELKKQKADWFVVYNQRAPRLLDVDIVQSLDHNSVVCCVRFSADGKYIATGCNRSAQIFDVQTGQLICRLQDDSVDREGDLYIRSVCFSPDGKYLATGAEDKQIRVWDIKSQSIRHVFTGHEQDIYSLDFSRNGRHIASGSGDRTVRMWDIESGQCTLTLSIEDGVTTVAISPDGKFVAAGSLDKSVRIWDTSTGFLVERLEAPDGHKDSVYSVAFTPNGMDLVSGSLDKTIKLWELQAPRGIQANQRGGVCVKTLCGHKDFVLSVASTLDGQWILSGSKDRGVQFWDPRTGQVQLMLQGHRNSVISVAPSPMGGLFATGSGDCKARIWRYFPVNR

SEQ ID NO: 47131 - protein, 426 aa, Oceanobacillus iheyensis HTE831
MTTIVDKARNDMAVFEEMESAVRSYSRGWPVVFEKAKGYKLWDKNGNEYIDFFAGAGALNYGHNPSEMQKVMIDYIQNDGVIHSLDMATAPRKKFLESFNEIILKPRNMDYKVMFPGPTGTNTVESALKIARKVTGRDTVIGFTNAFHGMTIGSLSVTGNSFKRNGAGIPLNHAISMPFDQYVDEQDSIAYIERFLEDSGSGVALPAAFILETVQGEGGINAARLEWVKKIEEICRKWDILLIIDDVQAGCGRTGTFFSFEEAGINPDIVCLSKSIGGVGLPMAITLIKPEFDQWGPGEHNGTFRGNNLAFLAATEALNNWKTDAFSQNIKKMSSLFQERMKRIVEKFPELNADLRGRGLMLGIGVHVDGLAGEICAEAFSRGLILETSGAKDEVVKFLPPLIIDEDGIEKGMDILEESIQAALEK

SEQ ID NO: 47132 - protein, 460 aa, Rhodococcus sp. TK6
MGVYTTTDPATGEEVAQYPEISDAELDELIGRSAAAYRSWRTTPLEQRRAVLARAAEIHREQADELAALLTLEMGKPITQAKGEVALVASIYQYYADHAEEFMADEPLDIAGSGTAVVRTEAIGPLVGVMPRNYPFYQVARFAAPNIALGNTIILKHARNCPQSALALERVLTEAGLPDGVYLNAFISSAQVAAAIADPRIQGVSLTGSEKAGSAVGEVAGRHMKKCVLELGGSDPFIVLGDADVDAAASAAVVGRLGNGGQACTASKRFLVEEPVYDEFVRKFLDGMTGWQPSDPASPETKLGPLSSRSAVDELDELVQDAVSHGAEVLTGGDRPDEKGAYYPPTVLVGVTPEMRAYHEELFGPVVVVHRVGSLDEAIEAANDSPFGLSSSVFTSDPDKADRVAEELETGMVWINSTSKSSPDLPFGGVKRSGVGRELARFGFNEFANKKLVRNPGGKK

SEQ ID NO: 47133 - protein, 433 aa, Shewanella sp. ANA-3
MRFESFSFCPEILRAISDCGYQKMTPIQQQAIPAIRRGQDVLASAQTGTGKTAAFALPILQKMVENPSETLKSNARVLILTPTRELAAQVADNVEAYSKYLNFSVLTIYGGVKVETQAQKLKRGADIIVATPGRLLEHLTACNLSLSSIDFLVLDEADRMLDMGFNADIQKILQAVNKKRQNLLFSATFSSAVKKLANDMMVKPQVISADKQNTTADTVSQVVYPVEQRRKRELLSELIGKKNWQQVLVFTATRDAADTLVKELNLDGIPSEVVHGEKAQGSRRRALREFVSGKVRVLVATEVAARGLDIPSLEYVVNFDLPFLAEDYVHRIGRTGRAGKSGVAISFVSREEERTLADIEKLIGQKIRRITVPGYEVGSRDLLLKQLQTRRSFAKKQQRLDNVSEQIIAEKSMQGRRVKMKVGQAPSKAKKLK

SEQ ID NO: 47134 - protein, 182 aa, Idiomarina baltica OS145
MADIRSYHEKEPQLGERVYIDDSSVIVGEVTIGDDASIWPLVAARGDVNYIHIGARTNVQDGSILHVSRASAGKPDGDPLIIGEDVTVGHQCMLHGCRIGNRVLVGMSAIVMDGVEVQDDVIIGAGSLVPPGKVLESGFLYVGSPVEKKRPLNDKEMSFLSASAENYVRLKDEYLIDVKPIS

SEQ ID NO: 47135 - protein, 411 aa, Glycine max
MYKNQLQELAQRSCFNLPSYACIREGPDHAPRFKATVNFNGEIFESPHYCSTLRQAEHSAAEVALNSLSHRGPSHSLAAKILDETGVYKNLLQEIAQRVGAPLPHYTTYRSGLGHLPVFTGIVELAGITFTGEPAKNKKQAEKNAAMAAWSALKQLAKETASSSTEPENNDELEQITIARALLNYRLKEKMAMSNPNAPVSFHKRFQIQNPRPISSQPPPATSSKILPLICQKTAPRSKPSLATTANESPRSRHPQAAMTSDNSTLPPQSCSLESRATRPLKFRAAGAAPYVPIRQMRPSCQRIAPPVTIRTVVPAFATPPCPPPASVPHPAIRAPPVRVAPPVTIRQAVPVYAAPPSKKNEPAAVQQKDLPTAGASGQQDKLPVKIQEMDKAENIPPESETMRSLEQLRI

SEQ ID NO: 47136 - protein, 403 aa, Campylobacter jejuni subsp. jejuni NCTC 11168
MLELNKIYKAKQQISGFVNKTPFIYSSFLSDICQSEIYLKNENLQITGAYKIRGAYNKIANLSTEQKQHGVIAASAGNHAQGVAISAKKFSIKAVIVMPESTPLLKVSATKALGAEVILRGDNFDEAYAFATSYAKENNLSFIHPFEDEFVMAGQGTLMLEMLDEISDLDMIIAPVGGGGLISGISSTAKQINPNIKIIGVGAKGAPAMYESFHAKKIKNAKSVRTIADGIAVRDANPINFNIILECVDDFIQVDDEEIANAVLFLLEKHKIIVEGAGAASVAALLHQKINTQNHKKIGVVLSGGNIDAQMLNIIIEKGLFKSYRKMQIYVTLVDKPGALLHLTDSLKIANANIVKIDYDRFSTKLDYGDAMISITLETKGKEHQEEIRKILTQKAFNFYESF

SEQ ID NO: 47137 - protein, 339 aa, Listeria innocua Clip11262
MLELHKNGFLRLEKVVMRATAIAHTNVALIKYWGKRDEHLILPANSSLSFTVDKFYTKTTVEWDENLAQDTFILNNEQKTDAKVARFIDKMREEFGISAKAKITSENHVPTAAGLASSASAFAALALAGSSAAGRKDTKEYISRLARFGSGSASRSVFGDFVIWEKGELADGSDSFAVPFTNKLCDKMSLVVAVVSDKEKKVSSRDGMRLTVETSPFFEKWVSAAETDLEEMKQAILEEDFIKVGEITERNGMKMHATTLGAEPPFTYFQPLSLEIMDAVRELRENGIPAYFTMDAGPNVKVICERENENIVAEKLSGLAKNVLICHAGKEASVISDEK

SEQ ID NO: 47138 - protein, 380 aa, Schizosaccharomyces pombe 972h-
MDSTAQQFPLNHDLQVQKDQKGVVEEDEEQIHKRIRNYESHSGFSEYCTLFGHEKSVTCVSVSPNKRWIATSSSDGTIKIWSALTFRLECTLFGHYRGISQVKWATGSKYLASASDDKTIRIWDFEKRCSVRCLKGHTNYVSSIDFNPLGTLLVSGSWDETVRIWNLQDGTCLRMLPAHSEPIISVSISADGTLCATASYDGMARIWDVLSGQCLKTLVEPINVPLSNLQFTENRKYLLVSNLNSQIRLWDYRRNRVVRIFDSHVNTRYSMSWDCYSSKNIPKNTEALPNNDSSYPDDAESFMHDAYLLIPSEDGTIQITDPSTKIIIDDSIRHSDDPETSLLNVTSLGPFIITSGTDPYVRVWAPSLLLSKHEKDGFSP

SEQ ID NO: 47139 - protein, 283 aa, Picrophilus torridus DSM 9790
MEFYLGKTGERISSIGIGTWQMKSNDQSIMAIRAGLDAGSNFVDTAEAYRNEAMVGRAIESREVFIATKVFPNHFKYDSLIRACENSLKRLNVKTIDLYQLHWPNRHVDIKETMKAMEHLVDTGMIRYIGVSNFNVNELKSAMSAMSKYEIVSNQVEYNPLVRYIEPEISEFCRKNSISIIAYSPLMHGHDIDPISKDESPFNIIANKRNATVRQVILAWILSKNFFAIPKSNVPEHVIENVKSMNINLSSEETSMIDHYVSRFNKKSLKERYGNIISFVSRF

SEQ ID NO: 47140 - protein, 301 aa, Picrophilus torridus DSM 9790
MKRDIISVYDMKDDLEDIIELSIKLKKDRTIKFSEKKILAMIFEKPSTRTRNSLEVAMEQLNGHAIYLNPNDMQIGRGETIADTARVLSRFVDIISYRAFNHDDVVELARHATVPVLNALDNLEHPMQIVADFMTVYEKKHRLKGLKLAYIGDGNNMANSLLLGSSILGVDISIACPKGFEPNKEILRQAREISLKTGNKIEITDDPRIAVEASDIIYTDVWVSMGEENERENKERIFMPYQVNEDLTENANRDYIFMHCLPAHRGLEVTAGVIDGIHSVVFDEAENRIYSEKGIIYKLLS

SEQ ID NO: 47141 - protein, 391 aa, Aspergillus oryzae
MLSSRGIKKAELPKIPWRYAPPHTYNKESNPAGLISFGMAEHVTFTEDSVGYGSSSSTPNRLPKAVASHLNNILKPLSPIEPETVIVASGITAIGSMLSFTLAEPTDGILVSRPVYGRFELDYGVEADVQIVYADTDPEEAFTPAVVDKYEAALKRAEENGTKVRAVLIVNPHNPVGAWKFSGSVINTNSISSVTKYTHPVSLTRETRMLSLSLRSYLSQDNQDFAAGGLHLGFLITQNTALRQACKAILSVPTPRLHNASTASITIGATILEDQDFITQFTQESRQSLASTYRIATSILNHEGINYVKGGNAGFFIYIDLSSYLPYPDRSVREREFALAQRFLDAGVFLHPGEEHGKESGWFRLVFAHEEQVLREGLWRFCEVLADAKVF

SEQ ID NO: 47142 - protein, 483 aa, Rickettsia akari str. Hartford
MAEFTPITIAYGDGIGPEIMEAVLYILRKAEARIRLETIEVGEKLYKKHYTAGISEESWESIQRTGIILKAPITTPQGGGYKSLNVTIRKTLQLFANIRPSVSFHPFTRTLHPNLNLTIIRENEEDLYAGIEYRQTHNIYESIKLISHTGCEKIIRYAFEYAVKNNRKKVTCLSKDNIMKFSDGVFHKVFNEIAKEYPQISNEHYIIDIGTARLSTKPEIFDVIVTSNLYGDIISDVAAEISGSVGLAGSANIGQHYAMFEAVHGSAPNIAGKDIANPSGLLNAAIMMLVHIGQGDIATLIENAWKKTIEDGVHTADIYNQQNSSKKVGTKEFAEEVTKRLGKIPTKLPRADYPLIAEKQESNIDYKIDTKEVKKLVGTDIFVNINVSSAHDIADTVNKLELGNVELKTISSKGLKLWPRDTRFETVSDHWCCRFMNKDGTEIKHLDITRLLEALSKANIDFIKVENLFEFDGVAGYSLAQGE

SEQ ID NO: 47143 - protein, 182 aa, Triticum aestivum
  misc_feature (21)..(21): Xaa can be any naturally occurring amino acid
LPYLDHPWPPTVMASWDTSLXPFQGVKSTAGLPVIPRSNGFILGSVSIGGRIRCMQVWPIEGIKKLETLYYLPPLSTEALLKQVDYLIRSKWVPSLEFSKVGFIFREHNAFPGYYGGLYWTMWKLPMFGCTDATQVINEVEEVNKEYPDAYVRIIGLDNMRQVQCVSFIAFKPPVSEESVKA

SEQ ID NO: 47144 - protein, 393 aa, Candida albicans SC5314
MPVNFLTSVVFDGPEVIPYWDQIKEYGPTVLPILLTLAGAKYYFHGATNTWERDMHGKVFMITGATSGIGAQIAYELGQRGAQLILLTRRTNDQWVAEYIEDLRDKTNNGLIYAEECDLSSLYSIRKFATRWLDNQPPRRLDGVICCAAECIPRGKSRQITMDGVERQIGINYLAHFHLLTLLGPSLRVQPPDRDVRVLIATCSSQNLGDVDLNDLLWSDKRYPATQPWKVYGTSKLLLGLFAKEYQRQLMGYERKDKAPCNVRINLINPGIVRTPSTRRFLSLGTVWGLIIYLILFPIWWLFFKSAEQGTQSFYFALFAPIFMKIEGGNVVQECKIMTKVRKEYTDDDLQQKVFHNTEELIKQIETKSAIERKKHENAKKTPEQKARKGKRN

SEQ ID NO: 47145 - protein, 407 aa, Picea sitchensis
MGESSDYESSESEEQHSSEEHHSSEEQHSSENNSNNNSSDDGRGNGDDNVDRKRRREEEEEEEEEEEEEDEDEEEEKVGKGFRAKRAARGRDIVFRIVVASNKIGKVIGKQGSKINQLREDTGARIKIADPVTPLEDRVIIISSKGEEEEETSAAEQALIQIATVILEESGESSATAKVGTRHVGPNMMRLLIAGSQAGSLIGASGKTIKEIRNDSGATIKILPQNLSPICASASETDRLVQISGEVSQVLKALDHIGVTLREHPPREVISTRPTYYAGLSPANGLMVLPQTVLPGYNMQTGNSNYSYLGAAGRAAGGTISAAFALPKVTVEMKIPSSVAGGVIGKRGDNISQIRSLSGAIVKVIGEKDGATRTIFFEGTAHQVATAQNLVNNHINAQAQENLVYHS

SEQ ID NO: 47146 - protein, 259 aa, Sulfolobus tokodaii str. 7
MRVSIIGVGKIGYAILKGLKSLNVEIIGTGRSEETLDKIKKEGVEATRDNEYAIKKSDIIILAVKPQHFHSILDKVSKTAWEGKKVVSVMAGIRISTLTRLTNAKVYRAMPNINAVIGKATTALAEERDEEVERIFRTIGNVYWIPEELFDAWTAIIGSGPAFVAEIIDAFALGAVACGMSRELAYQAILDMVEGTVYTLRKDKTHPVLLRDQVTTPAGTTIRGLMVMESEGIKSAIIKTIEAAYQRSMAIGKEIDKMY

SEQ ID NO: 47147 - protein, 254 aa, Streptomyces coelicolor A3(2)
MHDLTGKNVIITGGARGLGAEAARQAVAAGAHVLITDVLDDDGENAARELGDRARFLHHDVTSEEDWSRAADFAVTEFGALHGLVNNAGISTGTPLESESVDHFRKVLDVNLTGVFIGMKTVVPALKEAGGGSIVNISSAAGLMGLALTAGYGASKWGVRGLTKIGAVEWGTARVRVNSVHPGMTYTPMTAAVGIERGEGKYPNTPMGRVGEADEIAGAVVFLLSDAASYVTGAELAVDGGWTTGPTVAYVMGQ

SEQ ID NO: 47148 - protein, 203 aa, Oceanobacillus iheyensis HTE831
MILLIDNYDSFTYNLYQYISEFNKEVRVIRNDAITPNEIRAMHPEAIIISPGPGSPTKAGNCLKIVREVYREFPILGICLGHQVLAEALGGEIKQAKVIKHGKTSPISIKDSQLLHSLQHPIQVMRYHSLIVDRKSLSADYQVTARSLDDNEIMAIEHKQLPLFGMQFHPESIGTKDGKQIIKNFLIQIKALQEDENNEALTS

SEQ ID NO: 47149 - protein, 188 aa, Zea mays
  misc_feature (29)..(29): Xaa can be any naturally occurring amino acid
  misc_feature (53)..(53): Xaa can be any naturally occurring amino acid
  misc_feature (88)..(88): Xaa can be any naturally occurring amino acid
  misc_feature (108)..(108): Xaa can be any naturally occurring amino acid
  misc_feature (125)..(125): Xaa can be any naturally occurring amino acid
KVTPNLAMDAADTLLLYLSLLHRLDPPAXDILISAAHVTVYYFYFDCYYGSSXTCEGSLFSIQNNSQPRFQFIAMNTYSTDNLLLDLXQDDSNTKFPLYICWTRVDDXLTVIWVYNQHDCEDVAXLFGMIMNAYSRVPPTPKATSTKRELNQLEECSYMCLHHMVYLNCRCDAVEGLLIRGVTNRIAT

SEQ ID NO: 47150 - protein, 267 aa, Salinibacter ruber DSM 13855
MTSKTKAPTVIKISGSLLDEPNALADLWPSVQALHEDAPVVLVHGGGTQMTALADRLGHTPERVQGRRITTDLDLKIAQWAIRGSLNTTLVSEAQQHDLTAVGVSGADATLVQVSKRPAWDVDGRTVDFGWVGDIEHVDPSLLEGLMARSLVPVVAPLGIDDEGQVYNVNADTVARALAEALAADPLLYVTEAGAVRRDAENPASRLATCPPGTARQGIAEGWIAGGMRVKVETALDALDGSVGAVYICGPGDLLARSQATEVVLEA

SEQ ID NO: 47151 - protein, 181 aa, Idiomarina baltica OS145
MLTVGDKLPDFSVVAAKPKFNMPEENGESAFETVTQDSFTGKWKIIFFYPKDFTFVCPTEIVEFAKLNEEFADRDAVVLGGSTDNEFVKLAWRREHPDLDRLNQYSFADNGSLVDGLGVRDKEENVALRATFVVDPHNVIQHVSVNNLNVGRNPAEILRILDGLQTDELCPCNRAVGGDTL

SEQ ID NO: 47152 - protein, 387 aa, Triticum aestivum
  misc_feature (171)..(171): Xaa can be any naturally occurring amino acid
  misc_feature (193)..(193): Xaa can be any naturally occurring amino acid
  misc_feature (215)..(215): Xaa can be any naturally occurring amino acid
MASATLLKSSFLPKKAEWGVARQVAAPRVSMVVRAGAYDDELVKTAKTIASPGRGILAMDESNATCGKRLDSIGLENTEANRQAFRTLLVSVPGLGNHISGAILFEETLYQSTVDGKKIVDILVEQGVVPGIKVDKGLVPLTGSNDESWCQGLDGLASREAAYYQQGARFXKWRTVVSIPNGPSELPVKEAAXWGLARYAAISQDNGLVPIVEPXEILLDGEHGIERTFEVAQKVWAETFYQMAQNNVMFEGILLKPSMVTPGAECKDRATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 47153 - protein, 803 aa, Oryza sativa Indica Group
MIPQLYIYLGLLLFSLHGAPPCSAATVNDTLLAGESIAVSDKLMSRNGKFTLGFFQPSVVSKSGNITSPNWYVGIWFSNISEFTTVWVANRDNPVTDLQLNQTRLKLSNDGNLIISSNASTIWSSATVANTTTATTMNTTSVVLANNGNLMIIGSSSTSNVSWQSFEHPADVMLPGAKFGWNKATGATIKYFSKKNLIDPGLGLYYFQLDNTGIVLARSNPAKMYWSWSSQQSSKAISLLNQLMSINPQTRGRINMTYVDNNEEEYYAYILLDESLNVYGVLDISGQLIINVWSQDTRSWQQVYTQPISPCTAYATCGPFTICNSLAHPVCNCMESFSQTSPEDWEVGNRTAGCSRNTPLDCGNMTSSTDVFQAIARVQLPSNTPQRVDNATTQSKCAQACLSYCSCNAYSYENNICSIWHGDLLSVNSNDGIDNSSEEVLYLRLSAKDVPSSRKNNRKTIVGVIIATCIASFLVMLMLILLILRKKCLHTSQLVGGIVAFRYSDLCHDTKNFSEKLGGGGIGYVSKGVLSDSTIIAVNKLDGAHQGEKQFRAEVSSIGLIQHINLVKLIGFCCEGDKRLLVYEHMVNGSLDAHLFQSKATILNWTTRYNLAIGVARGLSYLHQSCKECIIHCDIKPENILLDASFTPKIADFGMAAFVGRNFSRVLTTFRGTVGYLAPEWISGVAITPKVDVYSFGMVLLEMLSGKRNSQKVCIDDNSNQVTLFPVTAISKLLEGDVRSLVDPKLNGDFSLEEAERLCKVACWCIQDNEVDRPTMSEVVLVLEGLHNLDMPPMPRLLAALAL

SEQ ID NO: 47154 - protein, 280 aa, Campylobacter jejuni subsp. jejuni NCTC 11168
MQEVISYIQKAVLEISNALKFPDTSYSQNQNFTGDTQLKFDVLSDEIITKTLSQCSSIKAIISEEKDEILTLNERANFIVAYDPLDGSSLMDVNFAIGSIFAIYEEKASAKNLRAALYSMYGARLELVICKDQPKLYRLNANNEFIFIKDLRMNEKGKINATGGTQKFWEEKHAKFIKSLFDEGYRLRYSGAMVSDINQILLKGGGIFSYPATQDAPNGKLRAFFEVFPLAFIIEKAGGKTTNGKNRSLLELEFDKIHATTPCFFGSEYEISKLLKAYNE

SEQ ID NO: 47155 - protein, 335 aa, Schizosaccharomyces pombe 972h-
MAIPKVGINGFGRIGRIVLRNAILTGKIQVVAVNDPFIDLDYMAYMFKYDSTHGRFEGSVETKGGKLVIDGHSIDVHNERDPANIKWSASGAEYVIESTGVFTTKETASAHLKGGAKRVIISAPSKDAPMFVVGVNLEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDSVVSTDFCGDNHSSIFDASAGIQLSPQFVKLVSWYDNEWGYSHRVVDLVAYTASKD

SEQ ID NO: 47156 - protein, 359 aa, Zea mays
PRALPTPAPPRPAAMGSRSSTRSFCVDDNDLEDGKASKERESSAQSLRLPKIQNQALLSGLAYCISSCSMILVNKFVLSSYGFSAPVFLMLYQNIVSVTIVSTLSLSGAVPTEPLTWNLIKVWLPVNIIFVGMLITSMFSLKYINVAMLTILKNVANVLTASGETYFFKKQHGTQVWVALMLMIISAVAGGITDLSFHAVGYIWQTLNCVLTAAYSLTLRHVMDSAKQVTKSGNLNELSMVLLNNVLSLPLGIILVLGLNEMEYLLQTSLLRMPEFWLVITASGVLGLGISFTSMWFLHQTSATTYSLVGSLNKIPLSIAGIVLFNVRTSVQNSLSILFGLLAGVFFARAKLRDNSPTL

SEQ ID NO: 47157 - protein, 249 aa, Oryza sativa
MRLYPLDRAPPSTGDAAPSTPARPPHAGPAPSTPARLAASTPAGPAPPVKPGRSESAARRRRRVVGRRHRRIRQLGHRPGISSSPATPHRIVAIILRRPESWVGEMLKFLSKVVVEYCPLDPRKAAVVELLAQCNGRKAKDSNPACSVELRRLPSPPPADAAAAGEKNAHPPPRVLVTYFNGVEESFVAAEGATAQGIRDQILDRGRLLDTEQLFRDGGEKWPVLIPEEELTMSFPGIKPKKAEEKPQA

SEQ ID NO: 47158 - protein, 435 aa, Corynebacterium efficiens YS-314
MVTCCVGVTTYTPDDSGRITTTGGGLRKRRSCQPVHDFYGNDVSMKLIIEADGGSRGNPGVAGSGTVVYSENRERILREIAYVVGTRSTNNVAEYRGLIEGLRVARELGATEVEVFMDSKLVVEQMSGRWKIKHPDMKTLAMEARNLAGDIGRVTYTWIPREKNKAADHLSNVAMDAAAAGKPEGPIDDGTPVVSDMTDPTDATVTGVDKPTGEDLNCPTTKPATWNGATTDPTRLLLLRHGQTAMSAARQYSGRSNPELSELGQRQVQAAARKLAERGGIDVIVSSPLRRCVQTAGAAADQMGLEVRIIDDLIEADFGLWDGKTFSEAHESDPELHSRWLTDTSVAPPGGESLQQVHRRVKKARELIEKDYGAANVLVVSHVTPIKSILRQALDASPSFFKKTHLDLASLSIAEFYSDGPTCVRLFNDTSHLDS

SEQ ID NO: 47159 - protein, 217 aa, Erythrobacter sp. SD-21
MTDEEAAELAQLERRANKLFSGRVEFLLSAPQLKFLPEPTVPEIAFAGRSNVGKSSLLNALTGRRKIARASVTPGRTQELNFFEVGEPTQFRLVDMPGYGFAKAPVKVVEKWKNLVKTYLRGRQVLVRNLVLVDSRHGLKDVDREMMKMLDEAAVGYRVVLTKADKIKASELAKTVAAVEAEAKKHVAAYPQIHVTSSEKGMGIGELRAALLRDAGV

SEQ ID NO: 47160 - protein, 321 aa, Schizosaccharomyces pombe 972h-
MASNSIKIFAGNSHPELAEKVARRIGLSLGKVAVVQYSNRETSVTIGESVRDEDVFILQTGCGSINDHLMELLIMINACRSASARRITAIIPCFPYARQDKKDKSRAPITARLVANMLQTAGCNHIITMDLHASQIQGFFNVPVDNLYAEPSVLRYIRENIDTTVNPTVIVSPDAGGAKRATALADRLDLDFALIHKERQKANEVSRMVLVGDVRDKLAILVDDMADTCGTLGLAAKTLKDNGAKAVYAIVTHGILSGKAIKVINESALEKVIVTNTIPHDDKRSLCSKIETIDISGVLAECIRRIHHGESVSVLFSVAPA

SEQ ID NO: 47161 - protein, 433 aa, Schizosaccharomyces pombe 972h-
MLTRSVLRKAPRAFSPFLQKRNLALHEYISHDILRKFGVDVPRGAPARSGEEAEKVARDLKVTDLVVKAQVLAGGRGKGQFDSGLRGGVRPVYDATEARMFAEQMIGHKLITRQTGPAGKICNVVYVCERKFIRKEYYFAILMDRENQCPMIVASDQGGVDIETVAAENPSAIIKRSLPNSPNLDPHIAEELVDKLGFSSSSKPKAVDAIVKLYKVFNDCDATQVEINPLAETTDHKVLCMDAKLNFDDNAEFRHSNIFVLRDISQEDPDEARAAKVGLNFIKLDGNIGCLVNGAGLAMATMDIIKLHGGEPANFLDVGGNANAEAIREAFSLITNDPKTTAIFVNIFGGIVRCDVIAKGLISVVSALNLNIPIICRLQGTNQGAAKEVINNSGLRIFSFDDLDEAAKKACRFSRVVEMAREADVNVSFELPL

SEQ ID NO: 47162 - protein, 314 aa, Mesorhizobium sp. BNC1
MPTRRMLIKATAAAGLLAPFGGFSAAPASAQGNALFRFGIIADPQYAPFPPKAGGTRYYANSLWKLTEAIDTFNQQDLQFVATLGDIIDRHWDSFGDILPIYDKLRHDHFFVLGNHDYEVGQDYLRSVVRTVGMPKPYYDFTGGGYRFIVLDGNDISLFAPPAGDPRLEIAAERLAKLKEAGASNAQSWNGSLSDEQFAWLGETLEKAKTAGEKVIVLSHYPIYPDNMHNLWDSDRIVELLTSHDHVAAFFNGHNHAGNYGEISGKHFVNFQGMVETPAHNAFSTVAVYEDRLEITGFGREPSRSLRLDGARGA

SEQ ID NO: 47163 - protein, 397 aa, Mesorhizobium sp. BNC1
MPDISKRITGIMPSGKDGWEVHFAALTRKLAGENILMLSVGDHDFDTPAGTVEACVEAVQSGHHHYIQLPGLPKLRQALARLSTECTGVDTAPEEVIVTQGGQGALYASCQAVLDPGSHAVIVSPYYATYPGTVRAAGASFTEIETRSEDGFEPRVEAIAAAIRPETRMILINSPNNPTGAVYSRATLEAIAEICRRHDLWLLSDEVYWTLRGEREHVSPRSLPGMKERTLVVNSLSKSHGMTGWRVGWLTAPAEVVKLLISLNIVSSYGMVDFVSRAAVAAVENGHGVQEIAARYGSRRKAFLDEIRGANDIVVRGSEGGMYVMLDISHINPDAEAFAWGLLEAEKVAVMPGPSFGAAAQGHIRISMCQEEPVLREAAMRIRRYIASEITRRDAAE

SEQ ID NO: 47164 - protein, 391 aa, Sinorhizobium meliloti 1021
MAKFCRSNRDSETGGASLKTPAAVLRKSPVERPYAHTRPLSIETIDLAPPGPDELLVKIGAAGLCHSDLSVINGDRPRPVPMALGHEAAGTVEAVGSGVRDISPGDRVVMSFMPSCGHCLPCAEGRPALCVPGAEANGKGTLLSGERRLSCGEVPVNHHLGVSGFADYAVVSRHSAVRIEADLPMVEAALFGCAVLTGVGAVVNTCRVRPGESIAVVGLGGVGLAALLGAIAAGAERIVAIDLAEDKLKLARALGATDTFLAADPDAAENIRQATRGGVDHAIEAAGSVRAFDLAYRITQRGGLTVSAGLAHPSSQISIPAVSLVAEERSVRGSYMGSCVPARDIPRFIALYERGRLPVDRLLSSTGPLEEINEAFDLLDQGRVIRHVITF

SEQ ID NO: 47165 - protein, 327 aa, Mycobacterium leprae TN
MLSHDWTDNRKNLMLFSGRAHPELAEQVAKELDMHVTTQDAREFANGEIFVRFHESVRGCDAFVLQSCPAPVNTWLMEQLIMIDALKRGSAKRITAVIPFYPYARQDKKHRGREPISARLVADLLKTAGADRIVTVDLHTDQIQGFFDGPVDHMRGQNLLTGYIKNNYPDTNMVVVSPDSGRVRIAEKWGDALGGVPLAFIHKTRDLRVPNQVVSNRVVGEVEGRTCVLIDDMIDTGGTVAGAVQLLRNDGASDVIIAATHGVLSPPAAERLAQYGTREVIVTNTLPIGEEKRFPQLTVLSIAPLLASTIRAIFENGSVTGLFDGEA

SEQ ID NO: 47166 - protein, 279 aa, Arabidopsis thaliana
MDKLKIAEWGEKLKTGGAQMSRMVSEKVKDMLQAPTLESKMVDEATLETLEEPNWGMNMRICAQINNDEFNGTEIVRAIKRKISGKSPVSQRLSLELLEACAMNCEKVFSEVASEKVLDEMVWLIKNGEADSENRKRAFQLIRAWGQSQDLTYLPVFHQTYMSLEGENGLHARGEENSMPGQSSLESLMQRPVPVPPPGSYPVPNQEQALGDDDGLDYNFGNLSIKDKKEQIEITRNSLELLSSMLNTEGKPNHTEVVATLSAHLTFVIFLNKCLWNMD

SEQ ID NO: 47167 - protein, 447 aa, Mycobacterium leprae TN
MSPPTGRPRLSHDYKENLVPVIEQVGAREILDSRGNPTVEVEVVLIDGTFARAAVPSGASTGEYEAVELRDGDGRYGGKGVKRAVDAVLDEIGPVVIGLNANDQRLIDQELLDLDGTPDKSRLGGNAILGVSLAVAKAAADSAELPLFRYIGGSNAHILPVPMMNILNGGAHADTAVDVQEFMVAPIGAPSFVEALRWGAEVYHALKSVLKKKGLSTGLGDEGGFAPEVAGTTAALDLVTLAIEAAGFKPGADVALALDAAATEFYTDGIGYHFEGMTHTADQMTEFYADLLGSYPLVSIEDPLSEDDWDGWAALTASIGEQVQIVGDDIFATNPERLEEGIGRGVANALLVKVNQIGTLTETLEAVALAHHSGYRTMISHRSGETEDTMIADLVVALGSGQIKTGAPARSERVAKYNQLLRIEEELGDAARYAGDLAFLRYVVETR

SEQ ID NO: 47168 - protein, 427 aa, Mycobacterium avium subsp. paratuberculosis K-10
MVRIASVVARQLLDCKARPLVEVEITTDTGHVGRGAAPTGTSVGAHEAFVLRDGDPTRYRGRSVHRAVAAVRDEIAPALTGAELDDPRSLDRVMIELDDTPDKHRLGGNAIYSTSIALLRAAAAAAGTPTYTYVGALLGLTPPTTVPMPSFNMINGGRYGDVEQSFSEFLVVPYRAESIQAAVEKGVSLFEVLGEVLAEHLGRTPLLASSYGYIAPSGDPHAVLELLAEAVERAGCADVMAFALDCASSEVCDNGSATYAFNGGRVTAEALIDYARALSQEFPMLFIEDLLDGDDWAGFTKAVQTVNRSIIVGDDLIVTNRDRLRRAVETSAVDGFILMPNQVGTIAEALDCFEYASQNGLLAIPSGRSGGVIDDVVMDLAVGLGAPLQKNGAPRSGERIEKLNFLLRAAEGIPDCALADVPALARF

SEQ ID NO: 47169 - protein, 468 aa, Rhodobacter sphaeroides 2.4.1
MTATMTDQPSPSGSTLSEAETFLAAHPEIEAFDIVLHDANGIGRGKIIRRHELLSFYKGGRHLPISILGLDICGEDVHETGLIWDQGDGDLRAWPIPGTLVPLHGTTPPRGEVFMCMYDLDGRPMSSDPRHALARQVEALAELGLHPSAAFELEFFLLANERGPDGRVQPAADVLDGRRSAKTEVYSVDHLHGMMPLFSDIYAGAETAGIKAETMISEYAPGQYELTLHYRTDVLQAADDLMRLKRIVRAQARRHGVTACFMAKPVESYAGSGMHLHVSLCDAEGRNIFVEETEGQWSRPILHALGGLRETMGESMLVFAPHANSWRRFASQSYAPVSPSWGVNNRSVALRIPAGDIRARRIEHRPAGVDANPYLVAATVLAGIRRGLEQQIDPGPETTGNGYEDPGDTQPIPTCWRSAIAAAEHSAFLREALGPDMHRTFTAIKAAEYARVARTIPDVDYDLYLHTV

SEQ ID NO: 47170 - protein, 301 aa, Pseudomonas abietaniphila
MSTDKNNKVVVVGAGLMGTGIAHGFVSAGFHTVLVDTSAQSLSNARTAIENILKAGVSLGKVSAQQADASMARLSTAGDLGEAAIGANWLVETVSEQLAIKKSIVAQAAPLMAPDAIIATNTSALSVTEIAATIDSADRVIGMHFFNPVHKMKLVELVRGLATSDETVARTRDLCDALGKTSIIVNESPGLTTSRMSAMLGNEAMYMLQEGIASAEDIDTALRMGFNHPMGPLELGDLTGWDTRLSVLRYLHQTLGEKFRPCPLIIKMVAAGRLGRKTGHGVYRYEDNKAVPGSGLRASAL

SEQ ID NO: 47171 - protein, 263 aa, Prosthecochloris aestuarii DSM 271
MITIKSEREIDLMRESGAATSLVLDMIEREIKPGMTTLQLDTLAEAFIRDNGGVPSFLHYAPKGDPDVTPYPATLCVSINEEVVHGVPDAKRVIREGDIVSVDCGVYKGGYHGDSARTYLIGEVNPKVRKLVTVTRECLYLGIEQAVEGNRLHDISAAIERHARSFGYSVIENMVGHGIGSELHEEPPVPNYGRRKTGIRLREGMALAIEPMIAMGRSRNAVSRNGQWVAVTEDGKPSAHFEHTIIVRKEKAEIMTLSPSERK

SEQ ID NO: 47172 - protein, 260 aa, Mycobacterium tuberculosis CDC1551
MSGRLIGKVALVSGGARGMGASHVRAMVAEGAKVVFGDILDEEGKAVAAELADAARYVHLDVTQPAQWTAAVDTAVTAFGGLHVLVNNAGILNIGTIEDYALTEWQRILDVNLTGVFLGIRAVVKPMKEAGRGSIINISSIEGLAGTVACHGYTATKFAVRGLTKSTALELGPGGIRVNSIHPGLVKTPMTDWVPEDIFQTALGRAAEPVEVSNLVVYLASDESSYSTGAEFVVDGGTVAGLAHNDFGAVEVSSQPEWVT

SEQ ID NO: 47173 - protein, 462 aa, Nicotiana sylvestris
MVASPDNNAADGRTVKNKRPIDEWLPITSSRNGQNGGYSAFHNVTAMVGAGVLGLPYAMSELGWGPGVTVMVVSWVITLYTLWQMVECKKCPGMLAGTCIDDHKLAVSNVFGNKLGLWIVVPQQLVVEVGIDIVYMVTGGKSFQKSIVLVCKDNCKDIKLTYYIMIFASVHFVLSHLPNFNAISGVSLVAAIMSLSYCTIAWGASIVLGVQPDVEYEYRAENTGEGIFNFFSGLGEVAFAYAGHNVVLEIQATIPSTPEKPSKGPMWKGVLVAYIIVALCYFPVAIIGYWIFGNSVSNNILISLEKPTWLIVLANAFVVITLLGAYQLYAIPVFDMLETYLVRKLKFKPTWYLRFMTRNLYVAFTMFVGIIFPFLWGLLGFLGGFAFAPTTYFLPCIMWLSIYKPKRWGLSWTSNWICIIVGVMLTVLAPIGGLRTIIIQAKDYNFFYWDSLSGSLAFGKKG

SEQ ID NO: 47174 - protein, 163 aa, Nostoc sp. PCC 7120
MRDEMGLTNVIPMIPFCRTPEEGRLVLAEMAKHGLKQGVNDLQVYVMCELPSNVILAEQFAEVFDGFSIGSNDLTQLTLGLDRDSALVARLFDERSPAVKQMVKMAIASAKKQRRKIGICGQAPSDYPEFAQFLVEEGIDSISLNPDSVLKTMLEIAKVEQQS

SEQ ID NO: 47175 - protein, 1310 aa, Phytophthora sojae
MVSRYSTLRADNLETMLNGGLERFYKKYNHLSRKINLQLPTPEVRFENLSFSVQVPAEAGAYGTVGSHLASIFTPWQKVPMTTKHALHPMSGIIKPGSMTLILANPGAGKSTFLKALAGKLQDNKQTEISGQILYSGLRGEEIDLIKLVGLVDQTDNHIPTLTVRETFKFADLCVNGRPEDQPEEMREIAALRTELFLQILGLESCADTVVGNALLRGVSGGERKRVTVGEVLVGGQSLFLCDEISTGLDSAATFDIIKALRTWCKTLGGSVIVALLQPTPEVVEQFDDILMVNEGHMVYHGPRTEILDYFEERGFSCPPRVDPADFLIEVTSGRGHRYANGRVEKRDLAVTSEDFNNLFCQSSIYKKTHEAISKGFNEHQFENAEDFQKAKSVANLARSKQKSEFGLAFIPSTLLLLNRQKLIWLRDPPLLWGKLFEALIVGLVLGMIYFNVSSTYYLRMIFFSIALFQRQAWQQITISFQLRGVFYKQRPRNFFRTMSYAIAETVVQIPVNLSVSFILGTFFYFMSGLTRTFEKYIVFFLVLVCFQHAIGAYMTMLSSLSPSITVGQALAGISVSFFLLFSGNIILADLIPDYWIWMYWFNPLAWALRSNMLSEFSSDRYSPAQSQKFLDSFSISQGTEYVWFGIGILLAYYLFFTTLNGLALHFIRYEKYKGVSVKAMTDNSSEEDNVYVEVRTPGAGDVVQTKARGAGLPFTPSNLCIKDLEYFVTLPSGEEKQLLRGITAHFEPGRMVALMGATGAGKTTLMDVIAGRKTGGRIVGDIIVNGEPKNPANFSRITAYCEQMDIHSEAATIYEALVFSANLRLPPTFSEEERMNLVNETLELLELSPIAGEMVGRLSVEQKKRVTIGVEVVANPSILFLDEPTSGLDARSALIVMRGVQSIARTGRTVLCTIHQPSISIFELFDGLLLLQKGGYTAYFGDLGVDSVKMLEYFESIPGTEQIRPQYNPATYMLEVIGAGIGRDVKDYSVEYKNSELCRSNRERTLELAKASGDFVCHSTLNYTPIATGFWNQLGHLAKKQQLTYWRNPQYNFMRMFLFPLFAIIFGTTFYQLSAGSVKKINSHIGLIYNSMDFIGVINLMTVLEVTCAERAVFYRERMSNYYGPLPYSLSLWFAEVPYLIVVIVLFVTIEYWLVGWSSSPGDYFFFMFVFYLYTSACTYVGQWMSALMPNEKVANVAVGALSCLFNLFSGYLLPRTAMKAGYKWFTYLMPSSYSLAALVGVQFGDNQDIIAVTSGNITTNMTVAHYIEKTYDFRPERKYSFMAGLLVIWVVLQVAIYLTFKYVSHLKR

SEQ ID NO: 47176 - protein, 460 aa, Pyrococcus woesei
MNIKKLTPLLTLLLFFIVLASPVSAAKYLELEEGGVIMQAFYWDVPGGGIWWDHIRSKIPEWYEAGISAIWLPPPSKGMSGGYSMGYDPYDYFDLGEYYQKGTVETRFGSKEELVRLIQTAHAYGIKVIADVVINHRAGGDLEWNPFVGDYTWTDFSKVASGKYTANYLDFHPNELHCCDEGTFGGFPDICHHKEWDQYWLWKSNESYAAYLRSIGFDGWRFDYVKGYGAWVVRDWLNWWGGWAVGEYWDTNVDALLSWAYESGAKVFDFPLYYKMDEAFDNNNIPALVYALQNGQTVVSRDPFKAVTFVANHDTDIIWNKYPAYAFILTYEGQPVIFYRDFEEWLNKDKLINLIWIHDHLAGGSTTIVYYDNDELIFVRNGDSRRPGLITYINLSPNWVGRWVYVPKFAGACIHEYTGNLGGWVDKRVDSSGWVYLEAPPHDPANGYYGYSVWSYCGVG

SEQ ID NO: 47177 - protein, 274 aa, Oceanobacillus iheyensis HTE831
MEYVTLNNGLKMPQLGFGVWKVPNEEVVSPVEHALKVGYRSIDTAKVYGNEVGVGEAISNSGIPREQLFITTKVWNSDHGYDNTLKAFDESLERLGLDYVDLYLIHWPTPEFDQYVETYKALETLYKDGKVKAIGVCNFDIEYLERILNECEIVPVLNQVECHPYLQQKELRDFCEKHNIYLESYSPLMNGKEVLQSEELQNLAERKGKTVAQTILRWHLQSGMIVIPKSVTPNRIEENLDVFDFELTDTEMQEINELDRNLRSGAVPSEMNVR

SEQ ID NO: 47178 - protein, 804 aa, Oryza sativa Indica Group
MTPHQLYVFLGLILFSLHGAPPCSAAVNHTLTAGESLAVSDKLVSRNGKFTLGFFQPSFVTNSGNITSPNWYVGIWFSNISAFTTVWVANRDNPVTDLQLNQTRLELSKDGDLVISSNASIIWSSATVANTTTATTMNTTSVILANNGNLMIIGSSPTSNVSWQSFDHPADVMLPGAKFGWNKVTGATIKYVSKKNLIDPGLGLYYFQLDNTGIVLARSNPAKTYWSWSSQQSSKAISLLNQMMSINPQTRGRINMTYVDNNEEEYYAYILSDESLYVYGVLDISGQLIINVWSQDTRSWQQVYTQPVSPCTAYATCGPFTICKGLANPVCSCMESFSQKSPQDWEVGNRTAGCFRNTPLDCGNTTSSTDVFQAIARVQLPSNTPQSVDNATTQRKCAQSCLSYCSCNAYSYENNRCSIWHGDLLSVNSNDGIDNSSEDVLYLRLSTKDVPSSRKNNRKTIVGVIVAACIVCFLVMLMLILLILKKKLLHASQLGGGIVAFRYSHLCHATKNFSEKLGGGGFGSVFKGVLSDSTIIAVKKLDGARQGEKQFRAEVSSIGLIQHINLVKLIGFCCKGDKRLLVYEHMENGSLDAHLFQSKATVLNWTTRYNLATGVARGLSYLHHSCKEYIIHCDIKPENILLDASFTPKIADFGMAAFVGRNFSRVLTTFRGTIGYLAPEWISGVAITPKVDVYSFGMVLLEILSGKRNSHKVCTDDNNSNQVAFFPVTAISKLLEGDVQSLVDPELNGDFSLEEAERLCKVACWCIQDNEVNRPTMSEVVRVLEGLHNFDMPPMPRLLAALAV

SEQ ID NO: 47179 - protein, 667 aa, Shewanella sp. ANA-3
MQKPQPLNQTREQITHLDNELLSLLAERRRLSLEVARSKEVDVRPIRDTQREKELLARLVTAGREKGLDAHYVISLYQSIIEDSVLNQQAYLHGRANPETQKQQYCIAYLGARGSYSYLAASRYCQRRQVEMLDLGCQSFDEIVQAVESGHADYGFLPIENTSSGSINEVYDVLQHTSLSIVGETTIEVSHCLLGKPGSKLSDIKTVYAHPQPISQCSRYLSQHKDLRLEYCSSSAEAMEKVNQSADNSAAAIGSTEGGALYQLESIESGLANQKINQSRFIVVARKAVAVPEQLPAKTTLIMATGQKAGALVEALLVLKAHQLNMSKLESRPIPGTPWEEMFYLDIDANISSEAMQQGLKQLERITRFIKVLGCYPCETVKPTQLSNSQLLIEPSTSKAQVISTVSLDPSPYRFSKAYKAQASEIHCGPFTIGAGHIGAIAKITLSKSLLQLESSQAALSAFERRVKQLKEAGFQAVILDGCHSLVSAEAIIPKLRQTLHQYDLLCVIAIEQATDMPLATGHADMLFLTGKQMFNQALLAQAGTLPIPLFLERNDMASYEEFMAATEAILSQGNQQLILCDSGIRTYNNANLPTLDLASLIQIKANSHLPIVINPCYAISEDTLPLQTQGIKQLKADGLVLNCSLEEDKAHDALALMAEVVRELYR

SEQ ID NO: 47180 - protein, 323 aa, Bacillus licheniformis ATCC 14580
MADLFTTVQGKVAGKGVKIVFPEGLDERILTAVNKLAGNNVLKPILVGNEQEIKDKANGLNLTLDGVDIYDPHTYEGMEDLVQAFVERRKGKATEEQARQILLDENYFGTMLVYKGLADGLVSGAAHSTADTVRPALQIIKTKEGVKKTSGVFIMARGDEQYVFADCAINIAPDSQDLAEIAIESANTAKMFDIEPRVAMLSFSTKGSAKSDETEKVANAVAIAKEKAPELTLDGEFQFDAAFVPSVAEKKAPDSVIKGDANVFVFPSLEAGNIGYKIAQRLGNFEAVGPILQGLNMPVNDLSRGCNAEDVYNLALITAAQAL

SEQ ID NO: 47181 - protein, 389 aa, Shewanella sp. ANA-3
MTSYQILCILCALALVTSVASSRLHKLQETVAITALALGMSLLLLLGGKALGGHVYGYFVAGLEKLDFQALLLNGMLGFLLFAGALQIRLKILRHQKWEILILAFVSTLLSTFIVGGLLYYIAPMLGLPLALSHCLLFGALISPTDPIAVLAILKKMGAPEDIAIQVEGESLFNDGIGLVIFVAISHLAFSTEPLTFSQISLLFVQEALGGVVYGAVLGVLLHHFFRYCEEETQLMLVTLLIPTAGYVIAEVLGVSGPLAMVSAGMIIGNYSVPKYFVRHERVKLYTFWSLIESFFNALLFLLLGLLLLLVTFKAPLWWFMLVAIPLVLTARAVSVFLPYIGFRMVKSYNPYAESILIWGGLRGGAGLGHGDEFTRGRDCRFTKRCRAA

SEQ ID NO: 47182 - protein, 550 aa, Schizosaccharomyces pombe 972h-
MGNCLSCCEKSKDEQYEPLLADREREAVADLLSFLEDRNEVNFYSEEPLRALTILAYSDNLDLQRSAALAFAEITEKDVREVDRETIEPVLFLLQSPDAEIQRAASVALGNLAVNAENKALVVKLNGLDLLIRQMMSPHVEVQCNAVGCITNLATLDENKSKIAHSGALGPLTRLAKSKDIRVQRNATGALLNMTHSYENRQQLVSAGTIPVLVSLLPSSDTDVQYYCTTSISNIAVDAVHRKRLAQSEPKLVRSLIQLMDTSSPKVQCQAALALRNLASDERYQIEIVQSNALPSLLRLLRSSYLPLILASVACIRNISIHPLNESPIIDAGFLRPLVDLLSCTENEEIQCHAVSTLRNLAASSERNKRAIIEANAIQKLRCLILDAPVSVQSEMTACLAVLALSDEFKSYLLNFGICNVLIPLTDSMSIEVQGNSAAALGNLSSNVDDYSRFIECWDSPAGGIHGYLVRFLSSEDSTFAHIAAWTIVQLLEAGVPRLTAFIQSSDDIIELLNDIVARDANNGEYEDGEGDVILLSGRALHLIEQDTDS

SEQ ID NO: 47183 - protein, 279 aa, Synechococcus sp. RS9916
MNLFADLLAASNGGKATATGPRIQQRRGVEVKSARELKIMAEASRIVATVLREIMGSVEPGQTTGDLDAIAERRIREMGATPSFKGYHGFPASICASINNEVVHGIPSNKRVIRNGDLLKVDTGAYFDGYHGDSCITICVGDAPEEAQTLSRVARESLMAGLAKIKAGNTLLDIAGAVEDHVAANGFSVVEDYTGHGVGRNLHEEPSVFNFRTDELPNVKLRAGMTLAVEPILNAGSKHCRTLKDRWTVVTRDGSLSAQWEHTIVVTSDGCEILTDRGD

SEQ ID NO: 47184 - protein, 75 aa, Triticum aestivum
FTRQCGCCGDLVEDEERREHLEAACDLATHYLCHPCALCQEGRELRRRVPHPGFNNGHSVFVMMPPMEQTMGRGM

SEQ ID NO: 47185 - protein, 174 aa, Schizosaccharomyces pombe 972h-
MGQSQSQIFEDLISNSSFSNEEIERIRKRFIKIDANQSGSIDRNEFLSIPSVASNPLASRLFSVVDEDGGGDVDFQEFINSLSVFSVHGNKEEKLKFAFKIYDIDRDGYISNGELYLVLKMMVGTNLREDQLQQIVDKTIMEVDKDRDGKISFEEFKDIVSGSNVTSSMTLDSF

SEQ ID NO: 47186 - protein, 199 aa, Francisella tularensis subsp. holarctica
MVLVGKKAPLFNAPAVLGNGEIVDSYDFAKAIQGKYAIVVFYPLDFTFVCPSELIALDKRTAKLKELGVEVVSVSIDSHFTHNAWRNTPINDGGIGPVKYTMVADINQEIVKAYDVQAAGGMAFRGTFLIDKSGVVRHQVVNDLPLGRNMDEVIRMVEALQFHEEHGEVCPAGWKKGDQGMKASPQGVAEYLSDHVIDL

SEQ ID NO: 47187 - protein, 363 aa, Anaplasma phagocytophilum HZ
MGLNCGIVGLPNVGKSTLFNALTQTTLAEVANYPFCTIEPNAGRTIVRDARLKTLASMAGSQNTIFSQVEFVDIAGLVRGASAGEGLGNKFLGHIREVDAIMHVLRCFEDEDIQHVNNAVNPVHDAEIVEMELIMADMESVKRRIMNVAKAAKSDKTQHSQKELLEKILAALEDGRPARSVADVAPQELKHLQLLTSKPVMYVCNVEDTNAATGNALVEAVKEMAQRSGSHCCYLSAKLETDILSFEDEEMRSNFLEELGMAESGIDTAVRTIYNLLDLITFFTLGPKEARAWSIMRNTPADKAAGTIHTDFEKGFIKAETISFEDYIQCGGEAECKKAGKVRFEGRDYIVQDGDIMHFRVNK

SEQ ID NO: 47188 - protein, 190 aa, Mesorhizobium sp. BNC1
MNAQLQPTGSAYFITKETEKAETRTLAVLVDNEPGVLARVIGLFSGRGYNIDSLTVSETEHERHLSRITIVTRGTPHVLEQIKHQLERIVPVHRVVDLTLTAHNRGQERPLERELAMVKVSGSGNSRVEALRLADAFRAQVIDANTEHFIFEITGRVSKIEQFIAIMKPLGLVEVCRTGVAAMNRGPEGM

SEQ ID NO: 47189 - protein, 182 aa, Schizosaccharomyces pombe 972h-
MSFQVRVKQNMQDLDNRLAAFPQLNSLEKNFGVSKLYVFLTAAGIYALFLFLNWGGFLLTNLLAFAMPAFFSINAIETTNKADDTQWLTYYLVTSFLNVIEYWSQLILYYVPVYWLLKAIFLIWLALPKFNGATIIYRHLIRPYITPHVIRICKSVSRQNAAPAPTASSFAHTTATDIPPSI

SEQ ID NO: 47190 - protein, 354 aa, Aspergillus oryzae
MVQQLPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKANDLALDLLERLLAFNPAKRITVEEALRHPYLEPYHDPEDEPTAPPIPEGFFDFDKNKDALSKEQLKILIYEEIMR

SEQ ID NO: 47191 - protein, 197 aa, Pseudomonas fluorescens Pf-5
MTCYSLDGLTPVVDPSAYVHPSAVLIGDVIVGAHCYVGPLASLRGDFGRIVLEEGANLQDTCVMHGFPDSDTVVERNGHIGHGAVLHGCRIGADALVGMNAVVMDNAHIAPRCIVSAAAFVKAGFECAPQSLIMGTPARVSRPLSDAELAWKQAGTREYQQLARRCLEQMRPCEPLREAEPGRPRIGNSALRPKARP

SEQ ID NO: 47192 - protein, 365 aa, Picea sitchensis
MASAAAENSELNMKIVNDDEWLLCMELGNFSYLPMAMKAAIELDVFQIIANAGNGVQLSSRQIVAHIPTTNPDAAISLDRILKVLASHSVLSCSVTTDENGKAEGLYGLTPLCKYIVKNRDGISLAPWVLMNQDKVFMETWHYLKDAVLEGSQPFTKAHGMNLFQYLAMDRRFNKVFNRTMSEHSTTLMCKILDMYQGFKDVQKLVDVGGGVGSTLNLIVSRYSHITGINFDMSHVVAEAPHYPGVTHVEGDMFDSIPTGEAIFMKWILHDWSDDDCVKLLKNCHKALPEKGKVIVVDTILPMGAETSPYARYAFHLDLLVLAYTPGGKERTEQEFRELGHAAGFAGGVQPICCVDGVWVIEFHK

SEQ ID NO: 47193 - protein, 336 aa, Picrophilus torridus DSM 9790
MKAALLYKNEKKLRIEDVPVPEINDDEVLIKVKAAGICHTELHFIDNVLNAGKYPIIPGHEVAGIVYKKGKNVKDLDLNDKVLLYYYRGCGKCDFCINGQENLCTNPEMEYGFINDGGFSEYIKARETDLVKLNDDIDIYSIAPIACSISTGIHALNMAKPELNDRVLVYGVGGVGFGLIQLNKLRGCRVFSASRNDKKLDIAKKLGSDYNINTCNENIVNKVKSMGGVDIIYDLVGSNETIKNDIEMLNKAGKLVLIGYDGSNVNINPLDLIINEIKIISCVGNTRYELEEAVRLFNENRIKIVIDRFDELKNINNDLEIIRNGEAMGRIVIKFD

SEQ ID NO: 47194 - protein, 343 aa, Oryza sativa Indica Group
MVDLVNGVLNWVATPAMVASLLLFYPPYYLFKTVHSFLSYLFPDDLARKVVLITGASSGIGEQLAYQYALNRASLVLVARREWSLRKVADQAFELGAPDVIILRGDVANPEDCKRFVQTTIDHYGRCKSPTSLICSWTILYATLASQVLDVNFWGSVQSTFEALPHLKRSRGRIVVTASATGWNPVPRMTFYNAANAALINFYETLRTELGSQVGITIVTPGWIESEMSKGKFLKDHGEMEVDQEMRDAQIGLFPVEYAKNCAKAMVQAVRQGERCLTVPPWFSTMYLWRVFAPEVVEFCYRLLYMQRHGGSQADAPSKKMAEASGKKLLYPTSLRSADIKDE

SEQ ID NO: 47195 - protein, 140 aa, Axonopus compressus
LVKWKGFQQGLYMGNGGGANVVAKGYTKGDGLGAEIVGTFILVYTVFSATDAKRNARDSHVPILAPLPIGFAVFLVHLATIPITGTGINPARSLGAAIIYNREHAWNDHWIFWVGPFIGAALAAIYHQVIIRAIPFKSRS

SEQ ID NO: 47196 - protein, 641 aa, Yarrowia lipolytica CLIB122
MWAPIKHALYAPKPEPGSSPTVVENPSTFQKIFNPPVKKDENAIDENAAPNGSQEMAKITSLWNRHDLWMAWGSMLLIAVALALQGRTFKVYSTFATSEFEELSLLSSLAVTQAVINVAATTVFAKLADVLGRFESFLLSVVFFTIGFIMLAVSPNIGTYFAAHIFYVSGSQGITFLQQVFAADTSSLRNRLFFVVLPNVCYIFVPWCAAPITNAIIKHSTWRWGYGMWCIIVPIVSIPVLTILFRLKMKAKSLNMAGGKSLQVRDAKETLRQFDFIGLTLLTAGLALLFLAVTLVKTSKSWTEPHVLVMVIIGPILLVLFPIWEKFPKYPFLPMKNMKNRTLITGCVFAGIHAMATSLYNPYYMPWLLVCKGLSVTAATNASATLSVSYIVTTIIAAFIIRYTRRVKPCIVAGSCIYTLGLGLTYHYRQPDVPLAKFIVTQAVEGVGNGLLQSPALVLTQSSMPKHLVISATAIYYTINSIGRVVGDAISGSLYRQQYPKRLAEFAPFMDEKTVQRMVNDVNSPLKFAWGSEERVAVIEAFNHVYRKMLYGPMIIAAVGILIALTFPNINMSEVDNGFVVEETEEDMPATAVVNEKKQQQPSETSESETEKKLPEVSSSHTVSSGPRSADLSVEEHERRV

SEQ ID NO: 47197 - protein, 461 aa, Idiomarina baltica OS145
MSQGKVVQIIGAVVDFEFPQDAVPKVYDALKVTEGNLEGLVLEVQQQLGGGIVRAIAMGTTDGLRRGIIAENTGEPIMVPVGKKTLGRIMNVLGQPIDEAGPIGEEERMSIHRAAPTYEEQSNTSDLLETGIKVIDLICPFAKGGKVGLFGGAGVGKTVNMMELIRNIAIEHSGYSVFAGVGERTREGNDFYHEMNDSNVLDKVSLVYGQMNEPPGNRLRVALTGLTIAEKFRDEGRDVLFFVDNIYRYTLAGTEVSALLGRMPSAVGYQPTLAEEMGVLQERITSTKTGSITSVQAVYVPADDLTDPSPATTFAHLDATVVLNRDIASLGIYPAVDPLDSTSRQLDPLVIGEEHYDTAMGVQEVLQRYKELKDIIAILGMDELSEEDKRTVARARKIQRFLSQPFFVAEVFTGAPGKYVSLKDTIAGFKGILEGDYDDLPEQAFYMVGTIEEAIEKAKNL

SEQ ID NO: 47198 - protein, 423 aa, Synechococcus sp. RS9916
MTPERLGLLWGVTVFAGASARLLAALTGLPGVVLLLLSGLLIGRSGLGLVEPLDLGQGLGTVVGLLVSLVLFDGGLNLRLPGDTIKATVLRISVVRLVLSLGGALLAAHWLAGLNWSVAAVYSAIVLATGPTVVTPLIQQIRLAPPLGDVLEAEGLVLEPVGAVLALLLLELLLGNLHGWRELAYGLLARLGGGVMIGLTFGWLLSEGLRRLPPDPSVGLPLQITLGMLFLMFGACEWLLPESGLPASVAAGVVVGRRPATHAAQLDEVIRELARLAITMLFPLLAADVSWAELSPLGWGGVSCVLVLMLVVRPVAVSLATVGQPLDWRQKLFMGWLAPRGIVTAAVASLFAIRLEQAGVLGAGRLQGLVFLTILMTVGLQGLTAQPLAKVLGLVAPAAEDGLSASASEAAEQSLSITAEPGQ

SEQ ID NO: 47199 - protein, 123 aa, Bacillus licheniformis ATCC 14580
MKLFLILGAVNAMLAVALGAFGAHGLEGKIPEKYLQIWQTGVQYHMYHALGLIAVALIASKLAGAGSVSAAGWLMFAGIVLFSGSLYVLSLTQISVLGAITPLGGVAFIAAWIMVVVSAVKYL

SEQ ID NO: 47200 - protein, 178 aa, Saccharophagus degradans 2-40
MSLNLVPTGKKVPDEVNVIIEIPMGGEPIKYEIDKDSGALFVDRVLGTSMRYPCNYGYVPHTLCGDGDPVDVLVYMDRPLVHGSVINCRPIGVLKMTDESGEDAKIVAVPVSKITSIYDNVQSIEDLPEIATRQIAHFFEHYKDLEAGKWVKVEGWEGVAAAKQEILDSVANYEKEAK

SEQ ID NO: 47201 - protein, 379 aa, Synechococcus sp. CC9311
MTAPNPFTARLVLQDGTVLEGFACGQRGSVIGEVVFNTGMTGYQEVLTDPSYSGQLITFTYPEIGNTGVNPDDQEADQPHARGLIVRQLAPQASNWRSQQSLPEWMEQNGVIGIHGVDTRALVRHLRELGPMNGVISSDGRPALELLEELKQAPSMEGLNLADQVTTSTAYSWTKPCNVTFDQRFQTSPARPYRVVAIDFGIKRAILERLVSHGCDLTVLPANTDINTVLSHEPEGVFLSNGPGDPAAVQSGITLASSLLEHRQLPMFGICLGHQILGLALGGTTFKLAYGHRGLNHPCGSTGQVEITSQNHGFALDAASLPSETVEITHFNLNDRTVAALAHRTQPVFGVQYHPEASPGPHDADHHFARFARLMADRR

SEQ ID NO: 47202 - protein, 460 aa, Bacillus licheniformis ATCC 14580
MAERTTSIETTVTEQKQYFLSGATLAVENRLEQLNILKDAVKKNERNILEALQKDLNKSEHEAYMTEIGIVLEEIRFISRRLKKWAKPKKAKTAVSHIGSKSIVIPEPYGTVLIIAPWNYPFQLAVSPLIGALAAGNTAVIKPSELAPAVSTVISEMIKDIFPPEYVSVIEGGVKTNQELLRQKFDYIFFTGSVPVGKVVMEAAAKQLIPVTLELGGKSPCIVHKDADLKLAAQRIVFGKLTNAGQTCIAPDYLLVHKDVKNELMRALKQSIQTFYGEKPESHLAYGKIISKRHFERLIRFLQNENIVTGGTYQKDALKIAPSIIDEPDWESPVMQEEIFGPILPVIGYETIEDVIQMVQSRPKPLALYLFTNEKTVQRHILSRISFGGGCINDTLMHTATPYLPFGGVGESGIGSYHGYHSFKTFSHEKSVLKQTNLFDISFRYPSSKNGLRIIKKLLR

SEQ ID NO: 47203 - protein, 256 aa, Erythrobacter sp. SD-21
MSLSPDRLDRFARHIVLPEVGGAGQVALAGKHLVLVGLGGIGSPALQYLAAAGIGRLTLVDDDKVDASNLQRQTLYNERDIGHGKAISAKRWVKLFDPELDVEISDRRIDAARADTLVTGADLVLDGTDNFATRLAVSDACVRAGVPLLSAAVGRFQGQVGAFAGHLPDQACYRCFVGDAFDAEDCDTCAEDGMLGAMAGWVATFAALHALRVLLDGVSAYGDPQWSRVNLLDGMKPGMRQFTIAKDPECKGCGGA

SEQ ID NO: 47204 - protein, 452 aa, Zea mays
MGNSEVGHNALGAGQIYAQGAKLVDLALGSGKIYEGEGFKYIQQSFQDGTLHLIGLLSDGGVHSRFDQLQLLLQGASERGAKRIRVHVLTDGRDVADGSSVRFVEMLEEDLARLREKGVDARIASGGGRMYVTMDRYENDWQVVKRGWDAHVLGEAPHRFRSALEALRKLREEDPKKASDQYLPPFVVVDGSGEPVGPVRDGDAVVTFNFRADRMVMLAKALEYEGFDRFDRVRFPRTRYAGMLQYDGELKLPRHYLVAPPEIQRTSGEYLARNGVRTYACSETVKFGHVTFFWNGNRSGYFDQNLEKYEEIPSDAGIPFNVQPKMKALEIAQKARDAILSQKFDQIILDAVEQVGGVFVVTADHGNAEDMAKRDKSGEPLRDKDGKVQTLTSHTLNPVPIAIGGPGLAPGVRFRTDLASAGLANVAATVMNLHGFQAPDHYEPTLIQVVDE

SEQ ID NO: 47205 - protein, 143 aa, Bacillus halodurans C-125
MTEQNEELKKKLTPLQYEVTQNNGTEPPFRNEYYDLEAEGIYVDIVSGKPLFSSKDKYDAGCGWPSFTKPIDEEEVIEKEDRSHGMFRTEVRSKQADSHLGHVFPDGPGPNGLRYCINSAALRFIPKADLEKEGYGKYKALFD

SEQ ID NO: 47206 - protein, 228 aa, Vitis vinifera
MGFDEKMEAGDKSGALETKTSETMSANQVGVDESSQNAAEEEEEEVERKIKLGPQFTLKEQLEKDKDDESLRRWKEQLLGTVDLENVGETLEPEVRILSLSIISPGRPDIVLPIPEDGKPKGLWFSLEEGSHYKLKFSFQVSNNIVSGLRYTNTVWKTGMKVDSSKEMFGTFSPQAEPYTHEMLEEITPSGFFARGSYSARSKFLDDDNKCYLEINYTFDIRKEWATP

SEQ ID NO: 47207 - protein, 188 aa, Campylobacter jejuni subsp. jejuni NCTC 11168
MKKILFIDNYDSFSYTIIYYLKELSFECKVIKNDGFKKAKELEKFDFTHLIISPGPHSPKESKLSLKAIKYFKKNKKILGICLGHQCIAEIFGGRVSKMQNPMHGKISKLYFKKDPIFKGIKKEIEICLYHSLHISSMPEKCKILAHNSENIIMAIKHKKYPIYGLQFHPEAVLTQKGKKILKNFMKL

SEQ ID NO: 47208 - protein, 164 aa, Vitis vinifera
MASLFSKPTLQAGRDEVYVATMPLRATKGPPQLLMSAAYSLNLWDLQHFMVIIKPSSPTLSQAFVYDFQPKDPENVYVALAALSGRAVQGAVLERKLTKLPRSKWWLIGCSREDGVEAAHRFNKAWHTDLKIGYHDCRDYTNGLVEYLTGEKQVLKRLRSSISR

SEQ ID NO: 47209 - protein, 523 aa, Aspergillus nidulans FGSC A4
MLVDLTIDSDPEEQPRIPNPLIKSLGRQTLAHRTLSPSPHTKNSTIPFKRKSDADSAESGSESSYASAVAYPQKAKTRTTNVSSRNPVGHDSLSGPFKRVGAGPGTGAARQARQIPASAPSLASSSGTDSAAGHYAPSPAPETLRVVIPSPSVQLKKEIDSAERLPDAEVKTPEITGMSEKYYPTDALERRAMRGAYPAARKTNRAGVPLVIGTPGPFLTEKNRRPVIDLLCKNLQKKLASIKGPAVTVAKADEKRLAKATTGFEFINEYKLREGVAPISKEFQSGCSCETICLPDRCQCLAQEEDSEERIIAYKRARDNPRFMVLRPEFMKRTSMIFECNSLCGCEEKCWNRVVQLGRTIRLEIFHTGARGFGLRSLDTIRAGQFIDLYLGEVITTSKADQREKIANTRNAPSYLFSLDFLVDDESSYVVDGANYGAATRFINHSCNPNCRMFPVSRTHGDDYLYDLAFFALREIKPGTELTFDYNPGMERVDKLDPNAVPCLCGEPNCRGQLWATERKKAR

SEQ ID NO: 47210 - protein, 132 aa, Erythrobacter sp. SD-21
MTDKLEMTDAEWRKKLSPEQYHVLREKGTERAFTGKYEKNKATGEYHCAACGQRLFDSSEKYDSGSGWPSFTAPAEDDAVEAHRDVSHGMVRTEVVCSKCEGHLGHVFPDGPGESGLRYCINSAALDFEPED

SEQ ID NO: 47211 - protein, 257 aa, Shigella flexneri 2a str. 2457T
MNPLIIKLGGVLLDSEEALERLFSALVNYRESHQRPLVIVHGGGCVVDELMKGLNLPVKKKNGLRVTPADQIDIITGALAGTANKTLLAWAKKHQIAAVGLFLGDGDSVKVTQLDEELGHVGLAQPGSPKLINSLLENGYLPVVSSIGVTDEGQLMNVNADQAATALAATLGADLILLSDVSGILDGKGQRIAEMTAAKAEQLIEQGIITDGMIVKVNAALDAARTLGRPVDIASWRYAEQLPALFNGMPMGTRILA

SEQ ID NO: 47212 - protein, 922 aa, Aspergillus nidulans FGSC A4
MASAGPATADGGAGHSHAASGHHLHATNVQSKRRTMIATPTGQWSLGKTLGAGSMGKVKVGKHLETGEQVAIKIVPRQSTEEHRSQREAERADRSKEVRTAREAAIVSLVNHPYICGMRDVVRTNYHWYMLFELVNGGQMLDYIISHGKLKEKQARKFARQIASALDYCHRNSIVHRDLKIENILISKTGDIKIIDFGLSNLFSPRSLLKTFCGSLYFAAPELLQARQYTGPEVDVWSFGIVLYVLVCGKVPFDDQSMPKLHAKIKSGVFEYPPGLTAECRHIISRMLVTDPKQRASLTEIMNHPWMNKGFSGPPDNHLPHREPLQLPLDPEVIEKMTGFEFGKPEYITAQLTKIIESEEYQHAIALNAREHPVPAHTDKKRGVFDFYKRRNSASRDTLSAPSAEAVQLGNDPLNAYSPLLSVYYLVKEKLDRERSESNPGALSIAQAPGDMLQVPDLAPPEAAHTNQYQVPGEKDTGRRSRPRARTHGDDEITEGMKNASLAPNHAQASHSPAASQPDTPAKKESTAAGLLRRFSTRRTKDRSRDRERSRLASPHQPSLNVQPPADSASPLSRGFSMRKNRRTEPSATAIPSTGSQPQHQDLLKTPGSVEPASRSNKYLERSISVSSGEPRHRRSRRTEGDSGSQPPQTSGSEYSAVPKDSTAGREQKIAPRTHASRTMSLGHARRESIQARRARRDAAREANVPEETDGEISGPGAALESANEEDLSKPVYLKGLFSVSTTSSKPLAFIRADIIRVLKQLAVDYVEIKGGFSCRHAPSIELDKVVDNGPPSPERQGQVSNHRRRISLGGLLNHDDGREELARTTTRRRHRAPDRSFVSNSEVSDEYLETRDTTVTSGERVVGETTTRVQSDTGGNLVLRFEILIVKVPLFSLHGIQFKKVSGGMWQYREMAKKILDALRL

SEQ ID NO: 47213 - protein, 536 aa, Oryza sativa Indica Group
MMASTTSATAAGGAFAAAKTRRVVGGGRRPCARVAAGGRRRSGVVVRCDAGVEAQAQAQAVAKAASVAALEQFKISADRYMKERSSIAVIGLSVHTAPVEMREKLAVAEELWPRAISELTSLNHIEEAAVLSTCNRMEIYVVALSWNRGLREVVDWMSKKSGIPASELREHLFMLRDSDATRHLFEVSAGLDSLVLGEGEILAQVKQVVRSGQNSGGLGKNIDRMFKDAITAGKRVRCETNISSGAVSVSSAAVELALMKLPKSECLSARMLLIGAGKMGKLVVKHLIAKGCKKVVVVNRSVERVDAIREEMKDIEIVYRPLTEMYEAAAEADVVFTSTASETPLFTKEHAEALPAISDAMGGVRLFVDISVPRNVSACVSEVGHARVYNVDDLKEVVEANKEDRLRKAMEAQTIITQELKRFEAWRDSLETVPTIKKLRSYADRIRASELEKCLQKIGEDALTKKTRRSIEELSTGIVNKLLHGPLQHLRCDGSDSRTLDETLENMHALNRMFSLDTEKAIIEQKIKAKVEKSQN

SEQ ID NO: 47214 - protein, 477 aa, Anaplasma phagocytophilum HZ
MSVPITVAYGDGIGPEIMEAVLLILKEAQADIAVETAEIGHAQYKRDWPCGIAPSSWASIRRTKVLLKSPTMTPQGGGHKSLNVALRKSLGLYANVRPCVTYSPIIDTGSTNLDIVVVRENEEDTYCGVEYRISQDASVCDKITTRSASERLCAYAFRYARSHNRKRVTCLIKDNIMKMTDGTFRSAFQKIAAMYPDISSEYCIVDIGMARIAAHPEEYDVVVTPNLYGDILSDVVAVASGSIGLSGSANLGEEYAMFEAVHGSAPDIAGQNIANPSGLLNAAVQMLVHIGQESTAQAIYNAFLKTLEDGVHTADIYNAKTSSSRASTTEFAQAVVNNLGTSPKYLRSMLINKNTEEAMHYERVQDTSKKVLVGADVTIHWSGGDGLNELVQSLAAALPPSVKLRLIHAKGLELWPNAPCVCSYIDLLTCRFVYDAQEGADSTSISQLLLCLEGLGLDVVKLVKLYTFDGVEGFFTP

SEQ ID NO: 47215 - protein, 361 aa, Solanum lycopersicum
MKALILVGGFGTRLRPLTLSVPKPLVEFANKPMILHQIEALKAVGVTEVVLAINYQPEVMLNFLKEFEASLGIKITCSQETEPLGTAGPLALARDKLIDDSGEPFFVLNSDVISEYPFKEMIQFHKSHGGEASLMVTKVDEPSKYGVVVMEESTGQVERFVEKPKLFVGNKINAGFYLLNPSVLDRIQLRPTSIEKEVFPKIAAEKKLYAMVLPGFWMDVGQPRDYITGLRLYLDSLKKHSSPKLASGPHIVGNVIVDESAKIGEGCLIGPDVAIGSGCVIESGVRLSRCTVMRGVRIKKHACISGSIIGWHSTVGQWARVENMTILGEDVHVCDEIYSNGGVVLPHKEIKSSILKPEIVM

SEQ ID NO: 47216 - protein, 174 aa, Francisella tularensis subsp. holarctica
MTKKVPNVTFKTRVRDEGIGGSNPFRWQDVTSADIFDNKRVIVFSLPGAFTPTCSTYQLPGFENNAARFKELGIDEIYVLSVNDSFVMNKWIQVQGIQNIKPIPDGNGEFTEALDMLVDKSNIGFGKRSWRYAMIVNNGEIEKMFVEPGKRDNADNDPYGESSPENLLKYLESK

SEQ ID NO: 47217 - protein, 491 aa, Mycobacterium avium subsp. paratuberculosis K-10
MSVAPETTVALQDRFFRELPELAVRWQAETFPELRLLVLNEPLATQLGLDTGWLRGPDGLRFLTGNLVPTGAAPVAQAYSGHQFGGFVPRLGDGRALLLGELVDNKGRLRDIHLKGSGATPFARGGDGLAAVGPMLREYVVSEAMHALGVPTTRSLAVVGTGRPVYREATLPGAVLARVASSHLRVGSFQYAAATGNRDLLRRLADHAIARHHPGAADAEQPYLALFEAVVAAQASLIAQWMLIGFVHGVMNTDNMTISGETIDYGPCAFMEAYDPDTVFSSIDFWGRYAYGNQPVIAGWNLARFAETLLPLFSENTEEAIALAERSFGVFQTRYDAVWATGMRAKLGLPAQVDAEFAAALIDELLALLKANHVDYTSFFRQLGRAARGDDRSAAEPAREMFMDLPGFDAWLARWRALGPDADAMDRVNPIYIPRNHLVEEALAAATDGDLDPLDQLLAAVTAPYTERPGFERYASPAPEDFGKYQTFCGT

SEQ ID NO: 47218 - protein, 586 aa, Nicotiana tabacum
MSRQTYRVCFCFRRRFRVVAAEAPADVKNLFNRYSDNGVMNAENLQRFLIEVQKEENASLEDAQGIMNNLHDLKILNIFHRRGLHLDAFFKYLFADINPPINPKRGIHHDMNEPLSHYFIYTGHNSYLTGNQLSSDCSDVPIIQALGRGVRVIELDIWPNSAKDDVEVLHGGTLTTPVALIKCLRSIKEHAFTVSEYPVVITLEDHLTPDLQAKVAEITQTFGDMLFSPDSCLKNFPSPESLKRRVLISTKPPKEYLQAKEVKEKDSKKGTESPDTEARGREVSDLKARYNDKDDSDDGAGVEDDESDEGDPNSQQNVAPEYKCLIAIHAGKGKGGLSDWLRVDPDKVRRLSLSEQELGKAVVTHGKEIIRFTQRNLLRIYPKGIRFDSSNYNPFVAWTHGAQMVHHMQGYGRSLWLMHGMFRSNGGCGYVKKPDILLKAGPNNQIFDPEANLPVKTTLKVTVFMGEGWYIDFKHTHFDAYTPPDFYAKIGIAGVPADNVMKKTKTLEDMDTPTWDEKFEFPLTVPELALLRVEVHEYDMSEKDDFAGQTCLPVSELRQGIRAVSLHDRKGEKYNSVKLLMRFEFV

SEQ ID NO: 47219 - protein, 563 aa, Ostreococcus tauri
MTVDDGGGSDEEDDAVVDARTERRERANPLAELRALRRTFGDSLLKFIFSVMFGLKGALMQLIGTSALPYAQQYLKFTAVQMQRYSIVAMFPWTVKPVMGMVSDLFPIGGYHKRYYIVGASAIGFAAICYLAGTEMRPGMGISYVIALVAINTQVATADLLTEGAYTERMREKPKRSSDMVSFVWLCITLGSIFSTACSFFSIKYKDYRSMMFIAVPLSAQALYTSFAGWLPEKKVGSSEESESKDAESALETGKKEYGEALWRENWRVFTLSIFMALMCLLIAGVQFFELENKYVDLIITVSITVILSICIYAALPRPVANVTFFLFLTSVTSVSFGSAMSYWFTVGNKCNPGGPQFDYLFFSVYTAIIARVCTGIGVYLFQVFFSNANVRFTFWMSAILSSFASLGDYAMVKRWNLDWGIPDKTFYLVGDTILEPMVGMMAAMPSVVLMSKMCPKNMEATMFAILASFNNLGSSLSSALGVFAMDYMGIKTDIMKEGIEGSCDFSQLPNLILYFGMLMPLTAIPLTFIFVPNINMQDTVNLETGRPENDESNSERAPLLAK

SEQ ID NO: 47220 - protein, 605 aa, Nicotiana tabacum
MSRQTYRVCFCFRRRFRVVAAEAPADVKNLFNKYSDNGVMNAENLQRFLIEVQKEENSSIEDAQGIMNNLHDLKILNIFHRRGLHLDAFFKYLFADINPPINPKRGIHHDMNEPLSHYFIYTGHNSYLTGNQLSSDCSDVPIIQALHRGVRVIELDIWPNSAKDDVEVLHGGTLTTPVALIKCLRSIKEHAFSVSEYPVVITLEDHLTPDLQAKVAEMITQTFGDMLFSPDSCLKNFPSPGSLKRRVLISTKPPKEYLQAKEVKEKDSKKGTDAPDTEAWGREVSDLKARYNDKDDSDDGAGVEDDESDEGDPNSQQNVAPEYKCLIAIHAGKGKGGLSDWLRVDPDKVRRLSLSEQELGKAIVTHGKEIIRFTQRNLLSIYPKGIRFDSSNYNPFVAWTHGAQMVAFNMQGYGRSLWLMHGMFRSNGGCGYVKKPDILLKAGPNNQIFDPEANLPVKTTLKVTVFMGEGWYYDFNHTHFDAYAPPDFYAKIGIAGVPADNVMKKTRTLENNWIPTWDEKFEFPLTVPELALLRVEVHVYDMSEKDDFAGQTCLPVSELRQGIRAVSLHDRKGERYNSVKLLMRFDMSNSESSSFEFGTSFRYHG

SEQ ID NO: 47221 - protein, 371 aa, Ralstonia metallidurans CH34
MTISRIEDIIADIRAGRMVILVDEEDRENEGDLVLAADFVTPEAINFMAKYGRGLICLTLTAERCRQLELYPMVSRNGTVHGTNFTVSIEAAEGVTTGISAADRSRTVQAAVARDARASDLVQPGHIFPLTAQPGGVLIRAGHTEAGCDLGTLAGLTPAAVICEIMKDDGTMARLPDLIEFAREHDLKIGTIADLIHYRSRTESIIERVGERDMQTPWGTFHSVLYRDKPSGRAHVALVKGKPQPDRETLVRVHEPLSVLDLLEAGHTTHSWSLPAALEVLHGAEHGVMVLLNCGDSPEMLFEQFAALDAPENRPRRKPDLRTYGVGAQILRDIGVGKMRVLGSPQKMPSMTGYELEIVGCQPMSGESNRG

SEQ ID NO: 47222 - protein, 169 aa, Ralstonia metallidurans CH34
MDHGFYESNLDGEGLRIGIVQARFNEPVCDELREACMAELKKLGVEGEDTLLVTVPGALEVPLALQKMAESGQFDALVALGAVVRGETYHFELVSNESGAGITRVGLDFNVPIANGILTVDTDAQAHARTREKGRDCARAAVEMANLVVALDSLREHGAEDAEDEEDDE

SEQ ID NO: 47223 - protein, 158 aa, Glycine max
  misc_feature (46)..(46): Xaa can be any naturally occurring amino acid
  misc_feature (92)..(92): Xaa can be any naturally occurring amino acid
  misc_feature (108)..(108): Xaa can be any naturally occurring amino acid
FLILISKQRLPHDHFPTVTTVNRAGAGLDAPLTGLKSMAGFPTRKXTNNDITSLASNGGRLQCMRGWPPGGKNNLETLSYLPDLDDAQLPKXVEYLLRKGWIPCLEFXLEHGFESREHTRKPGYYHGRYWTMWKLPMFGCTDAPEVLKELQEANTAYP

SEQ ID NO: 47224 - protein, 393 aa, Ralstonia metallidurans CH34
MDLQRLATASRLANIDAFHVMELAKQAAELERAGRHIIHMGIGEPDFTAAAPVIHAAEAAMRRGVTQYTGALGIHALREAIAGYYKTSYGIDVPARRVIVTAGASGALLLACAVLVEIGAEVLMPDPSYPCNRHFVAAFDGHAKMIPSGPEERFQLTAAQVIEHWGENTRGVLLASPSNPTGTSILPDELKAILAEVRKRQGFAILDEIYQGLSYDAPPVSALSLDDNVVTVNSFSKYFNMTGWRLGWLVVPDSLVPAFEKVAQNLFICASAVAQHAALACFTPEALAIYDERKAEFRRRRDAIVPALEALGLRVPVKPDGAFYVYANCRHVNHPAAGNADRLTQAILHDAGVVMVPGTDFGPHTANDYIRISYATSMQNIEEAMQRLHHFLR

SEQ ID NO: 47225 - protein, 523 aa, Arabidopsis thaliana
MAAMITFDFQNSFIFILFFLFSLLCYSLFFRKPKGSRAGRDLPPSPPSFPVIGHLHLLLSALVHKSFQNISSKYGPLLHLRVFHIPIVLASSASVAYEIFKAQDVNVSSRGHAPVGESLWFGSSSFFFAPYGDYFKFMRKLIATKLLGPQALERSRKIRADELDRFYKTLLDKAMKKESVEIGEEAAKLNNNIICKMIMGRSCSEENGEAEKFRHLVIESMALTKQIFFGMIFHKPLKKLGISLFQKDILSLSRKFDELLEKILFEHEEKKAEHNQANDMMDFLLEAYGDENAEYKITRNHIKSLFVDLVIAGTDTSVQATQWTMGELINNPKILQRLREEIESVVGNTRLIQENDLPNLPYLQAVVKEGLRLHPPGSISVRMFQERCELKGFYIPEKTLLVVNTYAIMRDPNFWEDPEEFKPERFIASSRSEQEDEVREEVLKYIPFSAGRRGCPGSNLAYISLGIVIGVMVQCFDWRIEGEKVNMNEAAETTALSMAQPLKCTPVSRTKNPLPSSLHIPSS

SEQ ID NO: 47226 - protein, 638 aa, Solibacter usitatus Ellin6076
MRSPRTPHTNMATILEGIQSPEQVQKLSLPELDQLAAEIRERLITVLSNNGGHLGPNLGVVELTLALHYVFQTPADSLLFDVSHQAYVHKLLTGRQDQFHTIRTPGGLNGFMLRTESPHDAYGAGHAGTALSAALGMAVARDKTGGKEHVIAVAGDAAFTCGITYEALNNIAHHTKRMIVVLNDNEWSIDKNVGAIATYLNKIVTSPRFDYLHDRAGKLVEMVGGEAALRMARRAEEVAKGMLWPSVIFEELGLKYFGPIDGHDTATLIKTFEYLKKQDRPVLLHVLTQKGKGFEPAMQKQKKFHGLGPYDPETGETKPLGRRTYSEVFADTMVKLADYDPKVVAITAAMPNGTGLDRFQPHHPDKYFDVGIAEEHAVLFAAGLAAKGFKPFCAIYSTFLQRAFDPIVHDVCLQNLPVVFCMDRGGLSADDGPTHHGLFDISYLRSVPNLVHMVPKDEDELADMLFTAMKWNGPIAVRYPRGLGPGTPVKDVPRAIAVGKAELLQHGENDRVAIFAIGAMVPLAEEIARKLEGEGIAAAVVNARFTKPIDVAMLEFFAGTAEVILTLEDHVLRGGFGSAVLEELSNLGLNTPVVRIGWPDHFIEHGKQDALRAKYGFTPEAALEKLRPYLRLRQAQPV

SEQ ID NO: 47227 - protein, 226 aa, Schizosaccharomyces pombe 972h-
MNRIGILSRSDGSSEWKQGSARVICGVNGPIDVKIRDERLNKATVEVLVQPVSGVAETLEKMISSRIVGILEDAIFLNTYPRTLIQVSIQIIEEDGTDTLAAVINGAVLALLDAGISLKYIPCAINCHWKNKITQDEPDVDGTINKLESIITICYSISSEPAKLIFLETAGPIPEEDFFRVLETAPLHAEEVSKKMKELLFETYNESDGHENEKNPKEDVEMDVVA

SEQ ID NO: 47228 - protein, 82 aa, Oryza sativa Japonica Group
MAAEKGSPLPKFGEWDVNDPASAEGFTVIFNKARDEKKTGGNSQGQDLAAKSEQPSGQGLYPAKPNSSKKWFCCMQPTAAES

SEQ ID NO: 47229 - protein, 321 aa, Erythrobacter sp. SD-21
MSRADFSADLPPEIAARVTGSVLNEGRATVVMDVAGVSEDARGALERAVTEALSGRADVTDVRVVMTAERKGPMIIVVGSGKGGVGKSTLTANLAISLAKKGVKVGLVDADIYGPSQPVIFGSQGTRPDARDNKPVPIESKYGVPHLSMGHLVTPGKALAWRGPMASGAITQLLEAHWSSETEVLLVDLPPGTGDVQLTMIQKFKPAGAVLVSTPQDLALIDAARAGQLFDTAGVPVIGLVENMSGYACPHCGEVSDPFGAGGVEAAAGRLELPFLGRIPLDMAIRQGSDTGDPPAAGDGPMAEPFHAIATRLDEWISARS

SEQ ID NO: 47230 - protein, 212 aa, Salinibacter ruber DSM 13855
MALIDISRSVSPATAVWPGDQEVQWTWTARRNEDESSVNLGSLRLSTHTGTHVDAPLHVKRQGQATDDLPLDSFVGPARVVDVNANAPSVRPEHIGQLDGASAERVLFKTSSGVSPDDEWPDAVVPIQPDTIHALADAGVSLVGTDAPSVDPLDSTDLPAHHALLDTGIVNLEGLVLTNVPPGRYELIALPLKIVGGDAAPVRAVLRDAPDP

SEQ ID NO: 47231 - protein, 241 aa, Zea mays
MAGGGGQELKLLGTWTSPFVTRVKLALSFKGLSYENLEEEDLYHNKSELLLRSNPVHRQVPVLIHNGKPICESQLIVQYIDEAFSSANGPSLLAAEPYERAVARFWGAYIDDKLFASAFQAGRANMEEEKAEALKRTFAAVETLEAAFEGISDGKPFFGGDSVGYLDIVLGGLVPMVYYGEARHGIKLFDGTRSPLLEAWVERFGALDAAKAVLPDVHELVEHSKMKRARAAAMAAATGSD

SEQ ID NO: 47232 - protein, 462 aa, Erythrobacter sp. SD-21
MATLAAHDPIPTHWTEGAPSAVDLAHIPGEGGWPLVGNTLKMLKDPHAFTRRMVEIYGRVYKNKAFGGWNVGLIGADANELLLFDRNKNFSSEQGWGPILDQLFPRGLMLMDFDHHRADRRALSIAFKPGPMRHYSGSLNRGIAQKVEDWGEGPMQFYPAIKTLTLDLAADSFIGIEWGPEADKINTAFIDMVQASVAPVRKPLPFTQMKRGVDGRKFLVDFFTAETHRRRAEGGGQDMFSQFATAEYEDGSLMPVDEVVDHMNFLMMAAHDTITSSATSLIWLLAKHPDWQEKLRQEVESVTGGIGADGRPRDLDYDDMGKLELLEMAFKEALRMVPPVPSTPRRALREFEFGGYRIPAGTHVGINAYFVHHEEENWDNPHAFDPMHFTPEKVKARHKYAWVPFGGGAHMCLGLHFAYMQVKILMAQLLPRYRIELVQEPDWQPWPIPKPRDGLRISLKAI

SEQ ID NO: 47233 - protein, 421 aa, Arabidopsis thaliana
MRGLVNKLVSRSLSISGKWQNQQLRRLNIHEYQGAELMGKYGVNVPKGVAASSLEEVKKAIQDVFPNESELVVKSQILAGGRGLGTFKSGLKGGVHIVKRDEAEEIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKTDCTMLEINPLAETSTNQLVAADAKLNFDDNAAFRQKEVFAMRDPTQEDPREVAAAKVDLNYIGLDGEIGCMVNGAGLAMATMDIIKLHGGTPANFLDVGGNASEHQVVEAFKILTSDDKVKAILVNIFGGIMKCDVIASGIVNAAKEVALKVPVVVRLEGTNVEQGKRILKESGMKLITADDLDDAAEKAVKALAH

SEQ ID NO: 47234 - protein, 200 aa, Yersinia pestis KIM
MNNDMQLKRVAEAKLPTPWGDFLMVGFEELATGHDHLALIFGDISGDKPVLSRVHSECLTGDALFSLRCDCGFQLEVALTRIAEEGRGVLIYHRQEGRNIGLLNKIRAYALQDLGADTVEANHQLGFAADERDFTLCSDMYKLLGIKAVRLLTNNPKKVEILTQAGINIVERVPLIVGENPKNEHYLATKAAKMGHLLTK

SEQ ID NO: 47235 - protein, 167 aa, Brassica napus
  misc_feature (161)..(161): Xaa can be any naturally occurring amino acid
MDYILLLLPLVLFLLAYRFLFSSKSFNLPPGPTPFPIVGNLHLVKPPVHRLFRRFADKYGDIFSLRYGSRQVVVISSLPLVRECFTGQNDVILTNRPHFLTAKYVAYDYTTVGTAAYGDHWRNLRRICSLEILSSNRLTGFLSVRKDEIRRLLTKLSREHXGRVVEL

SEQ ID NO: 47236 - protein, 333 aa, Rhodobacter sphaeroides 2.4.1
MGELIEGVWHPNWYDTASNGGRFVRSRARFRNWITADGSPGPSGEGGFPAEAGRYHLYVAHACPWAHRTMIFRALKDLAPLIDVSVVHPEMLEDGWTFDRSFPGATGDRLYGLAFLREIYLKADPGISARVTVPVLWDRKRETIVSNESAEIIRMFNAAFDHLTGNRVDFLPEGDLAEIDRLNDRIYGTVNNGVYRAGFATTQEAYDEAAAPLFETLDWLEERLATRRYLVGDRLTEADWRLFTTLVRFDKVYHTHFKCNRRQIVQYPNLWGWLRELWQVPGVAETVHFDHIVRHYYFSHDTINPHRIVPLTPDPDFAAPHGRDQLFQASRLR

SEQ ID NO: 47237 - protein, 517 aa, Pediococcus pentosaceus ATCC 25745
MANADLSNFDKIIVLDFGSQYNQLITRRIREFGIYSELLSHKITAEEIKKINPKGIIFSGGPNSVYDKDAFRIDPEIYKLGIPILGICYGMQLMTYNLGGRVEPADNREYGHADIDVTDDQAVMFKELPAKQTVWMSHGDLVREVPEGFKTVATSANCPIASMADDARKFYGVQFHAEVRNTQYGNEILRHFAFDVCEAKANWSMNDFIDMQVQQIRETVGDRKVLLGLSGGVDSSVVGVLLNKAIGDQLVCIFVDHGLLRKGEAKQVMDSLEGKFGLNIIKVDAQDRFLSKLAGVSEPEQKRKIIGNEFIQVFNDEAQKLKGIDFLAQGTLYTDVIESGTDTAQTIKSHHNVGGLPEDMHFELIEPLRTLFKDEARDLGEKLGMPEDLVWRQPFPGPGLGIRVIGEITEDKLQIVRDSDLILREEIKKAGLDRDIWQYFTVLPGIRSVGVMGDGRTYDYTVGIRAVNSIDGMTADFARIPWDVLQKISVRIVNEVDHVNRIVYDITSKPPATVEWE

SEQ ID NO: 47238 - protein, 417 aa, Vitis vinifera
MPDEAEMDLDGHSVEEQLKAFQISSLKDEDLDEEEGEAADSNSDVVDDDDCEAEPVTLGFVEKPKNGWSLLCHMFPSKAGGLPAWLDPINLPSGKSSLCDICQTPLQFLLQVYAPISEKESTFHRSLFVFMCTSMECILQDKREQWKCPPEKASRSVKVFRCQLPRSNPFYSSEPPRGDGTDKPSGIGARLCNWCGTWNGDKVCSSCRKAHYCSEKHQVMHWRSGHKFVCRQMKTSSESSNSIPVNNRTTSNKLEKVASNTLWSEYEIINEDECEFDIEMSEDNGYSSSLVSNDRSDETFKALLKHFEADDDKKSWTSFQECIGKAPEQVLRYCRSPRAKPVWPISSGRPSQVDAPKCRYCGGPSVFEFQILPQLLYYFGVKDDVDCLDWSTIAVYTCEASCEASLSYKEEFAWIQV

SEQ ID NO: 47239 - protein, 534 aa, Mesorhizobium sp. BNC1
MISDTIIERDFMRPGKSVALAGTAMIATSHPQATMAGLKILEAGGNAVDAAIAAVALQGVIDPHMTGIGGDCFALYAAAGKAPIAINGSGRAPAAATLDHFEGLGLDKIPDGSVHAVTVPGAVDAWCKLSERYGKLGLEAILQPAIDATRDGFVVMPRVAHDWARYADRLRPYPASVKQYLPGNKAPAVGDRLNHPALGETLKRIAREGRTAFYEGEVAQDMVSMLQSLGGLHTLEDFASYAAFETAPISASYRGYDLVECPPNGQGLAALVIARILDGFDLAAPDLSEADRIHLFAEATKAAYRLRDIYVADPEYMRHSAEELLSDAFIASLRNKIDMTKASAVEDFDIPLHRDTVYVTVVDADGNAISLINSLFFAFGSGIYAPKAGVLLQNRGAGFSLKRGHPNAIGPGKLPFHTIIPAMVLRDGKPIMSYGVMGGQYQAVGHVHILSQIVDHGLDVQMASDQPRSFFTDGAISLEVTISADVRAELERRGHKTRWADEPLGGCQAIWIDRERGILWGASDHRKDGVALGY

SEQ ID NO: 47240 - protein, 759 aa, Rhodobacter sphaeroides 2.4.1
MDEARQDNARHAALDYHEFPKPGKLEIRATKPLANGRDLARAYSPGVAEACLEIKADPATASRYTSRGNMVGVVTNGTAVLGLGNIGALAAKPVMEGKAVLFKKFAGIDCFDIELAEPDPLKLAEIVCALEPTFGAINLEDIKAPDCFIVEKICRERMNIPVFHDDQHGTAIVVGAAATNALHVAGKRFEDIKVVSTGGGAAGIACLNMLLKLGVKRENVWLCDIAGLVWKGREAEMTPQKAEYAQDSDLRTLAEVIEGADLFLGLSGPGVLTPAMVERMAERPIIFALANPTPEILPDEVRSVRPNAIIATGRSDYPNQVNNVLCFPFIFRGALDVGATTINDEMQLACIEGIASLARATTSAEAAAAYKGEPMSFGADYLIPKPFDPRLIGVVALAVARAAMESGVATRPIADLDAYRRRLEGSVFRSALIMRPVFEASAAESRRIVFAEGEDERVLRAANAVLEETVHKPILIGRPEVVEMRCERAGLPIRPGRDFDLVNPENDPRYRDYWESYHALMARRGVTPDTARAVMRTNTTAIGAIMVHRGEADSLICGTYGQYLWHLNYVTQILATRNRRPIGALSLMILEDGPLFVADTHVHHEPTPEEIAETVIGAARHVRRFGLAPKVALCSSSQFGNLDCSTGRRMRAALEILDERRVDFAYEGEMHIDAALDQAIRDRIFPGGRFDGPANVLVFGNSDAASGVRNILKVKANGLEVGPILMGMGNLAHIVTASITARGLLNMSALAGTPVTHYG

SEQ ID NO: 47241 - protein, 169 aa, Arabidopsis thaliana
MCGLYINLFCLLRITSNKKTMEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 47242 - protein, 1004 aa, Aspergillus oryzae
MDDQDNNSGLDNVPNTGSVGQFSFAPATRTTVVTTTTTTTTTFPPLFIKPPRATRELDPKLYPLASSPTPSSLRNIKFEIGGHSVVFNEPDDTTSAVNELREKDDALRASNGLVRSVTSICSDDTQLPRRFAPPKGSSQPSSQQSSSKQRRALAAPETRHGYLRPYPARVPSEQSIRSTRSHGPTSTHPVVAGLATPETESNNYSAGESVLPRRRIHEGDPSRLAIPQEIETDGGPEDESGTSTSQDTGYETSQEAPQQSSLGSTSQFTAVGGVAVQDMCLPSPSLSPVAAMNAMNVDSSFDSAEDPEADTDSSFDNNDHRIVSSLRAEDPRTTAPHRSRPNILPASSDTLRPTSLMDIPSVLDFFDSVPEGLKTYLMYQFLRRCPKPTLHFVADVVNPALKCDFLALLPLELSLNIVKYFDAQTMCRAAQVSKKWRHIINSDEKSWKELFDRDGYVLPEGELERAIREGWGWQFPNGGEDYEKDLSVSSPVIKPDPESGSPSMQPLPGPSDRPSSAHRRPKRKACTRVSSRKLAKRKISSSGTDHSESSDWRKSVTAAEGPYGAANAAAAAVPYPDIGLPSLRGLHLYKSLYQRHHSIHNGWMKPSVKPRHIAFRAHDRHVVTCLQFDTDKVLTGSDDTNINVYDTRTGALRATLEGHEGGVWALEYYGNTLVSGSTDRSVRVWDIERARCTQIFHGHTSTVRCLQIVLPVEVGKKADGTPEMMPKEPLIITGSRDSNLRIWKLPKPGDPVYYQNGPHVDDTDCPYFVRALIGHQHSVRTIAAHGDTLVSGSYDCTVRVWKISTGEALHRLQGHSLKVYSVVLDHKRNRCISGSMDNMVKVWSLETGSILYNLEGHSSLVGLLDLKCDRLVSAAADSTLRIWDPETGQCKNMLSAHTGAITCFQHDGQKVISGSDRTLKMWDVRTGECVRDLLTDLSGVWQVKFNDRKCVAAVQRDSLTYIEVLDFGASRDGVPEDQLGRRIVVNRWGQEVSDADEDYDLSDA

SEQ ID NO: 47243 - protein, 175 aa, Vitis vinifera
MDDDSWSFGFSTSSKSYRSALLSRPDLCIDFDDLEGDDDSKVEFPCPFCSEDFDIVGLCCHIDEEHPTESNYGICTVCGTRVGIDMIEHLTTQHGNIFKISFFTQLRRIPFTPFLAEEGPSSSTEVNFEKKSLDENMLERNMQLSPLSDKDQKEKAKQCEFVQGLLLSTFLDDNL

SEQ ID NO: 47244 - protein, 650 aa, Ustilago maydis 521
MAVSTSPSSFKGSKLLLSLLLRSPFRAALLYNRINQAPTVTSKPPTAPLLPRRSFSSGALLVHHSNSLITLSPSRIMSSSRSHSPHLATPSNPSFLSILATSTTTTTTTSSSSTSDSNQSPTTPTKASAAHASGDLDQYLIAPDQAGSVNSALHIQERALHNLTANDVHHSTSTTMGNVSEQSAMDQVLSGVLAMQKELSRLHLRMDEMESKNDVNACRRNSFYNNFTPGQMSPALKSPALFPRLTRAPSSPPKNNGSSDLLHAPHLSMGASAHTQPAPLLAEEPKLGLWAVVPAGGAGTRLWPLSRESYPKFLLDLTGSGRTLLQSTWDRLLPLAGQAQMMIVTGQAHVGGVSAQLPDLEQANVLAEPSPKESMAAIGLAAAVLLQRDPEAVLGSFAADHIISGRDAFESAVTEAVATAKAGYLVTIGIAPSHPSTGFGYIKLGEKLDVSEAPNARRVTEFKEKPDARTASAYLSTGDYRWNGGMFVVKAQVLLDLLKGTVPELHEGLTRIAASWDSDARDTVMSEVWPTLPKIAIDHAVAEPASKVGKVAVVPATFGWDDVGDFASLADLIPAEEGEPRILGDSRLVVTESQAGGLIIPAAGRPIACLGVDDVVVVDTPDALLITTRARSQDVKKIVGRTKKVYPELC

SEQ ID NO: 47245 - protein, 348 aa, Ostreococcus tauri
MFSARCARAGARTSAREAVGGRRGWIPREGAAAWTRARTTGARAVSDGRELDDAAKAKKEREYAVKWTGSPAGDEDGRADAERTRSGDDASARGESCLLGDGIWMRLREEAKSDIDGEPALASYLYSTVLAHRSIEDVLAFVLANKLRNNVLLDSQLLELFSSQYKKYPELGKMCLADMQAVFERDPACDRYLCVVLFFKGFQAIQAHACALLWLRIARRSVSVAESHIRGGMMMDHATGVVIGETAVVGENVSILHGVTLGGTGTNKGDRHPKIGDGVVIGANVTILGPIHVGSDSKIGAGSVVLDNIPDGSTAVGIPAKVINRSSPQQSQPSLSMDQTSYITDYFI

SEQ ID NO: 47246 - protein, 78 aa, Glycine max
  misc_feature (33)..(33): Xaa can be any naturally occurring amino acid
FGSPLFMPFFDNQLKFPSPLLFPAQDVVSPLFXPKPVFLVKTVFAFAPEKDISPGDKVEIVVLKASGFFCEYMALRKD

SEQ ID NO: 47247 - protein, 333 aa, Staphylococcus aureus subsp. aureus MW2
MKNLRNRSFLTLLDFSRQEVEFLLTLSEDLKRAKYIGTEKPMLKNKNIALLFEKDSTRTRCAFEVAAHDQGANVTYLGPTGSQMGKKETTKDTARVLGGMYDGIEYRGFSQRTVETLAEYSGVPVWNGLTDEDHPTQVLADFLTAKEVLKKDYADINFTYVGDGRNNVANALMQGAAIMGMNFHLVCPKELNPTDELLNRCKNIAAENGGNILITDNIDQGVKGSDVIYTDVWVSMGEPDEVWKERLELLKPYQVNKEMMDKTGNPNVIFEHCLPSFHNADTKIGQQIFEKYGIREMEVTDEVFESKASVVFQEAENRMHTIKAVMVATLGEF

SEQ ID NO: 47248 - protein, 293 aa, Oryza sativa Indica Group
MAGLSLQHPWAFAFGLLGNLISFTTYLAPIPTFYRIYKSKSTEGFQSVPYVVALFSAMLWIFYALIKSNEALLITINAAGCVIETIYIVMYLAYAPKKAKVFTTKILLLLNVGVFGVILLLTLLLSHGEQRVVSLGWVCVAFSVSVFVAPLSIIKRVIQSRSVEYMPFSLSLTLTLSAVVWFLYGLLIKDKYVALPNILGFTFGVVQMGLYVFYMNATPVAGEGKEGKGKLAAAEELPVILNVGKLAGTPDRSSGAVHVHSVPRSCAAEAAAAEPEVLVDIPPPPRAVEVAAV

SEQ ID NO: 47249 - protein, 214 aa, Photobacterium sp. SKA34
MSENLHQCVIIGIAGASASGKSLIASTVYKELKEKVGDHQIGVITEDCYYNDQSHLTMDERVKTNYDHPNALDHDLLCDHLEQLIKGEAVEVPQYSYSEHTRMKETTLLTPKKVIILEGILLLTDPRLRDIMHASVFMDTPLDICLLRRLQRDVAERGRTMESVLVQYQKTVRPMFMQFIEPSKQYADIIVPRGGKNRIAIDVLKAHIAKLLRS

SEQ ID NO: 47250 - protein, 128 aa, Zea mays
MASSLPLLNLLTLALSLLFCIALTSEVGVQAQMEETGLNLMSEALEWPTAMSLYDEDSEEEDVQNGYSRRSLFWRRMKYYISYGALSANRIPCPPRSGRSYYTHNCYRARGPVHPYSRGCSVITRCRR

SEQ ID NO: 47251 - protein, 649 aa, Saccharophagus degradans 2-40
MFDQIPTQRPNTPLLDVVDTPARLRELSEKQLPQLAKELREYLLYTVGQTGGHFGAGLGVVELTVALHYVLNTPDDRLVWDVGHQTYPHKILTGRREQMSSIRQLDGLSGFPKRSESEFDTFGVGHSSTSISAALGMALAAEMTDNQQQTVAVIGDGSMTAGMAFEALNHAAHADTNMMVILNDNNMSISKNVGGLANYFSKIWASKTYCALREGSKRVLTKIPQAWELARKTEEHMKGMVSPGTLFEELGFYYVGPIDGHDLERLVHDIRNMLAIPGPKLLHIITQKGKGFTPAEKDPVGYHALNKIEPKASITPISASGGAEAPAASTIKKPKYQTVFGDWLCDLAEVDPFVLGITPAMCDGSGMVEFAERFPDRFHDVAIAEQHAVTLAAGLACEKFKPVVAIYSTFLQRAYDQLVHDVALQNLDVTFAIDRAGLVGEDGPTHAGAFDISFLRCIPKIIIATPSDENECRQLLFSAYHHPGAAAVRYPRGTGPGAVIELENQHWPIGKGRELRQGKTVCFINFGVLLPDAIAVAEANNYGVCDMRWAKPLDKDLLLNMAEQYDYLVTLEENAVAGGAGAGVMELLAAEGISTPVLPLGLPDEYLDHGKRSQLLQAAGLDRASINQRINQWLSRHNGAAHDSQIHSL

SEQ ID NO: 47252 - protein, 576 aa, uncultured archaeon GZfos3D4
MEETGTRTKIRKYALQNAVKYEKPPKEDAVVKKVLAEHPELRKNAKQVLMSVKEEIKRIESMSKEERVEELNKIAPELVAELKLKEKEKREPGLPELPLAEGEKVVMRFAPNPNGAATLGSTRGIIVNSEYVKMHGGKFILRFDDTDPVLKRPLLEAYDWYLEDCAWLDAEPDEVVVASERMDLYYKYAEELLKKGVAYVCFCPAETFKQYKDHKRPCPHRAADIEENMGCWKKMLNGVYEEKEAVLRIKTDMASADPALRDWVALRILKRAHPRVGDKYVVWPTLDFESAIEDHLLGITHIIRGKDLMKSEKRQRFLYDHLGWRYPRTMVWGRIKMQEFGKLSTSELRKRIENGEYEGWDDPQLPTLKALRRRGFQPEAIRRFFISIGVTQTDIAVSMKNMYAENRKAVDALASRYFFVRNPKEMRINRSLKKKALPKEGNYFVAKALKHPSKEDYREIRTSNTVYISGDDFVKMKKGHEIRLKYLCTVKIESIKPLVANVIEEPTEDIPIVQWAPSEGIKVIVKKPDGTDEGIGEPLIASELDNVVQFERYGFVRIDSVVEKEEGKEVVAYFTH

SEQ ID NO: 47253 - protein, 503 aa, Saccharophagus degradans 2-40
MPQTYLKRILDARIYDLAIETPLESVPLISIRTGNNVLLKREDLQPVFSFKIRGAYNKLRLLSEEARKVGVIAASAGNHAQGLALAAKHMGVAATIVMPRTTPAIKVDAVRRRGAKVVLMGDAYDEAAAHAKKLVEEKGLTYIHPFDDPDVIAGQGTVGMEILRQHPGDIDVVFVPVGGGGLCAGVAAYIKHVRPETKVIAVEAEDSACLKLAMDKKRRAVLPSVGIFAEGVAVAQIGKETYRVIKECIDEVITVNTDEMCAAIKDIFEDTRSIAEPAGALSLAGLKKYVARTGCVDKTLIAIDSGANTNFDRLRYISERTEFGEKREAIFAVTLPEKPGAYKKFCKDLGKRNITEFNYRYADNQQAHIFVGLQITPDKNDREDIVNTLTKGGYDVVDMTDNEVAKLHVRYMVGGHATVPDEIVYRFEFPERPGALMEFLTKIAGRWNISMFHYRNHGAAFGRVLVGMQVPKGERKDLKDLLDELNYTYWDETQNEAYSFFLG

SEQ ID NO: 47254 - protein, 874 aa, Clostridium symbiosum
MAKWVYKFEEGNASMRNLLGGKGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 47255 - protein, 226 aa, Saccharophagus degradans 2-40
MTQDELKQAVAQAALDYILPHLEDDMILGIGTGSTARLFIDLLAAHKGKFDGAVSSSEASSEQLKGHGIPVYDLNSVDSLPFYIDGADEANAQLHLIKGGGAALTREKIITAVADKFICIADASKDVDVLGKFPLPVEVIPMARAHVAREIVKLGGNPVHRQDCVTDNGCQILDVYDLAIHDAPALEAKLNNIAGVVTNGLFALRPADVLLLGTTNGVETRFAAKP

SEQ ID NO: 47256 - protein, 439 aa, Bacillus subtilis subsp. subtilis str. 168
MIAKHMIRTLMIETPSVPGNLGRVATAIGLLGGDIGEVETVKVGPNYTMRNITVQVENEEQLQEVIAAVQALGEGIRLHTVSDEVLSAHEGGKIQMKSKMPIRSLAELGRVYTPGVADVCRLIEKEPEKASIYTTISNSVAIVTDGTAILGLGNIGSVAGMPVMEGKAALFDQLAGISGIPILLDTSDPEEIIKTVKHISPGFSGILLEDIGSPHCFEIEDRLKEELNIPVMHDDQHGTAVVTLAAAISACRSAGVDLKEAKVGQIGLGAAGVAICRMFMAYGVNAVYGTDKSESAMNRLEQYGGQAVSSIEELMETCDIVIATTGVPGLIKPAFVRSGQVILALSNPKPEIEPEAALQAGAAYAADGRSVNNVLGFPGIFRGALNAKSTEINHDMLVAAAEAIAACTKQGDVVPQPLDSKVHHAVAAAVEHAALTAVK

SEQ ID NO: 47257 - protein, 503 aa, Lactococcus lactis subsp. lactis Il1403
MTEQKQALFTIFGATGDLAKRKLYPSLFRLFKKGELADNFAVIGTARRPWTNEYYREVVLESIKDLMNSKTEAENFASHFYYQSHDVSDSSHYVNLKDLGEKLRKQYKTAGNQVFFLAMAPQFFGTISEHLKSENILTGEGFERIVIEKPFGTSYDTAKSLNDSLAKVFSEEQIFRIDHYLGKEMIQAVSAVRFANPIFESLWNNQHIDNVQITFAEFIGVEDRGGYYETSGALKDMIQNHVLQVLSLIAMEKPEKFDESYIVKEKVKALNAIRQYSSEEALENFVRGQYIAGRFDGEDYLGYREEDSVATDSRTETFAAGKFVIDNERWSGVPFYVRSGKRMTEKGTRINIVFKKDKDNLFAENCDDQSVQNVLTIYIQPTEGFSLSVNGKAAGQGFHLEPLRLNFRHDSEFLGNSPEAYEKLFLDVLNGDGTNFSHWEEAARAWELIDVIREAWDKETSELPTYAARTMGPKAAFDLLEKNGHEWAWQPDLWYQERGYYNK

SEQ ID NO: 47258 - protein, 264 aa, Solibacter usitatus Ellin6076
MAIRIVQVDAFTDRAFAGNPAAVCVLREAPDEQWMRDVAREMNLSETAFLVPKDDGYQLRWLTPAVEVDLCGHATVASAHVLWQDGHLPADRQARFYTRSGKLTADRRGDWIELDFPAKVAVAAEPPPELLPALGLSEAKFVGKNAFDYLVEVDSEATLRGLSPDHSMLRKLPVRGIIVTARASTPGYDFMSRFFAPGSGIDEDPVTGSAHTALGPYWAERLGKQEFTAFQASARGGVVRVRLEGDRVKLGGQAVTVMTGELLT

SEQ ID NO: 47259 - protein, 471 aa, Erythrobacter sp. SD-21
MKFTHDVIVIGGGAAGLTAAGGCALFGLDVALIEARKMGGECLNDGCVPSKALLAAAKRAAEAREPSRFGVTLEPPRVEWTGVHKHIHDAIAAIAPHDSEERFEEMGCEVFRDWAQVVGPQSVEVGWRTLTAPRIVIATGSKPAVPPIKGLEEVPYLTNENLFDLGELPDHLVIVGGGVIGMEMAQGFRRLGSEITVIEPGELMGRDDPDSVAVVRSVLEGEGVSFVSGRAERVEARDGVVRVQVGSEAVEGSHLLIATGRRANCTGFGLEEIGVEMGANGIKVDDRRRTSVKGIYAVGDCREGPRLTHVSGYEGSNVALEITLGVPTKVDWSALPWVTYTEPEVAHIGMTEKEARQKHGEKVTVVTETFHHNERSLAEASDKGHLKLVLKGKKVLGASIVGKNVGELLLPFAQSITGKSSTFALGSAIIAYPTRSEISKAAAFSAWEPTVFGPIPKKWAQFLARMRRKFA

SEQ ID NO: 47260 - protein, 446 aa, Salmonella enterica subsp. enterica serovar Paratyphi A str.
MLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALCKVIAILAFIALGATAISGFYPYAEVSGISRLWDHGGFMPNGFGAVLSAMLITMFSFMGAEIVTIAAAESDTLDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 47261 - protein, 304 aa, Mycobacterium leprae TN
MAKWTTADIPDQTGRVAVITGANTGLGYQTALALAEHGAHVVLAVRNLDKGKDAAARITATSAQNNVALQELDLASLESVRAAAKQLRSDYDHIDLLINNAGVMWTPKSTTKDGFELQFGTNHLGHFAFTGLLLDRLLPIVGSRVITVSSLSHRLFADIHFNDLQWECNYNRVAAYGQSKLANLLFTYELQRRLATRQTTIAVAAHPGGSRTELTRTLPALIAPIFSVAELFLTQDAATGALPTLRAATDAAVLGGQYFGPDGFAEIRGHPKVVASNGKSHDVDRQLRLWAVSEELTGVVYPVG

SEQ ID NO: 47262 - protein, 161 aa, Brassica napus
  misc_feature (31)..(32): Xaa can be any naturally occurring amino acid
  misc_feature (46)..(46): Xaa can be any naturally occurring amino acid
VRFAMSKDDGSFRGFGHVEFATAEQAQKALXXHGTSMLGRDIRLDXAQERGERPAYTPQSGAGGNFRSGGGGGQSVFVKGFDSSLPEEDIKSALSAHFASCGEITRVSVPCDRETGASKGIAYLDFKDGTDKAFELNGSDMGGWSIVVDQPREKIVVDRWW

SEQ ID NO: 47263 - protein, 188 aa, Anaplasma phagocytophilum HZ
MFIQIESTPNPDTLKFLLSAEVVGINSGAEFLSADDAQASPLARLLFEVEGVEKVFFGGDFVSITKAENILWEVLKPEVLVVMTDYCLLQGTDKEHVQASAEDEEKEFFDEKDSEIVQQVKELIENYVKPAVAQDGGDIKFRGYKEGVVFVKLRGACSGCPSAAVTLKDGVYGMLSYYIPAIKAVESI

SEQ ID NO: 47264 - protein, 448 aa, Cryphonectria parasitica
MASAVFFLDLKGKTLLARNYRGDIPMSAVEKFPVLLSDAEEESSAVPPCFSHEGINYLYIRHNNLYLLALTKRNTNAAEIILFLHKIVEVFTEYFKVLEEESIRDNFVVIYELLDEMMDFGYPQTTESKILQEYITQESHKLEVQARPPIAVTNSVSWRSEGIRYRKNEVFLGVVESLNLLVSANGNVLRSEILGAIKMKCYLSGMPELRLGLNDKVMFETTGRTTRGKAIEMEDVKFHQCVRLSRFENDRTISFIPPDGEFELMSYRLNTQVKPLIWVECAVESYSGSRVQYMVKTRAQFKRRSTANNVEIIVPVPEDADTPRLRTNIGSVHYAPEQSAIVWKIKQFGGLKEFLMRAELGLPSVRGDDEHGGGMTGGFGGSMGGVGAPGKGAKRPIQVKFEIPYFTTSGIQVRYLKITEPKLQYPSLPWVRYITQSGDIAVRLPDAV

SEQ ID NO: 47265 - protein, 158 aa, Mycobacterium leprae TN
MSELPRVGLGFDVHVFEPGRPCWLVGLLFPDNDGCAGHSDGDVAVHALCDAVLSAAGQGDIGGLFAVGDPRWERVSGADMLRHVVELLLRHGYEVVNASVQVIGNRPKIGPRRTEAQRLLSALLRAPVSVAATTTEGLGLTGRGEGLSAIATALVVQV

SEQ ID NO: 47266 - protein, 340 aa, Oryza sativa Japonica Group
MAVRVPSMELHRPPPSVSGVRGKSCLQKPFLVQAKRLEGLEKANPRSRGKQSLEQVKKRAPLIRGTVSPPLPVPGHITQPPYVGKKDASEIASEIQMHDKVSIIHMKAACELAARVLEYAGTLVKPSVTTDEIDKAVHKMIIDAGAYPSPLGYGGFPKSVCTSVNECICHGIPDSRELQDGDIINIDVTVYLNGYHGDTSKTFLCGEVDEASKRLVKVTEECMLRAISACKHGTSLKKIGRRISEHAERHGFGVVDRFVGHGVGRIFHSEPMIYHQRNNMPGQMVEGQTFTIEPALSMGSIDCDMWDDGWTAVTTDGSLAAQFEHTILITKTGAEILTKC

SEQ ID NO: 47267 - protein, 733 aa, Zea mays
MASAHEQARGDAAGGATSSVVADASELRQRGSKGHKKPGTDAEDDDKESGRGAGAAGGCEVTVTDSIERVFEAEPVPPWPQQVTPRALVTSLFLAVLFSVIVMKLSLTTGIIPSLNVSAGLLGFFLLRVWTAAVKDPRRPFTRQENTVVQTCVVAAYGIAFSGGFGSYLFGMSETIASQAAEENNAGNVKEPRLAWMIGFLFLVSFVGLFALVPLRKVMIIDYRLTYPSGTATAHLINGFHTPDGSERAKSQVLTLIKSSVASFFWGFFQWFYTAGDGCGFGQFPALGLAAYQNRFYFDFSTTYVGAGMICPHTVNVSVLLGGILSWGLLWPLIAQKRGSWFDAKLPDSSLEGMQGYRVFIAIAIILGDGLYKFATVLLRTVASIAASTEKRKFFGALPVNGDGSNGAAAPAPPPSFDDARRTEFFTKDQIPVPVAIGGYVVIAAVSVAAVPRLIFPQLEWYHVLAVYLMAPVLAFCNAYGMGLTDWSLASTYGKLAIFAFGAWAGKPHSGVLVGLATCGIMMNIVSTAADLMQDLKTGYMTLASPRSMFVSQVVGTAMGCVVGPSVFWLFYRAFPGVGTHRSAYPAPYALIYRNMAILGVDGFSKLPDNCLTLCCVFFVGAIAVDMARDMAPEKVAKFVPLPMAMAIPFYIGPYFAIDMFLGSVVLFAWEWVDKDQANFFAYAVASGLICGDGVWSLPQALLSLFNVKPPICMKFLSRHMNDKVDDFIATLS

SEQ ID NO: 47268 - protein, 379 aa, Glycine max
  misc_feature (203)..(203): Xaa can be any naturally occurring amino acid
MTMSITLLLQANPSHLKWNQLPSLPRRTRPDRFTPIPDSKRRVSSVKCISSSRKPDNTFSLQSPWEVLASTVSNTLKALKKPAIAAVLVGLLLMYDPTCAFAASGGRMGGRSFSSSSSSSRSYSVPRTSSSGFSFSAPYYGPSPFGGVYVGPAVGVGVGAGSSFFLILVGFLAFVLVSGFLSDRSEGSVLAATDKNTILNLQXVGLLGMGRTLQRDLNRIAAVADTSPSEGLHYVLTETTLALLRHPDYCISAYSSVDIKQGIEDGEKRFNQLSIEERGKFDEETLVNANNIKRQSTRSQRANGFSNEYIVITILAAAEGDHKLPSINGSGDLKQALQKLGSIPSSRLLAVEVLWTPQNENDTLSERELLEDYPLLRPL

SEQ ID NO: 47269 - protein, 706 aa, Mesorhizobium sp. BNC1
MSVSRRVWKLLQDRNDYFGPEGEPMRRLSHWRYSRDEEGIVWLVLDRAGESANTLSEAVMAELHTVLEDLRSLNARGLVIRSAKKGGFAAGADIRDFRDIRDAGEVEKRIQRAHDIIDRLAALAMPTVAVIHGHCLGGGLEIALACKYRIAVNGASFGFPEILLGLHPGLGGTFRLTSLIDPVEAMTMMLTGRSVHTRKAKALGLVDEIVEERHVRDAVKAAIAGNLNRASGGWKNSVFRLGPARRLAAGRMRAEAEKRAPRKHYPAPYRLIDLWEEHGGDARAMQRAEIRSFSELLLGKTSQNLIRVFFLRERLKSLAKGESGIARVHVIGAGTMGGDIAAWCASRGMRVTLTDLDPKAIAKAVGRASSLFDKKLHSSLERRDALDRLTPDFDGTGFAKADLVIEAVAEKAEVKRRVYEAIAPRMKPGAILATNTSSIPLKTLSEGLPFPERFIGLHFFNPVSRMELVEIVAHEGASEDALQRARAFCGDISRLPSPVKSAPGFLVNRALMPYLVEAFVMFDEGVPIDVIDRAARNFGMPMGPIELADQVGLDICLEVARMLKEQSPDPMPEIPSWLVQKVEAGETGRKARRGFYSYDEKGKIRKEEVKAAEGAQIPRADAEAADRLILPMLNTLVRCLRENLVNEEELIDGAMIFGTGFAPFRGGPLFYARTRGVSEITAKLRQLEEKYGERFAPDEGWERLKT

SEQ ID NO: 47270 - protein, 235 aa, Aspergillus oryzae
MPADTDPSLQFDSIEDTIKAFKNGEFIIVLDSQDRENEGDLIIAADSITPAQMAFLVRFTSGLICAPVSPEIASRLSLPQMVIENADPKGTAYTISVDSSDPSVTTGISAQDRALACRTLASPTARAEDFRRPGHIIPLQARSGGVRERRGHTEAAVEFCRLTGKVQAGVIAELVEDGELVPGVPEIGGNNGMMRRDGCLKFGKKWGIKVCTIEDLVDYVEKTEGSSSVVTNGKQ

SEQ ID NO: 47271 - protein, 413 aa, Thermotoga maritima MSB8
MLSTGLYEDFPTLKMKINGKRIVYLDSAATTLKPKQVVKKLEEFYYNSYANVHRAVHTLAVRATTEFEETREEFAEFLGASPEEIIFTSGTTMAINLAVVSLLRSGILKEDDLVLVSLLEHHANFVPWLRLSKFHGYRIDFIRPSGRFGTLEMDDLLKHRDKNPKVVAITGLSNVTGQRIPVEELRNVFPNSIILLDGAQLIPHEPVKPKEIGVDFLAFSLHKMLGPTGVGVLYGKREVLEQMEPFLYGGEMIDRVSLEDVTFNELPYKFEAGTPNIADIVASREALRYLKETGFDSVHEKIEQLTQMALKEMMKIGGVEIYGPLDERQHGIVSFNVKGIHPHDVAHILDQEFGIAVRSGHHCAQPLMSILKEQSQIDFPNSTCRASFYIYNTEEDVKILVEGVKKVKEWFSR

SEQ ID NO: 47272 - protein, 730 aa, Ostreococcus tauri
MRRGRDASRVRSRPRSSIATLVVALTGVVASSFATRALGARFKVEIATLRVQSPTSVSGRYDVAIANFGRTLYGATLTGVLTYPRETSQRTGCGDDAVITLPDDAEATRMAIILLLDRGGCPFTEKVMNGQRAGADAVIIVDNTDEPLLTMDAAADAGSDVDSKITVPAALITKADGNKFENAIVNDERVVGTMDWHDILPHPDSRVEWELWSETNDECGRACQAQNAFLRDFKAIAQSLERGGYTQFTPHYLTWECMDVPPTSKECQAQCVNVGRYCAPDPEEDINSGYSGADVVIDNLRALCVFDVVNKTGSPWLWWDYVADFSLQCTMQNGNFALRSCAESIMKTIGVDAVAVDACVGDTSADRTNPMLEAQIALQSPPESSSRPDIRLLPTVLINEERYSGKLARGEVLTALCAGFEEHSIPSMCSDAGLMHAMCVRGQEGDTTCSADAQGDGRTACRETSAFPFFECVCPEGSQSLVGPDDKMKCESVNKCAQAMHDMANCSCERCVCTNLDEGRFQCKTQNKTMCESPLARGATSQGGCWANDGFTACVDNIEAKKKASREGRDPDTVPDVVCRCPKGFEGDGKSCHEIDECATKCKGSHAKCSNTYGSYTCTCADGYVTSYQPAPVDDYVCLSQHRGGGASLVITSALMSVLAVASASYAFYQYRARSYMDKEIRQIMAQYMPLENQMDDDDDDSPYDQPPSRPARVVKQSFLPVTNTEMSDF

SEQ ID NO: 47273 - protein, 253 aa, Ustilago maydis 521
MVSKQLITSTLPALRVGLRPSPAATRRLTTCAASSVAPSLFVAFPCRTLVRPSSIAPLALHLAANTGSMAASMRSFATTSVQKAISKGEQIPNTTFTYVPWAPELADGTACGAPTKIQTHEAFKGKKVVIVAVPGAYTPTCHVNHIPPYIKQIDSFKSKGVDQVIVLAQNDPFVMSAWGVQNKAEDKVIFATDLNLEFSKAIGSIADLSAMGFGQRTGRYALIVDDLKVVDFSPEPNPGAVEVSGADHVLAKL

SEQ ID NO: 47274 - protein, 744 aa, Shewanella sp. ANA-3
MLNTLRDITQAVASAHSLETALEVLVSSTKAAMETQCCSVYILDQQELVLSATDGLEKSAVGRVRMPLTQGLVGLAAEREEAVNLADARLHPRFKLFPEVAEEEYRAFLAVPIIYQKAVVGVIVVQQASARQFSEGEEAFLMTLAAQLAMAIRGLKQKAQVSSLHQQILFQGTSASSGIAIAHALVLGGEISLEQPDVRCEDIVLESSRLVAAMGRCKEAIGALSQRFDREQDEEVASIFNALQLLLDDVSLGGEYAREVQQGWEAESAVSRVSLRYIQQFLAMEDPYLKERASDIRDLGQKVLRQLIEPERLELEPDKPVILVTREADATMLAEFPRQKLAGIVTELGGVNSHAAILARALGVPAITGVEQLLSADIDQKLLVVNASRGQLMVSPSPAIVSEYRSLISAQKALQRQYAQELALPSVMLDGTRIRLYLNAGLLSGVASEIAEGADGIGLYRTEIPFMLQQRFPSESEQVKVYQQVLSAASGRPVVMRTLDVGGDKPLPYFPIKEDNPFLGWRGIRLSLDHPELFLVQLRAMLQAGGECKQLSILLPMVSNLDEIDQSLAYLEQAYVELKNDVNSQIEMPRIGIMLEVPALLYQLDEVAKRVDFVSVGSNDLTQYLLAVDRNNPRVSSLFDSYHPGILRALHQARLDCDYHELDISICGELAGEPMGAILLVAMGYQHLSMNQGSLARINYLLRRVSRADLTQLLSQALSLSNGFQVRELVKEYLTQQGLATILN

SEQ ID NO: 47275 - protein, 563 aa, Oryza sativa Japonica Group
MASSALICDTEQWKGLQAHYDFVFRHACGGEQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 47276 - protein, 518 aa, Photobacterium sp. SKA34
MLDFPQKTHQSVKNDVLSGLTVALALVPEAVAFAFVAGVDPMVGLYAAFIVGLITAILGGRPGMISGATGAMAVVMVSLVAQHGIQYLFAAVMLAGLLQILAGVFRLGKFIRMVPHPVMIGFVNGLAIVIFLAQLGQFKVPALNGGLEWMHGTQLYIMLGLVALTMFIIYFLPKLTKAVPSSLVAILTVTALVHILGLDSRTVVDFVRTMSGDANATLAGSLPTFALPDVGFNLETLKIILPYSLILAAVGLIESLLTLTVIDEMTNTRGHGNRECVGQGVANVTCSVFGAMGGCAMIGQSMININSGGRGRLSGITAAIGLLLFILFGSSFIEMIPLAALVGVMFMVVIGTFEWASFKMMRKVPKHDFFTIILVTSVTVIADLAVAVLVGVIYSALVFAWNHAKEIYAASHIDDNGAKVYQVNGPLFFGSVSHFLELFDAQNDPKEVIIDFAKSRVADHSAIEAIDTIAERYANRNKTIHLRHLSPECSKLLKKAGSLVEVNVLEDPTYKVASDVLG

SEQ ID NO: 47277 - protein, 93 aa, Synechococcus sp. CC9311
MASFTISIEGGSSFSCADDQYILDAAEEQGIDLAYSCRAGACSTCAGKILKGSVDQADQSFLDDDQMSKGLSLLCVSYPLSDCLIKTSVEDEL

SEQ ID NO: 47278 - protein, 305 aa, Escherichia coli O157:H7 EDL933
  misc_feature (23)..(23): Xaa can be any naturally occurring amino acid
MSAKVWVLGDAGRRSLARIRRAXYCLVLAARQLTLPVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTEIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVDCVDSTGAGDAFVAGLLTGLSSTGLSTDEREMRRIIDLAQRCGALAVTAKGAMTALPCRQELE

SEQ ID NO: 47279 - protein, 468 aa, Shewanella sp. ANA-3
MSNDFQFIEVGRKDPTKHPAAKRSTQFIEIYQPFAQAQVTEQADRCLDCGNPYCEWKCPLHNYIPNWLKLAQQGRIMEAADLVHETNTLPEICGRVCPQDRLCEGACTLNADFGAVTIGNVEKYITDTAIAQGWRPDMSKVTPRKEKVAIVGAGPAGLGCADILARNGIKAVVFDKYPQIGGLLTYGIPAFKLDKAVMATRRTVLEGMGIEFKLGVTVGKDVAFNQLLEEYDAVFLGMGTYTAMKAGLEGEDAQGVYQALPYLIGNTHHLMGSSNPDTPYLNLAGKRVVVLGGGDTAMDCVRTAVRQGASSVICAYRRDEANMPGSRREVQNAREEGVNFLFNRQPVAIKTQDGKVVGVECVETQMGKADASGRQRAEAIEGSEQLLDADAVIIAFGFQPSPAPWFADYGIELDQWGRVKASKQADNPFQTTNPKVFAGGDMVRGSDLVVTAIAEGRDAAQGILNYLD

SEQ ID NO: 47280 - protein, 164 aa, Arabidopsis thaliana
MASLFTPSPTTTSSSGDTIYVAAVPLKAAAGPPQLIMSMAYSLNISNLQHFMVLIKPSSPIRQEVLVFDFQPRNPESIEAAISLLSGNLIPGVVLQRRLKNVPRQRCWMVGPSKGNDAMEMAMEFNKSWETDLRVGFHDCRHYTNELVQHLTGEMQIVERLPRS

SEQ ID NO: 47281 - protein, 134 aa, Salinibacter ruber DSM 13855
MAEIDSSRPSNDTLRDELTEEQYHVTQEAGTEKPFSGQYWDHKGDGLYRCVVCETPLFDSDTKFESGSGWPSFYDVVEDGNVHLTSDHSLGMRRTEVVCDECGAHLGHLFDDGPEPTGQRYCINSAALAFDGDE

SEQ ID NO: 47282 - protein, 588 aa, uncultured archaeon GZfos3D4
MVDVIRMNMAFHKGGETERAIFKWLRENKKGMTKNVAVLGDLPGPKIRLGGVGGAIKVSKGEHFDLYFRKRNEVSKSKRAGASVLVNDKPFEEVVKKINEYDGIGDYIGESIRNNKDVVISIADGSVILKAVGESEGVVECEVEKEGEIKDHKGVTIKRAELDAPSFEQRDKEALRFLLDEGGDFLGFVGVSFVKDAEDVLKVRKYIEDYFFEKLKKEIKGKSFEEIKNILTFEPASRAEEKGALRKEARLRAPAVIAKIETKQAWRNIDEIIDVADGIMVARGDLGLQVDPQEVPSIQKKIIKLCNLRGKPVITATEMLSSMENNPEPTRAESTDVFNAILDGTDAVMLSGETSSGKYPAHAVRMMVNIAEQAEEYFEQKGLSTDLRKSLDTRRFEEISSGSASLLNDKERRFESRIYEAAVKIPDTTGKEKEWYQWIEDFYSQKLLNRKRQRIMDSISESSCILSLSEEGDGEGENAAIVASTLTGRTARMISRFRPSIKAIIGVVHDIHTAKKLVLSSGVYPLNIGKEKNGEKYSNMDEMFEEALKLATEEGRVQRGDKVIFIGGTPLWTVEEANLIQIHAYSVK

SEQ ID NO: 47283 - protein, 428 aa, uncultured archaeon GZfos3D4
MTSEIKEIKGREILDSRGNPTVEVEVLTESGFGRAEVPSGASTGSNEAWEKRDGDKGKYGGKGVLEAVKSVNTVIKKELVGMDALEQREIDNRLIELDGTENKTKLGANSILGTSMAVCKAAAESLKKPLFAYICENVAGMKLQAELPVPIMNVLNGGEHAGNELSVQEFLILPFGFDRFSDNLRAGAETYHALKKVLAKKYGKIATNVGDEGGYAPPMSRTEEPLEVMTEAISEAGYSESEIRLGMDAAASTFFNAKTQKYVIDGMEKEGSELIDFYQALVDKYPVESIEDPFDEESFELFAELTAKMPQKIIIGDDLFVTNVNRLQEGINKKAANAILLKVNQIGSVSETLDTIRLASENGYKKVVSHRSGETEDTFIADLAVAVNAEIIKTGAPARGERTCKYNQLLRIEEQLGEQARSRKFLKA

SEQ ID NO: 47284 - protein, 224 aa, Lactococcus lactis subsp. lactis Il1403
MDNLKKQVGIKAAEFVKSGMVVGLGTGSTAAYFVEELGRRIAEEQLEITGVTTSNVTSSQARALGIPLASIDEVDYVDLTVDGADEIDSSLNGIKGGGAALLMEKIVATYSKDYIWIVDESKLSENLGSFKIPVEVIPYGSQQVFKKFEAAGYAPTWRLNEENERLITDMHHFIIDLHISQIKEPEKLAEELDLMGGVVEHGLFNNMVKKVIVAGNEGVRIINK

SEQ ID NO: 47285 - protein, 326 aa, Zea mays
  misc_feature (262)..(262): Xaa can be any naturally occurring amino acid
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALXALKEGLLVGISSGAAAAAAVRLAKRPENAGKLFVVVFPSFGERYLSSVLFQSIKKEAESMVVEP

SEQ ID NO: 47286 - protein, 441 aa, Oryza sativa
  misc_feature (428)..(428): Xaa can be any naturally occurring amino acid
  misc_feature (436)..(436): Xaa can be any naturally occurring amino acid
MSFDNFVQITGDARAVRKALFAVSTIIYKCPSKETIPLETSVSDLPPSIIVPSELPVYPSSNFYSPSDAAISSGHPSLSILGSTPHVPELTVSADAHSRLPIYQSVLPVIPAYNTPKCSGELVLRVLCPAGKIGLVIGKGGVTIKSIRKESGARIDVDDSKNDREESIITITSNEATDDAKSAAVEAVLLLQSKINDDNEGKMNLRLLVPGKVIGCLIGKGGSIVNDMRSKTKAAIYISKGEKPRKASSSDELVEVFGEVENLRDALVQIVLRLRDDVLRDSVDRQNSEKDGKLTVATTDPLYASSYPLPALLPYRQQITPLGYDHRGDIERGLEVYPHSSLYGYSSLQAIDDGYSAVSSYASKGYGGRPPHMEMTIPASGLSKVMGKHGTNLDNIIKISGAHIEIIESKSSRHGHVARISGTTEQKXSAENLIKXFIMST

SEQ ID NO: 47287 - protein, 448 aa, Picrophilus torridus DSM 9790
MEALKGINIKVEPPGPIAKKIIEMDEKYLARSTKSLPIVAKRGYNSYIEDVDGNVFLDFTTGISTTNIGYMNKNVLDAVEEQLHQLWHFAGTDFYYEAQVNAAKALGEVAPGNFNKKVFFANSGAESNEASLKVAKNYTKKRQFIGFIGAFHGRTMGALAFTASKPVQHSMYFPEMPGVVHVPYPNPYRNPFNIDGYENPDELVNRTIDFIEKYTLETYLPADDVAAIMVEPIQGEGGYIVPPENFHRELIKLAHENNILLIMDEVQTGFGRTGYFFASEYFKVEPDIISVAKSIASGIPMGASIFNEKFDFDKEGLHSNTFGGNLLASVACTATINEIKEKKMLENSRKMGKYLNKRLNELKDKYEEIGDVRGLGLMQAIDFVNDRSRRDFNVGLRDRVIERSFKNGLLLLGAGESAIRLIPPLIITEEEIDNAIEIIDESINRELK

SEQ ID NO: 47288 - protein, 467 aa, Oryza sativa Japonica Group
MAKSTPAAAAAAPEEATAAALRLRLRRLVAAVTAGGVGGGEAFDEAASALAALRDAELGPPPKDRPGAGAERRRSGHAEAAAVPEQFLCPISSEIMRDPVVLASGQTYDRRFIQEWLSAGNRTCPQTQQVLSNTILIPNHLVRSMIAQWCTENGIALSPLENQEEDLVTNNERKSFSELFDRISSSSNISEKRQAIKDLRLLTKRNSSFRAVIGENPDSISQMISAVSNPELESNSEVLEDTVTTILNLSIHESNKKIIGDDTKAITFLISALQSGTMEARSNAAAAIFSLSALDSNKAKIGESGAMRPLVDLLEHGSMTAKKDAASAIFSLCKLHENKSRATKSGVIDVVLKAISDESLTDESLTILALLSSDHETVEEIGETGGVPCMLHIIKDDQCKRNKENAVAVLFSICMYDRTKLREVVEDENLNGSLAWLAQNGTSRARRKAAGILDKLKRTIHKTHYSC

SEQ ID NO: 47289 - protein, 208 aa, Mesorhizobium sp. BNC1
MRDTMNLIPMVVEQSARGERSFDIFSRLLRERIIFLNGQVDDNSAALVCAQMLHLEAENPKKEIAFYINSPGGVVSSGFAIYDTMQFIKCPVATLCLGTAASMGSFLLMAGERGMRVALPNASIILHQPLGGFQGQASDIERHAQNVMRHKRRMIRLYAEHCGRAEEDVERTLDRDFFMTAEDAREWGLVDHVYRRRAGDLPLIAPSS

SEQ ID NO: 47290 - protein, 317 aa, Sinorhizobium meliloti 1021
MHKVIFDTDPGVDDAMALLFLHRHPAIELVGITTVFGNASIETTTRNALFLKGAWNIAAPVAKGIGETLDAGRPHVGWPTGIHGDDGLGNIDVPAQIDLPLDPRPAHRFIIDTVRANPGQVTLIAVGRMTNLARALRDDPEIATLVKAVVIMGGAFDVPGNITPAAEANIHGDPEAADVVMTAPWPVTVIGLDVTTKTVMSRAMLSDIAERGGAPARLLSDISQFYIDFYEHHVDDGMIVHDSCACAYVVAPELFQTRSGAIRVLCGGIADGQTIQKPDARLFPPNAWDGFPSQQACIGIDAEAVLKLIGDTLADGN

SEQ ID NO: 47291 - protein, 410 aa, Ustilago maydis 521
MSSTLSARTSLNLKVLRRHDPSIVTILETASFVVLYNYNDGEWTKTGVEGPLFLFRRRVPPYNGFFLMNRNGVENFSADITPDDDLEITPEFIIYRPETSNEVYGIWVFEANQRMFVGDKLLKLQQMMDGPSEEELKQAESAEAESKSVAAGDEKQTASTAVVAAGQKSAKDAEGKAVKTKANGKPKKNAKQVAGKSNDEDASARATAVSTTDVTVDSVEGTQINLDDLFGTPAVPAQFETDAAEPLSEPVTESASKGAESNDASLLDSLFQKASLDTRIANTTNTTAEASKASAPEPTDHSQNLLALLSSATAASTKPSSTPPPNCASNPPSTEKTTQAVRTSSSSPAPPKSGPKMSELIEQAIRDHIGLGDDNQPLSRREFVTELLSMIHVSAAQAKQGLYCEVDMHG

SEQ ID NO: 47292 - protein, 770 aa, Mesorhizobium sp. BNC1
MVVKKTRSDLDEAALFFHRYPVPGKLEIQPTKPLGNQRDLALAYSPGVAAPCLAIHEDPATAADYTSRANLVGVVSNGTAVLGLGDIGPLASKPVMEGKAVLFKKFAGINVFDIEIDAPDVDRMVETISALEPTFGGINLEDIKAPECFEVEERLKERMKIPVFHDDQHGTAIIVAAAVLNGLELAGKDIASVKIVTSGAGAAALACLNLLVSLGVKTENIWITDRHGVAYRGRVEEMDRWKEPYLKDTEARELADVIDGADVFLGLSAGGVLKPEMLKGMAERPLILALANPNPEIMPDVARKARADAMICTGRSDFPNQVNNVLCFPYIFRGALDVGATAINEEMKLAAVRAIAALAREEPSDVAARAYSTETPVFGPDFLIPSPFDPRLILRIAPAVAKAAMESGVATRPIEEMDAYLDRLNRFVFRSGLVMKPVFSTAKQIGRKRVIYADGEDERVLRAAQVVLEEGLAQPILIGRPHVVEMRLKRYGLRIKPGVDFEIINPEDDPRYRDYVDLLIRIAGRRGVTTEVARTLVRTNATVIAALAIMRDEADAMICGLEGRFERHLRYVEAIIGRREGVQDLSALSMLITQQGVVFLTDTYVTLDPSAAEIAEMTVLAAEEIRRFGIDPKAALLSHSDFGSRDSASAMKMREAVGILHRIAPDLIADGEMHGDAALSEELRQRVYPHALLKGEANLLVFPNLDAANITLTTLKVMTDALHVGPILLGMARPAHILTPSVTSRGIVNMTALSAVEALQSQNRQLNLPG

SEQ ID NO: 47293 - protein, 173 aa, Thermotoga maritima MSB8
MFKLDLKRFIRDIPDFPQKGIVFRDITPLLRNQEAFKEAIDRMCELVFDREFDLVVAPEARGFILGAAMAYKLGKGFVPVRKPGKLPYKTVYEEYQLEYGTEQLHIHEDAIEKGQKVLIVDDVLATGGTAEALIRLVKKLGGEVVSLAFLVELSYLEPRKRLEGYDVKTLIVY

SEQ ID NO: 47294 - protein, 448 aa, Thermotoga maritima MSB8
MSLKFDFSNLFEPNISGGLTDEDVKSVEEKVTSAVRNFVENTPDFAKLDRSWIDSVKSLEDWIINFDTVVVLGIGGSGLGNLALHYSLRPLNWNEMTREERNGYARVFVVDNVDPDLMSSVLDRIDPKTTLFNVISKSGSTAEVMATYSIARGILEAYGLDPREHMLITTDPEKGFLRKLVKEEGFRSLEVPPGVGGRFSVLTPVGLLSAMAEGIDIDELHEGAKDAFEKSMKENILENPAAMIALTHYLYLNKGKSISVMMAYSNRMIYLVDWYRQLWAESLGKRYNLKGEEVFTGQTPVKALGATDQHSQIQLYNEGPNDKVITFLRVENFDREIVIPETGRAELSYLARKKLSELLLAEQTGTEEALRENNRPNMRVTFDGLTPYNVGQFFAYYEAATAFMGYLLEINPFDQPGVELGKKITFALMGREGYTYEIKERSKKVIIE

SEQ ID NO: 47295 - protein, 583 aa, Oryza sativa
MGSMPEGRKCVGCIGRPVADARRRARLGKGSRLLARLLAPAEVRQVMRAERGCAANQVRPGEILVNGRGLSQGELDLLLGCAVPPERLAAGRYWYDKDSGLWGKEGERPDRIVSSKLSIGGKLQTDASNGTTQVFINGREITKTELRMLKLANVQCPRNTHFWLYDDGSYEEEGQNIIKGNIWQKAKFLYGTEFSPEEILNLKLMIQSNVYKYLSTLLEWRECFEDEALEEEKELGMSNHKGDENVTECELPTGEPKAVQSTSSLYSLNQRLMHFANWLLEIVALGNLDAFFPAATREYAPIVEEVWKDPAIQATYKRKNELHFLPDVASYFLDRVVEISSNEYEPTETDILYAEGVNQWNGLSTLEFSLDDRGPLSDSYADKAGNPAIQTKYQLIRMNSKGLTGGFKCLGMLEDIRAIIFCISLADYDQTWVQSSGEPCNKMIASRDLFEDVIRHPSFEDTPCVLLLNKYDAFEEKISRVPLTVCEWFADFSPVRPHHTSQTSLASHAYYYVAVKFKDLYSSVADGRKLFVFQTKALERRTVDDAFRYIREVLRWDDVKNSDAGYCSADESSYSVDMTTSPS

SEQ ID NO: 47296 - protein, 244 aa, Photobacterium sp. SKA34
MSLEGKVALVTGASRGIGRAIAEILVERGATVIGTATSESGAEAISAYLGDKGKGLALNVTSPESIESVLKQIKVDFGDVDILVNNAGITRDNLLMRMKDDEWQDILDTNLTSIFRLSKAVLRAMMKKRNGRIISIGSVVGTMGNAGQTNYAAAKAGLLGFTKSMAREVASRGITVNAVAPGFIETDMTKALNDDQRAATLANVPAGRLGDPREIAAAVAFLASDDAAYVTGETLHVNGGMYMI

SEQ ID NO: 47297 - protein, 477 aa, Escherichia coli K12
MNKKSLWKLILILAIPCIIGFMPAPAGLSELAWVLFGIYLAAIVGLVIKPFPEPVVLLIAVAASMVVVGNLSDGAFKTTAVLSGYSSGTTWLVFSAFTLSAAFVTTGLGKRIAYLLIGKIGNTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 47298 - protein, 350 aa, Nicotiana tabacum
MDPKFSGKPIPIPFLAGRTDLDQMPDTPTRIARHRRAQSETFFRFPDFDDDILLDDVVADFNLDISAPSLSPSADTHMQPANSADSSSTGGPGLMSGPGANNNPRPLNHFRSLSVDADFFDGLEFGATTPGAAAEEEKKVFGSSSVSGSGTRHRHSNSMDGSFSTASFEAECSSSVKKAMAPDRLAELALIDPKRAKRILANRQSAARSKERKIRYTSELERKVQTLQTEATTLSAQITVLQRDNSGLTNENKELKLRLQALEQGAHLRDALNEALREELQRLKIAAGQILGANGNRGPRPHFPPQPQSFVQCGSHHAQQQQQHMPHSTTSTQNIGGQTQPSFMNFNNRG

SEQ ID NO: 47299 - protein, 247 aa, Nicotiana tabacum
TVKRHVLTSVLGPNAQKRHRIHRDTLIENVSKQLHDLVRKYPNEAVNLRKIFQSELFGLALKQALGKDIESIYVEGLDATLPREDVLKTLVLDIMEGAIDVDWRDFFPYLKWVPNKSFENRIQRQHLRREAVMKALIMEQRLRINSGETLNRYIDYLSSEANTLTEQRMLMLLWEAIIESSDTTVVSTEWAMCELAKDPKRQEQLFLEIQNVCGSNKITEDKLCQLPYLCAVFHETLRKHSPVPIVP

SEQ ID NO: 47300 - protein, 422 aa, Schizosaccharomyces pombe 972h-
MDRRHRVYRVFNQEMYVEPNFKVVKELGQGAYGIVCAARNVASKDQEAVAIKKITNVFSKSILTKRALREIKLLIHFRNHRNITCIYDLDIINPYNFNEVYIYEELMEADLNAIIKSGQPLTDAHFQSFIYQILCGLKYIHSANVIHRDLKPGNLLVNADCELKICDFGLARGCSENPEENPGFMTEYVATRWYRAPEIMLSFSSYHKGIDVWSVGCILAELLGGTPLFKGKDFVHQLNLILHQLGTPDEETLSHISSSRAQEYVRSLPKQRPIPFETNFPKANPLALDLLAKLLAFDPNRRISVDDALEHPYLAVWHDPSDEPVCDSVFDFSFEYIEDANELRRVILDEVLNFRQKVRRRSHPTNPTVNIPQPAQTVPSNDNGSFNVSSSSSSQTSNKKRHDHSYNETAAIDHKSDDNRHN

SEQ ID NO: 47301 - protein, 152 aa, Streptomyces avermitilis MA-4680
MAIQVGDKAPDFELKDNHGATVRLSDFRGEKNVVLLFYPFAFTGVCTGELCALRDELPKFVNDDVQLLAVSNDSIHTLRVFAEQEGLEYPLLSDFWPHGNTSRAYGVFDEDKGCAVRGTFIIDKEGVVRWTVVNGLPDARDLNEYVKALDTL

SEQ ID NO: 47302 - protein, 820 aa, uncultured archaeon GZfos3D4
MKFIKWFEEVGTGDVALVGGKNASLGEMIQKLTEKGVNVPSGFAITAEAYRYLIQKTGIQGKIRDTLVDLDTHDMENLSERGSKIRDLIKNAECPKELEEEIRAAYRQMERRYGGGVDVAVRSSATAEDLPTASFAGQQETYLNVRGEEELVKKVMECFASLFTNRAISYRVDKGFAHLSVYLSVGVQNMIRSDLACSGVMFSIDTESGFRDAAYITGAYGLGENVVQGTVNPDQFYVFKPTLKEGFKPIVEKKLGTKRKKLVYKEKGAGTKQKKVEKAQQREFVLTDDEVLTLTRWACIIEDHYGTPMDIEWAKDGRTNELFVVQARPETVHSQKDAAVSETFVLEEDRELLKAQGRLLVEGEAVGSKIGYGEVIAIENTRDIHEFKPGQVLVTNMTDPDWEPIMKVAGAIITNRGGRTCHAAIISRELGIPCVVGTVKGTRVLKGIKDVTIDCSEGVGRIYEGKLKYRTEKLTLDNLPRPRTRIMMNAGVPENAFVHGQIPNDGVGLAREEFIINSYIGIHPQALIEYEELKKRATEEEDRKIARVVKEIDERSASYEDKVEFFVDNLARGIGKIAAGFYPNEVLVRLSDFKTNEYANLIGGYLYEPEESNPMIGWRGASRYYDDKFKPAFGLECRAIKKVREEMGLTNVKVMVPFCRTPEEGREVIKTMNEFGLKQGENGLEVYVMCEIPSNVILADEFADVFDGFSIGSNDLTQLTLGLDRDSDLVAHLFDERNEAVKRLVKQVIEVAHAHEPRRKVGICGQAPSDFPEFAEFLVECGIDSMSLNPDAVISTRLNIAEVEKRTRKNKSLTQINTDR

SEQ ID NO: 47303 - protein, 518 aa, Schizosaccharomyces pombe 972h-
MSLADELLADLDDIEETTESTITDELGPDAKKRRLELQLEEGNGISAELENDLDITKISDSAQKLPSEVANKFNDNNENIYQLLNSTRLRDIIEGTEKYKGTEKQAITGNIEDDLEYHLIVDSNSIAMEIDDEILRLHRLVKEWYHDRFPELSSLVLNAFDYCKTVSSLLNDLDNSKTKLSFLPSATVMVIATTATTTVGKPLPDEMIKNVKNCCEAIQQLGEEKQKIIEYVQSRISVVAPNLSAVVGSTTAANLIGIAGGLTRLGKFPACNLPALGKRRLTTIGINNPAVSGDYGFLYMSEIVQKTPPDVRKQAIRMTAAKVALAARIDSIHEYPDGSFGISARKEVERKIEKLLEPPSQKPTVALPVPDDRPKRRRGGRRIRKMKEQYAVTELRRLQNRVAFGKEEAEVFNFDETEGLGMLGQEGEGKIRAVSIDSRTKLRLPKARKAQLQSMAQKNPLAASGLQSSLSFTPIQGIELVNPLLQRQQKVEEANKWFRDGVFTQIKKDSNEPKNKFS

SEQ ID NO: 47304 - protein, 211 aa, Sulfitobacter sp. EE-36
MNTLVPMVVEQTSRGERAYDIFSRLLKERIIFLNGPVHDGMSSLIVAQLLHLEAENPSKEISMYINSPGGVVTSGLSIYDTMQYIKPKVSTLVIGQAASMGSLLLQAGEKGMRFSLPNSRVMVHQPSGGYQGQATDIMIHAQETQKLKTRLNEIYVKHTGQPLEKVEAALERDNFMSPEEAKDWGLIDEIVENRGKMDDPDAPKDGDKKGK

SEQ ID NO: 47305 - protein, 150 aa, Triticum aestivum
IRSSLQEHFSKCGEITRVSVPMDYENGASKGIAYMDFTDESSFSKALELSGSDLGGCNLYVAEAKPKGQFGGVGGRSGGRDGGRSGGGRFGRSGGRDGGGRFGRSGGRDGGSRFGRSGGRDGGRGGGRGFQSRQSAGTASAGKKTTFGDD

SEQ ID NO: 47306 - protein, 278 aa, Bacillus subtilis subsp. subtilis str. 168
MKKIGFVGAGSMAEAMINGILQSGITKPEHIYITNRSNDERLIELKETYSVRPCRDKNEFFTHTDIIILAFKPKDAAESIDSIRPYIKDQLVISVLAGLTIETIQHYFGRKLAVIRVMPNTSAAIRKSATGFSVSTEASKNDIIAAKALLETIGDATLVEERHLDAVTAIAGSGPAYVYRYIEAMEKAAQKVGLDKETAKALILQTMAGATDMLLQSGKQPEKLRKEITSPGGTTEAGLRALQDSRFEEAIIHCIEETAKRSAEIKEQFAGAALERHS

SEQ ID NO: 47307 - protein, 171 aa, Brassica napus
  misc_feature (86)..(86): Xaa can be any naturally occurring amino acid
  misc_feature (138)..(138): Xaa can be any naturally occurring amino acid
  misc_feature (158)..(159): Xaa can be any naturally occurring amino acid
KWVFKEPSESEPNLANYWQSSFDAIPPEWPDQFESGIQTIAVIQAGHGLLQLGSCKIIQEDLHFALRMRQMVESIGYQSGLYLFSXNGTAATPSSSSVPNQQLQSQGFNWGSHSPLLPSSSFQNQLPASTRYDFLQEXMLPPVEEQEDDIKWPNGLSXXSMALTGRAEEAS

SEQ ID NO: 47308 - protein, 140 aa, Brassica napus
MSEEFDESEIIFSDSFFPIRRREDVIEKENRPVNFRENSETRMRNTSRLSKTTPLPSSPAAFSSSSLPVNIPGRRYSSEDEEYSEDGGRRMVPPHLIVGRRIESGQMAFSVCTGQGRTLKGRDLSRVRNSVLRLTGFLEA

SEQ ID NO: 47309 - protein, 517 aa, Oryza sativa Indica Group
MEVTSTPAMLLYAALFAAALLYLAVAVRRGRGAGLPPGPTGLPLVGSLLSLDPELHTYFAGLAARYGPIFSIRLGSKLGVVVTSPALAREVLRDHDLVFSNRDTPDAACSISYGGGQNIVWNPVGPTWRLLRRICVHEMIGPAGLDSLHGLRRREFMATLRHLRARSGEPVDVGAQMFLTVMNVVTGALWGGNVGSESERTTVGKEFRELVADITELLGAPNVSDFFPALAPLDIQGIRNKSDLLKDRFDDIFARIIQKRTESDHAAAAGETASDFLEYMLKLEKEGGDGKTAFTMTNVKALLMDMVIGGTETTSNTVEWGMAEMLQNRGTLRKVREELDAVVGRDGVVEESHLPKLHYLNLVVKETLRLHPALPLMVPHCPGEDATVGGHRVPAGARVFVNVWAIQRDPAVWKDPEHFIPERFLPADGGGGRRLDFTGSEQEYMPFGSGRRICAGVAMAERMVAYSLAMLVQAFDWELPAGERLDLAERFGIVMKKATPLVAVPTPRLSNPQLYSA

SEQ ID NO: 47310 - protein, 338 aa, Pediococcus pentosaceus ATCC 25745
MVKKVAVLGAGSWGSILANMLVQNGNDVVAWTNMEEQAKELNEQHSNEHYVPGFKYDERLVATTDLEVALKDVDAVLFVVPTKVMRLVAQQMVEVLKKTGQKPIIVHASKGLELGTHKRLSEVLAEEIPSELRQAIVVLSGPSHAEEVAKQDLTLVTAASSDLASAEAVQKLFMNNYFRVYTNDDIVGVEMGAALKNVIAIGAGALHGLGYGDDAKAALITRGLAEISRLGVAFGANPLTFIGLSGVGDLIVTATSVHSRNWRAGNELGQGMKLDEVIDTMGMVIEGVPSTKAAYELAQQKNIEMPITEAIYDVLYNEKGVKEAIDELMHRDGRSELE

SEQ ID NO: 47311 - protein, 279 aa, Petunia x hybrida
MGSNQAAVSFLTNLARAAFGLGISATVVNSSLYTVDGGQRAVLFDRFRGVIDDTVGEGTHFLIPWLQKPFIFDIRTRPHTFSSTSGTKDLQMVNLTLRVLSRPEVARLPDIFKTLGLEYDEKVLPSIGNEVLKAVVAQFNADQLLTERPQVSALVRESLIRRAKDFNIVLDDVAITHLSYGAEFSKAVEQKQVAQQEAERSKFVVMKAEQERRAAIIRAEGESESAKLISDATAAAGMGLIELRRIEASREVAATLAKTPNVAYLPKQGNMLLGLNASR

SEQ ID NO: 47312 - protein, 329 aa, Solanum lycopersicum
MAKFGDLSNFLVLCILVGIAGSSYGQLQLNFYAKSCPQAEKIIQDYVYKQIPNAPSLAAALLRMHFHDCFVRGCDGSVLLNFTSSTKNQTEKVAVPNQTLRGFSFIDGVKKAVEAECPGVVSCADIVALVARDSVVVTGGPYWKVPTGRRDGEISNASEALANIPPPTSNFSSLQTSFASKGLDLKDLVLLSGAHTIGVSHCPSFSSRLYNFTGVWGKKSSLDSEYAANLKMKKCKSINDNTTIVEMDPESSSKFDLSYFQLVLRRKGLFQSDAALTTSATTKSFINQLVQGSVKQFYAEPGAMEKMGKIEVKTGSAGEIRKHCAAVNS

SEQ ID NO: 47313 - protein, 293 aa, Pediococcus pentosaceus ATCC 25745
MKKVRKAIIPAAGLGTRFLPVTKASPKEMLPIVDKPTIQYIVEEARKSGIEDILIITGKGKRAIEDHFDAVPELEENLKAKGKKEMLKMVEETTGLNMYFKRQSHPRGLGDAVLTAKSFVGNEPFVVMLGDDLMEDKVPLTKQLVDSFEETGASTLAVLPVPHEEVSKYGVIDPSEEVEKDLYNVSKFVEKPAVDEAPSNLAIIGRYVLTPEIFNILEKQGLGEGNEVQLTDAIDTLNKKQRVFAKVFNGDRYDVGNKFGFLKTNIEYGLKHPETKDELKTYIKELAKELEEK

SEQ ID NO: 47314 - protein, 289 aa, Nostoc sp. PCC 7120
MAHHWPDVEIVAVTIVNGNVPVEQGVKNALYTIQVCNASTPVYVGCTKPILRESLYADWFHGKDGMGNMYYPEPKSKPESAHATDVIIDIIKQYPGEITLVTLGPLTNIATALLKAPEIAQLVQRCVIMGGAANTVGNVTPAAEYNIWVDPEAAKIVFHSGMPMEMVGWELSRHDAALTFAEVETVMNFGTERARLAMECNRTALDVAMREQGAVGLTLADPVAIAVALDPDIVTRQGKYFVDVEITSELTRGATVVDELEVLNKSPNMNVIWAINVMGWKEILYCCLH

SEQ ID NO: 47315 - protein, 173 aa, Francisella tularensis subsp. holarctica
MLNNIPCGKDIPNDFNVVIEIPQDSDPIKYEFDKDSNMIVVDRFMSSTMRYPCNYGFVPNTIYDDGDPIDVLVLAPYPLAVGCVINCRAVGVFKMEDDGGVDAKVIAVPSSKLTKEYDHINDVDDLPVSLKQKIEHFFTHYKDLDSGKWVKVEGWDNAAFARKEIEKSVKNYK

SEQ ID NO: 47316 - protein, 508 aa, Nostoc sp. PCC 7120
MNQSAFTSPHTTGLLANRYQLQKLIGIGGMGEVFLATDILLGGAPVAIKFLTQTVCDPKIQKDFAREALMSAALSQKSLHIVRAYDYGVSDTGKPFYVMEYLNGKSLKDLIPLPLNQFVHLTRQICLGLQCAHQGIQIEGKVYPLVHRDIKPANILVIPDPILGQLVKILDFGIAKFLNHTVTLSTNRGFHGTLPYCSPEQLDGEKLDGRSDIYSLGVIMFEMLTGAKPWQPETDLFGAWYKAHNFEQPRAISEVKPQLKIPQQLNDLIMACLEKKASDRPQNVGEILQIIDALEQSKCAGLPTNISPPSYPQLTLASEVIRALEQQCKELTWPQDKPKKEIVFPLPLNTHQKNLSTLWLMLPTKEIQQRANSKIYNRFIFVTSPHPMLLWVTLLYNQEQEPKWLPCYLDMQHPLNRTLVLSLVENESYPLICFTLEPPHRCIQVLSSNIETSQRQKLKIWVEQSQKLPPTSQPQTSKNLLRQQYKEIQAHMLQHLSSTRQMEKLAKG

SEQ ID NO: 47317 - protein, 429 aa, Escherichia coli K12
MTTDDLAFDQRHIWHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 47318 - protein, 412 aa, Escherichia coli O157:H7 EDL933
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAILESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 47319 - protein, 437 aa, Physcomitrella patens subsp. patens
MTKVFSIILGGGAGTRLNPLTLRRAKPAVPLGGAYRLIDVPMSNCINSGINKIYVLTQFNSTSLNRHLARTYNFGNGCNFGDGYVEVLAAAQRPGFGGDKWFEGTADAVRQYLWLLEDAKNKDVEDVIILSGDHLYRMDYEDFVQKHKDSGADVTVSCVPMDDSRASDYGLMKIDGKGRINYFNEKPKGDDLQAMQVDTSVLGLSSEEAKKKPYIASMGIYVFKKSVLTKLLRWRYPLSNDFGSEIIPQAAKEFNVHAYLYNDYWEDIGTIKSFFDANLALTSPNSKFSFYDAAKPTYTSARYLPPTKIEKCIVKDSIVSHGCFLRDCSVENSIVGIRSRLESGCDVKRAMIMGADYYETDPEAAALLEEGKVPLGIGTNTKIRNCIIDKNARIGNNVVIANTDNVFEAARPSEGFYIRSGITVICKNAVIKHGTVI

SEQ ID NO: 47320 - protein, 175 aa, Triticum aestivum
  misc_feature (37)..(37): Xaa can be any naturally occurring amino acid
ASWAQRDKKVEEPTEVHLHAAEITLCANSCGFPGNPXATKNLCQNCFLASSSSPSPSAASPPSPSSSPAAFPLFDKLRPAAVASPLLQAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 47321 - protein, 303 aa, Physcomitrella patens subsp. patens
MDGYEKLEKVGEGTYGKVYKARDKRTGRFVALKKTRLENEDEGVPSTTLREVSLLQMLSHSIYIVRLLCVESVDENGKPQLYLVFEYLDSDLKKYIDLHGRGPGTNPIPAKTVQSFMYQLLKGVAHCHSHGVMHRDLKPQNLLVDKEKGLLKIADLGLGRAFTVPLKSYTHEIVTLWYRAPEVLLGASHYSTSVDVWSVGCIFAELSRKAPLFPGDSELQQLLHIFRMLGTPKEECWPGVNKLRDWHEYPQWPAKDLSLAVPDMSPDALDLLSRMLVFDPAKRISAKAALHHPFFDDLDKSQF

SEQ ID NO: 47322 - protein, 499 aa, Glycyrrhiza echinata
MDILSLLSYSVFYLALFFIFNIVIRARKFKNLPPGPPSLPIIGNLHHLKRPLHRTFKGLSEKYGHVISLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEIELSYRFYDMTFNNIMRMISGKRYYGEDCDMSDLQEASQFRDMVSELLQLSGANNKTDFMPLLRFLDFENLEKRLKDISGKTDAFLRGLIQEHRAKKERANTMIDHLLNLQDSQPEYYTDQIIKGLALAMLLAGTDSSAVTLEWSMSNLLNHPEVLKKVKDELDTHVGQDRLVDESDLPKLSYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLTNGDKIDMAERDGFTLTKLVPLKAMCKSRPVINKVFKQ

SEQ ID NO: 47323 - protein, 831 aa, Escherichia coli O157:H7 EDL933
MLTIQFLCPLPNGLHARPAWELKEQCSQWQSEITFINHRQNAKADAKSSLALIGTGTLFNDSCSLNISGSDEEQARRVLEEYIQVRFIDSDSVQPTQAELTAHPLPRSLSRLNPDLLYGNVLASGVGVGTLTLLQSDSLDSYRAIPASAQDSTRLEHSLATLAEQLNQQLRERDGESKTILSAHLSLIQDDEFAGNIRRLMTEQHQGLGAAIIRNMEQVCAKLSASASDYLRERVSDIRDISEQLLHITWPELKPRNNLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDNKRIDIAANIGTALEAPGAFANGAEGVGLFRTEMLYMDRDSEPDEQEQFEAYQQVLLAAGDKPIIFRTMDIGGDKSIPYLNIPQEENPFLGYRAVRIYPEFAGLFRTQLRAILRAASFGNAQLMIPMVHGLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTTAHQRGKWVGICGELGGESRYLPLLLGLGLDELSMSSPRIPAVKSQLRQLDSEACRELARQACECRSAQEIEALLTAFTPEEDVRPLLALENIFVDQAFSNKEQAIQFLCGNLGVNGRTEHPFELEEDVWQREEIVTTGVGFGVAIPHTKSQWIRHSSISIARLAKPVDWQSEMGEVELVIMLTLGANEGMNHVKVFSQLARKLVNKNFRQSLFAAQDAQSILTLLETELTF

SEQ ID NO: 47324 - protein, 286 aa, Brassica oleracea
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTVAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 47325 - protein, 523 aa, Glycyrrhiza echinata
MEPQLVAVSVLVSALICYFFFRPYFHRYGKNLPPSPFFRLPIIGHMHMLGPLLHQSFHNLSHRYGPLFSLNFGSVLCVVASTPHFAKQLLQTNELAFNCRIESTAVKKLTYESSLAFAPYGDYWRFIKKLSMNELLGSRSINNFQHLRAQETHQLLRLLSNRARAFEAVNITEELLKLTNNVISIMMVGEAEEARDVVRDVTEIFGEFNVSDFIWLFKKMDLQGFGKRIEDLFQRFDTLVERIISKREQTRKDRRRNGKKGEQESGDGIRDFLDILLDCTEDENSEIKIQRVHIKALIMDFFTAGTDTTAISTEWALVELVKKPSVLQKVREEIDNVVGKDRLVEESDCPNLPYLQAILKETFRLHPPVPMVTRRCVAECTVENYVIPEDSLLFVNVWSIGRNPKFWDNPLEFCPERFLKLEGDSSGVVDVRGSHFQLLPFGSGRRMCPGVSLAMQEVPALLGAIIQCFDFQVVGPKGEILKGDDIVINVDERPGLTAPRAHNLVCVPVERRSGGGPLKIIEC

SEQ ID NO: 47326 - protein, 270 aa, Oryza sativa
LIKVLDEADRMLDMGFEPEVRAILSQTASVRQTVMFSATWPPAVHQLAQEFMDPNPIKVVIGSEDLAANHDVMQIVEVLDDRSRDSRLVALLDKYHKAQRNRVLVFVLYKREATRVETMLQRRGWSAVSVHGDKAQHDRTKALSLFKEGSCPLMIATDVASRGLDIPDVEVVINYSYPLTTEDYVHRIGRTGRAGKKGVAHTFFTQENKGLAGELVNVLREAGQVVPPALTKFGTHVKKKESQIYGSHFKEIKADAPKSTKITFGDSDED

SEQ ID NO: 47327 - protein, 348 aa, Yarrowia lipolytica CLIB122
MTIPKTQKAIVFETSGGPLEYKDVPVPVPGDHQILVNVKYSGVCHSDLHAWMGDWPLPTKLPLIGGHEGAGVVVAKGKNVTTFEIGDYAGIKWINQACYTCEFCQEAYEPNCPKAQISGYTMDGTFQQYALADAVQAAHIPQGTDLSQVAPILCAGVTVYKAIKTSGRKAGEWLAVTGAGGGLGSLAVQYAKAMGFRVLAIDTTEEKEKMCLELGAEVFVDFAKTDNLVARVQEITGGGPHGVINVSVSEFAINQSLEYVRSVGTVVLVGLPAGAVCKSPIFSQVARAITIKGSPVGNRADTQEALSFFTRGLVHSPIHVVGLSELQKVFTLMEEGKIAGRYVVDTSK

SEQ ID NO: 47328 - protein, 464 aa, Solibacter usitatus Ellin6076
MPSPKSQDSRPGLLRQIGFFSATALVISNMVGTGIFATTGFMAGDLGSARLILACWTVGALFALAGALSYSELGINFPSSGGEYVYLTHAFGPEWGFMTGWVSFFAGFSAPIAAAALAFSDYLGYFFPLLKQANASIVIGTGTLSLRLGRGQMVASALIAAFTILNCLGVGRTAKVQNVLTSTKLIVIAGFVILGFAAGTGDWRHFSEHAVRTSTVSLPTQFMISLLWVMVGYSGWNAATYVAEEVRRPERTLPAAIAVGSLIVAVLYLGLNLVFIYATPLEQMKGVIAVGTLSASNLFGPGVAGVFSALMAVSIVSTVNAMVTIGPRVYYAMAKNRAFFSAAARVDPRWHTPVYAILSQGLCAMLMTLTPFPQLVVYIGFSLTLFTVLSVASIFIFRRRRRDWQRLRALEFAWPLIPASYILVGTCMMAYGVIWQPRASLTALATVGAGALVYRFGVHVPKVR

SEQ ID NO: 47329 - protein, 238 aa, Oryza sativa
EVRAQRRAMAAAAGRMEEYGVGRILDITHAYRADLPAFAPGAVTGPVVRLRDSMANGTLYNLSELKMECHMGTHVDAPGHMNQGHFAAGLDVDKLDLDLLNGPTLLVDTPRNTNITAKAMESLNIPKGVRRVLFRTLNTDRKLMWKKGGDLSYVGFTEDGAQWLVDNTDIKLVGIDYLSVAAYDHLITAHVVFFKFPNIILVEGLKLDDVKAGIYMLHCLPLRLVGSEGSPIRCILIK

SEQ ID NO: 47330 - protein, 228 aa, Capsicum chinense
MATAEMEKTTTFDEAEKVKLNANEADDEVEEGEIVEETDDTTSYLSKEIATKHPLEHSWTFWFDNPVAKSRQAAWGSSLRNVYTFSTVEDFWGAYNNIHHPSKLVVGADLHCFKHKIEPKWEDPVCANGGTWKMSFSKGKSDTSWLYTLLAMIGHQFDHEDEICGAVVSVRGKGEKISLWTKNAANETAQVSIGKQWKQFLDYSDSVGFIFHDDAKRLDRNAKNRYTV

SEQ ID NO: 47331 - protein, 584 aa, Medicago truncatula
MMQYTDEEVERCFEEFYEDVHTEFLKFGEIVNFKVCKNGSFHLRGNVYVQYKLLDSALLAYNSVNGRYFAGKQVSCKFVNLTRWKVAICGEYMKSGYKTCSHGTACNFIHCFRNPGGDYEWADSDKPPPKFWVKEMVALFGHSDNCEMSRVHGNFSALKHSSNILETDSDRYHSRRSRSREMGQLYGGRSSRRRQEDERKQRTLDEEWNTNYKDNHKRKYRNKTSDSDSDKEGLEEVDRKKYHEHTRKSSFNWNKDDNSRRHEEYSDVDRVTINRDNEKPHDRKGRNSQKSNRDSRDWIYEAGCDEDRDGDGRKHHISRRKGSRHQSRDNSNVTDESESDKDRGHEEYSDVDWDTMSRENEKQHGSNGRNSQKWNRDSRYRIYEAGSDEDRHRKRHHSSQRKGSRHRSRDNSNVADESESDKDRGHEKYSDVDWDTMSRDNEKQHDSKGKNSQKRNGDSKYQIDEAGSDEDRHRKKHLSSQMKESRHQSSDSGYGIDESDKDKGEMEAQHDYENENDKVDGGWSHRDNDRRAHHHKKKRLKYQKKLDSTNGDSKNVSHKNSGELSSKNPSEDRHEQGKGSDSHL

SEQ ID NO: 47332 - protein, 251 aa, Medicago truncatula
MWSNRKEKRKALKKLKRKERRKEIAEKERLEEEARLNDPEEERKRILLEQQEAERIERDRIAFEEREKAWIIKQQQQRDLEEEQQQLSQRDLEQHESELEEEEEEDVDDDDDGRPEIIWLGNEIIIQKKNPNPLLLLHNHNHHHHHHHHQEQHEHHDNRPTSNPFPPESPSQPLHNVAQQPPNFGTELDKAHCPFHLKTAACRFGDRCSRVHFYPDKSCTLLIKNMYNGPGLAWEQDEGLEAVAQSWLEEL

SEQ ID NO: 47333 - protein, 491 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERRLLRRSHVTKRFDMPGSFHTEWFKIARNSKI

SEQ ID NO: 47334 - protein, 397 aa, Synechococcus sp. RS9916
MLTSRRLDRLGSGVFDRNDQRKQLYRSSAAADSQPLVDLSLGSTDLEPPPEALEAMAAALDRSGSATYCLHAGTRPFREAVSAWCARRFDVAVDPDREVLLLVGSQEGTAHLPLAVLNPGDGGLILDPCYPSHRGGLLLADARVEHLPLDPQEQWRPRFDSLSDTVWDQLRLMVMGFPHNPSAQVGQQAWLDEAMARAQRHDLVFAHDNPYVDLALDGEAPSLLRCAGWRERGMEFFSLSKGWCLGGFRLGFAVGAEPLITALRQLKGVVDFNQSLALQEGAMAALSQAPDWPQRLLPVYRERRDRTLQALARLGWQVPTPSMALYLWLPLPGWARERGWNDEQLTAALLEQTGLALTPGSGFGAGGQDWMRMALVRPVEELEAAVARLESFWQQQC

SEQ ID NO: 47335 - protein, 489 aa, Bacillus subtilis subsp. subtilis str. 168
MKTNQQPKAVIVIFGATGDLAKRKLYPSIHRLYQNGQIGEEFAVVGVGRRPWSNEDLRQTVKTSISSSADKHIDDFTSHFYYHPFDVTNPGSYQELNVLLNQLEDTYQIPNNRMFYLAMAPEFFGTIAKTLKSEGVTATTGWSRLVIEKPFGHDLPSAQALNKEIREAFTEDQIYRIDHYLGKQMVQNIEVIRFANAIFEPLWTNRYISNIQITSSESLGVEDRARYYEKSGALRDMVQNHIMQMVALLAMEPPIKLNTEEIRSEKVKVLRALRPIAKDEVDEYFVRGQYHAGEIDGVPVPAYTDEDNVAPDSNTETFVAGKLLIDNFRWAGVPFYIRTGKRMREKSTKIVVQFKDIPMNLYYGNENNMNPNLLVIHIQPDEGITLYLNAKKLGGAAHAQPIKLDYCSNCNDELNTPEAYEKLIHDCLLGDATNFAHWDEVALSWSFVDSISETWAANKTLSPNYESGSMGPKESDDLLVKDGLHWWNI

SEQ ID NO: 47336 - protein, 339 aa, Lactococcus lactis subsp. lactis Il1403
MSNQEPIANYKFNYKTTANKVMKNINLSGKTIIITGGYSGIGLEMTKQLSRAGAKIIIPARRMEVAKKNLSKIKNIDILPLDLTNPESIHQFAESFLQNNSKLDILINSAGLMYLPLKRDSRGIEYHFATNHLGHYQLTLELLPALKNAKISRVINLSSRAQQMTPLLEDWNFEKIENYNPQIGYQQSKTANVLFSIKLDELGKKYGIRSFAVHPGMIPMTNIGRQNSPITPWLRYLADYFKLIHIPVFFNALKSGFDRSKYRYLKTIAQGAATPLWASTSPDLEGKGGLYCEDLNIARLMTSEEANNFSGGLRPHAIDHNDADRLWQISKNITGLDFE

SEQ ID NO: 47337 - protein, 581 aa, Aspergillus nidulans FGSC A4
METDQLGYGERERVIGMGNEDRRWCKAWPKRKQSRMPPQFMCQEVRRQRRLRKQLKPRSLLLLQWQSTSRSMIFLGSTPYSKPSIVAKSGTLSYETVASTTRAGLGQSLCISMGGDPLAGTNFVDALKIFENDPDTEGIILVGEIGGTAEMDAAEWIRDYRRRTTSPKPIMALVGGRQAPPGRIMGHAGAWTAPGEPGPEEKYRALERAGAVMVNHPEKFGKGMKALLTNRRSTSSSAKLTTQSTFGGQKRSLHTMRRVIPRRQQTLQKCQSRTLYIKQFQALDMLKKAGIQVNETSVSASDVHISLTIDRTALSPALITSTSPGFEPSNSARLPFPYIKEKFEASDSIITTAATQLSLPTSAHGKLAGIVQALWQIFKQREAFVLEVRANYSAEGGFEVRGARFGFDDAAFRSSGRQEEIHALRDVKEEVPEEVEAEKDGIVYVKLNGKGSIGTLVNGAGLAMNTVDALTHHGGSCANFLDTGGKATSETVKSSFRIITSDPRVKAIFVNIFGGLTRCDMIAEGIILAFRDMQMSVPVVVRLRGTNEESGQQMIAESGLPLHAFDSFEDAAKKVIALAKE

SEQ ID NO: 47338 - protein, 456 aa, Bacillus halodurans C-125
MKVTKFGGTSVASAEQIRKVATIVADDVERKIVVVSAPGKRHSSDTKVTDLLIRLGETYLEKGYANEELEAVLRRYEEIAKGLELGQEIIDQIANDLHTRLTFNQSNPGAFMDQLKASGEDNNAKLIAAYLQTKGMNAVYVSPKEAGLLVSDEPGNAQVLPEAYDHLKKLRERDEMIVFPGFFGFSPDGALVTFPRGGSDITGAILAAGVKAELYENFTDVDSVFAANPNVVESPAQIRRMTYREMRELSYAGFSVFHDEALIPAFRQKIPVCVKNTNNPSSPGTMILAEREYFLNPVIGIAADKGFATIYVRKYLMNREIGFGRRLLQIIEDEGLSYEHIPSGIDDASVILRQEQLTDEIEHRILARIKEELCVDDVFVEKDFAMVMIVGEGMHNTVGISARATAALARAHVNIEMINQGSSEVSLVLGIHEKDADAAVRELYEEFFGGAEETVQ

SEQ ID NO: 47339 - protein, 618 aa, Arabidopsis thaliana
MSLPIPPKFLPPLKSPPIHHHQTPPPLAPPRAAISISIPDTGLGRTGTILDESTSSAFRDYQSLFVSQRSETIEPVVIKPIEGSIPVNFPSGTYYLAGPGLFTDDHGSTVHPLDGHGYLRAFHIDGNKRKATFTAKYVKTEAKKEEHDPVTDTWRFTHRGPFSVLKGGKRFGNTKVMKNVANTSVLKWAGRLLCLWEGGEPYEIESGSLDTVGRFNVENNGCESCDDDDSSDRDLSGHDIWDTAADLLKPILQGVFKMPPKRFLSHYKVDGRRKRLLTVTCNAEDMLLPRSNFTFCEYDSEFKLIQTKEFKIDDHMMIHDWAFTDTHYILFANRVKLNPIGSIAAMCGMSPMVSALSLNPSNESSPIYILPRFSDKYSRGGRDWRVPVEVSSQLWLIHSGNAYETREDNGDLKIQIQASACSYRWFDFQKMFGYDWQSNKLDPSVMNLNRGDDKLLPHLVKVSMTLDSTGNCNSCDVEPLNGWNKPSDFPVINSSWSGKKNKYMYSAASSGTRSELPHFPFDMVVKFDLDSNLVRTWSTGARRFVGEPMFVPKNSVEEGEEEDDGYIVVVEYAVSVERCYLVILDAKKIGESDAVVSRLEVPRNLTFPMGFHGLWASD

SEQ ID NO: 47340 - protein, 506 aa, Bacillus subtilis subsp. subtilis str. 168
MSTWIIFTRNRKQAEEGGGREKLAQQRQKGKLTARERIIFLLDQDSFIELHPFMESQVLTREQRMLGDGVVTGYGTIDGRSVYVFAQDFTVYGGALGETHARKICALMDLAAKNKAPIIGLNDSGGARIQEGVLSLDGYGHIFYRNVLYSGVIPQISVILGPCAGGAVYSPALTDFIFMAEQTGRMFITGPKVIEKVTGEQVDAESLGGAGIHNAVSGNAHFSGHTEKEVLTGVRKLLSYLPLNGRTTEPKPEKEASRPLLNRLVPADTTKPYDVRKVIRELADPQSFFEIQPFFAKNIVIGFARLGEKAIGIVASQPKHLAGSLTIDAADKAARFIRFCDAFDIPLLTVEDVPGFLPGIQQEHNGIIRHGAKLLFAYAEATVPKVTLIIRKAYGGAYVAMNSKAIGADLVFAWPNAEIAVMGPEGAASILYEKEIKASADPQKTKREKTAEYKKQNAGPYKAAACGMVDDIILPEESRGRLIQAFHMLTHKTEERPKKKHGNIPL

SEQ ID NO: 47341 - protein, 400 aa, Crocosphaera watsonii WH 8501
MSKKTIANLSAADLAGKRVLVRVDFNVPFDNGSITDDTRIRAALPTIKELISNGAKVILCSHMGRPKGKVVDSMSLTPVAARLGELLGQKVTMCDDCVGESVTAAIGGLENGQVALLENLRFHSEEEGNDPEFAKQLAANADLYVNDAFGTAHRAHASTEGVTHYLSPSVAGYLIEKELQYLQAAIENPQRPLVAIIGGSKVSSKIGVIETLLEKCDKLIIGGGMIFTFYKARGLNVGKSLVEDDKLELAKSLEAKAKEKGVDFLLPSDVVLADNFAPDANAKTTSIDNIEDGWMGLDIGPDSIKLFQDALSDCKAVIWNGPMGVFEFDKFAAGTEAIARTLAELTGTGTTTIIGGGDSVAAVEKVGVAEKMSHISTGGGASLELLESKVLPGIAALDEA

SEQ ID NO: 47342 - protein, 279 aa, Bacillus halodurans C-125
MLQDHKITFLGAGSMAESIIAGLLSKKLLLPSQVIATNLCDEAKLTKLEDRYGICTTQNRQEAVRQGTIIFLAMKPKNIEEAIEEIRGEITEKQLFISVLAGTTTSYIETLLAHEVPVVRTMPNTSAKVGASATGLCGGRYANASHVKLATLIFTAIGTVTEVTEDKLDAVTGLAGSGPAYFYYMVEAMERAAVQSGLTESEAKAFISQTLIGTGKRLEQTSKTAEELYKEVMSPGGTTEAGLRVLEQQQMQQAIEEAITAAINRSRELGSTPSLEIKK

SEQ ID NO: 47343 - protein, 571 aa, Anaplasma phagocytophilum HZ
MHHSSYLLDVIVLLAAAVVVVVLFWKLRISPVLGYFVAGAAIGTHGLQLVESSSIINSLAEFGVVFLLFLIGIELTFERLSAMRMHVFGFGTLQVIVTATLIWCVARGLGVDSESSVVIGGALALSSTAIVLQVLQEKGMQSSQVGRLSIAVLLLQDFAVVPLIVLLPLLAGESNSLVGSLFIAFLKAGVALALIFVTGRLLLRPLFGTIAAMKSNEVFIASTLLIVLGAAFVTENFNLSMALGAFVSGLLVAETEYRYDVEQVVLPFKKLLLGLFFMTVGMSIDTELLLSKLPVVAALSLSLMLLKSFIVCVLCRCFRFSLSAGLQAGLLLSQGGEFSFILFGLAAEKSVLSHDLAQVLMMATTVTMAFTPLLATLGNWISGFLTKNKVSYTSSALVLDTSDLDQHVIVVGFGRVGRLVAKVLMAEHVNYIASDIQPSVVTEGRKEGFPVYLGDLTKLEVLTAMGASRATAIAIAINNEVTAKKVIALVAKNFPDTIIAVRIPDLSNADMYKKLGAHYLIPETYEAGLQLGGIALSISGFSDNAILSLQNAFRMEDYQRPVKKESSDDVR

SEQ ID NO: 47344 - protein, 566 aa, Oryza sativa
  misc_feature (190)..(190): Xaa can be any naturally occurring amino acid
MEAGAADEETPLIQQLPPEEQCSQYTCDGTVNSDKKPALKQSTGHWRACFFILGAQFAETLCFFMVSKNLVMYLTSALHESNIDAAQSVSIWIGTSFFTPLIGAFLADTYWGRYWTTVISLFIIIIGMLIVTVSSSPLFLNSSYYNWNICRATVYTGLYLTAVGSGCMKPCIPAFGADQFDSADPVERLXKGSFFNWDYFSMNVGSLLSTTLLVWVVANIGWSVGFAIPMLLSGFGLALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKILLRMFPVWVSMVVFFVVTAQITSTLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNTSLWS

SEQ ID NO: 47345 - protein, 841 aa, Crocosphaera watsonii WH 8501
MRAVLMAGGSGTRLRPLTCDLPKPMVPILNRPIAEHIINLLRRNNITEIIATLYYLPDVMRDYFQDGREFGVEITYAVEDEQPLGTAGCVKNVEDLLQNTFLVISGDSITDFDLQAAIAFHRQKKSKATLVLTRVPNPMEFGVVITDQEQKISRFLEKPSSSEIFSDTVNTGTYILEPEVLEYLPLKQESDFSKDLFPLLLAKGEPMYGYIAEGYWCDVGHLDAYREAQYDALEKKVKLYFAYTEESPGIWLGQNTYIDPTARIEPPALIGDNCRIGSGVVIEQGCVIGDNVTIGAVSDLKRPIIWNGVTIGDESYLAACVIARGTRLDRRAQVLEGAIIGPLSIVGEEAQISSNVRVWPSKRIESGAILNINLIWGSTANRNLFGQRGVTGLANIDITPEFAVKLGAAYGSTLKAGSQVVVSRDQRGFSRMISRSLISGLMSVGIDIQNLEATAIPISRTMTPKLGVSGGVHLRAHPDRMDHILIEFFDDEGINISKSQEKKIEGAYFKEDLRRVGIADIGIMAYPAQIIETYRQTFETQLDLDSISNSEPKIVIDYAYGVSGAILPQLLTKFGCDAIVLNASLRQTSVPTEERESLLHQLGQVVEAVKANLGAQVSANGEQFILVDESGLPIRGEWLTALMVNTIFTAYPRSIVVVPVEASSAVEQIARRHDGRVIRTKSNPTALMEAAQANSNVSLGGSGDTGFIFPQLHPGFDAMFSLAKLLEMLATQGRSLVQIQAELPRICHKSYVLRCPWKIKGALMRYLVEIHHHEQLELIDGVKIINPQNDNWVLILPDAGDAFVHIVANSDDREWVDVTLREYRHKVQKFIEHEQDNLNSM

SEQ ID NO: 47346 - protein, 413 aa, Populus trichocarpa
MPGSLEPLDLTVQIPYHFRCPISLELMCDPVTVSTGQTYDRSSIESWVATGNTTCPVTRAPLTDFTLIPNHTLRRLIQDWCVANRAFGVERIPTPKQPAEPSLVRSLLNQAASASNPTHSRLSALRRLRGLARDSDKNRSVISSHNVREVLVNLVFSTSQSSDLSHESLAILVLFPLTEFDCVGISSEPERISYLANLLFHSSIEVRVNSAALIENVIAGTRSSDLRLQISNTEIIFEGVIEILKNPLSSPRALKIGIKALFALCLVKQTRHKAVTAGAAETLIDRLADFDKCDAERALATIELLCRIQVGCAAFAAHALTVPLLVKTILKISDRATEYAAGALLALCSASELSQKEAVCAGILTQLLLLVQSDCTDRAKRKAQMLLKLLRDAWPEDSVGNSDDFLCSEVVPF

SEQ ID NO: 47347 - protein, 197 aa, Pediococcus pentosaceus ATCC 25745
MNLVPTVIEQSSRGERAYDIYSRLLKDRIIMLSGPIDDDLANSIISQLLFLDAQDSEKDIYLYINSPGGVVTAGLAIYDTMNFIKSDVQTIVMGMAASMASVLASSGTKGKRFALPHSEVMIHQPSGGAQGQQTEIEIAAEQILKTRKELNTILAENSGQPLEKINIDTERDNYLSAQDAVEYGLIDGIMEKNANLK

SEQ ID NO: 47348 - protein, 342 aa, Frankia sp. CcI3
MRLAVIGGDGIGPEVVAEGLRVLRAVHPKVDTTEYDLGARRWHETGETLPDSVLEELRGHDAILLGAVGDPGVPSGVLERGLLLRLRFEFDHHVNLRPVRLYPGVRSPLAGDPAIDMIVVREGTEGPYAGAGGVLRKGTPHEVATEESLNTRYGVERVVRDAFRRADRRERRHLTLVHKNNVLTKAGDLWSRTVAEVAPEFPDVRVDYQHVDAASMFFVTDPGRFDVVVTDNMFGDILTDIGAAITGGIGLAASGNLDPSGVHPSMFEPVHGSAPDIAGRQLADPTATVASVAMLLDHLGHAEEAAKVEAAVASSLADRAAAGAAQPSTRERGEDLAARAAG

SEQ ID NO: 47349 - protein, 384 aa, Thermotoga maritima MSB8
MGKFLKKHYIMAPGPTPVPNDILTEGAKETIHHRTPQFVSIMEETLESAKYIFQTKHNVYAFASTGTGAMEAAVANLVSPGDKVIVVVAGKFGERWRELCQAYGADIVEIALEWGDAVTPEQIEEALNKNPDAKVVFTTYSETSTGTVIDLEGIARVTKEKDVVLVTDAVSALGAEPLKMDEWGVDLVVTGSQKGLMLPPGLALISLNDKAWGLVEKSRSPRYYFDLRAYRKSYPDNPYTPAVNMIYMLRKALQMIKEEGIENVWERHRILGDATRAAVKALGLELLSKRPGNVVTAVKVPEGIDGKQIPKIMRDKYGVTIAGGQAKLKGKIFRIAHLGYMSPFDTITAISALELTLKELGYEFELGVGVKAAEAVFAKEFIGE

SEQ ID NO: 47350 - protein, 323 aa, Rhodopirellula baltica SH 1
MTLHPQAQTFVALLRELQPPRWEDLGVAKARRGFSALVDNFGAGPAMASVEDQVVEEQNCDGQVSRIPVRIYRPDDVSELAPVVMFFHGGGWVLGDVESHDTTCRRLAAASRAAVVSVEYRRSPESPFPGPVHDCFVATKAVAKNGISWGLDASRLAVMGDSAGGNLAAAVALLAKDDPDVAVKYAVLVYPVVSPAFDSESYREFESGFGLTKRTMQWFWGNYFGRAGEDFFGVDRVSDADPLADLMKADFSDFPPAHVLVAGYDVLRDEGLALADKIEASGGDVTRENASDMLHGFIHFAGQFETGVTAMQSLGNRIANQLS

SEQ ID NO: 47351 - protein, 104 aa, Vitis vinifera
MVKLGYQLSRHTRHVMEAQTEGGSPPKPRVKATLNLGPETYSVNASKGTISEQLVSVKEESMGILKEFITKHNVPNDVPDEPLEASSEDEDEVPENPPVTKKRK

SEQ ID NO: 47352 - protein, 162 aa, Bordetella pertussis Tohama I
MNIPFRVGQGFDVHALVEGRPLIIGGVTIAHTHGLLGHSDADVLLHAVTDALLGGAGLGDIGRHFPDTDPAYRGADSRVLLRAAFDKVRAAGWAPVNVDATIHAQAPKIGPHAAAMVANIAADLALDAGAVNIKAKTNEGLGYLGRKEGIAANVVVLLARAG

SEQ ID NO: 47353 - protein, 412 aa, Escherichia coli O157:H7 EDL933
  misc_feature (385)..(385): Xaa can be any naturally occurring amino acid
MTNYRVESSSGRAARKMRLALMGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELIFSQPNLAQLGKGMVIPSLPTSEAVFLAAGVLGATIMPHVIYLHSSLTQHLHGGSRQQRYSATKWDVAIAMTIAGFVNLAMMATAAAAFHFSGHTGVADLDEAYLTLQPLLSHAAATVFGLSLVAAGLSSTVVGTLAGQVVMQGFIRFHIPLWVRRTVTMLPSFIVILMGLDPTRILVMSQVLLSFGIALALVPLLIFTSDSKLMGDLVNSKXVKQTGWVIVVLVVALNIWLLVGTALGL

SEQ ID NO: 47354 - protein, 339 aa, Bordetella pertussis Tohama I
MKRKTLTQYLVEQQRSAQALGPEVRLLIEVVARACKAISHAVSKGALGGVLGSLESENVQGEVQKKLDVLSNEILLEANEWGGHLAAMASEEMETIHLIPNRYPKGEYLLLFDPLDGSSNIDVNVSIGTIFSVLRAPHRVAGADVCEQDFLQPGSQQVAAGYAVYGPQTMLVLTIGNGVVGFTLDREMGSWVLTHESMRIPEDTKEFAINMSNMRHWAPPVKRYIDECLAGKTGPLGKDYNMRWIASMVADVHRILTRGGIFMYPWDAREPGKAGKLRLMYEANPMGLIVEQAGGAAIDGTGRILDIQPDKLHQRVSVILGSKNEVERVGRYHAEAHAS

SEQ ID NO: 47355 - protein, 95 aa, Glycine max
MNADSEGRTPLHWAVDRGHLNVTELLVGKNADVNAKDNDGQTPLHYAVTCEREAIAEYLVKHNADIYSKDNDGSSPRDICESNWPCMQHVGEEVN

SEQ ID NO: 47356 - protein, 205 aa, Oryza sativa
  misc_feature (133)..(133): Xaa can be any naturally occurring amino acid
  misc_feature (147)..(147): Xaa can be any naturally occurring amino acid
  misc_feature (152)..(152): Xaa can be any naturally occurring amino acid
MMVCGSVLHPDFQSSSQAHDFVGVKMQRAIQAIGSHGSLLKSAVLRHISAPKPSILPAVYSRSMSVSSAQIEESGFETATVADILKSKGKSADGSWLWCTTDDSVYDAVKSMTQHNVGALVAVKPGQDKSIAXGIATERDYLRKIIXVQGRXSSKPTKAWRIMTEEKHLNTVKPDTKPCKAMQLKKEKPISTIRDRRAGHGWMGF

SEQ ID NO: 47357 - protein, 150 aa, Oryza sativa
  misc_feature (124)..(124): Xaa can be any naturally occurring amino acid
MSAAAAADVVHSGGCHCGRVRWRAEAPASVVVWICNCSDCAMRGNAHFVVPASKFTLAAGAGESLTTYTFGTHTAKHTFCRVCGITSFYTPRSNPDGVAVTAACVDPGTLAHVEYRHADGRNWXEKWFSRSDISDFSKPKAPPPPPPSKT

SEQ ID NO: 47358 - protein, 440 aa, Solibacter usitatus Ellin6076
MADTGPELKRELGLRDVTLFAIACIVGTRWIPAAAHAGPGSVTLWLLAALMFMVPLAIAVAALSVKYPGTGGFYLWTRNDFGRWHGFLAFVVYWISIAFWFPSAAMFYMSAGAYALGPSYSYLANSRPFLLTVSLVAIWIALGTNIVGMKIGKWTQNVGALSTWVLGGLLVVVAALLWNRSGPATPMNFAPTWNWDTLNFWSTIAYAMSGIEMAALVGGEIRDPQRTLPRAGWIASGITVVFYAGTTIALLAMLRPERISELNGLAEAGAQAASTLRAGWLSPLIAVLVMASAVGQFGGLGTAVSRLPFAVGVDKMLPPAFGRVHPRWGTPHISILALGILASFLLVAIQLGDTMRVAYQELVSLMVILGFLPYLYIFGSAWKTGKRLGAVSGWAITLLAILCSVVPTAEVKNVWLFETKLAIGTVGVIATAWWLYRRRA

SEQ ID NO: 47359 - protein, 210 aa, Oryza sativa Japonica Group
MARFGAVIHRVFLPLLLLLVVLGACHVTPAAAAAGARLSALAKALVVEASPRAGQVLHAGEDAITVTWSLNATAAAAAAGADAGYKAVKVTLCYAPASQVGRGWRKAHDDLSKDKACQFKIAQQPYDGAGKFEYTVARDVPTASYYVRAYALDASGARVAYGETAPSASFAVAGITGVTASIEVAAGVLSAFSVAALAVFLVLENKKKNK

SEQ ID NO: 47360 - protein, 463 aa, Carboxydothermus hydrogenoformans Z-2901
MDLMLKRENIFSNTKDQNPIYLFNREYLDFLSGCKTERKVASYIVEEAQKRGFTNLEEALKEERTLKPGDKVYLFFKNKAVLLAVIGEKPLREGFNLVASHLDVPRLDLKPQPLYEKDGFVLLKTHYYGGIKKYQWVTRPLALWGTVVLKGGKVLDIKYGEDENEGVLTITDLLPHLAKDQMEKKIREAITGEDLNALTGNIPDQEAKENKIKTYILKLLHDRFGITEEDLITAELSLVPAGPAREVGLDRSMVGGFGQDDRVCVFTSLKAILEVEAPVKTAIALFMDREEIGSMGNTGMQSKFLENAILKLLVAQGEKDELMLRLSLENARALSADVTAAVDPTFEGVLEKNNAAQINYGIVLTKYTGSGGKYGTSEASAEFMREIIDLFNQEGIRWQTGELGKVDQGGGGTVAQFLANLGMEVLDAGVALLSMHSPFEVAGKADIYEAYRAYKAFLSGGKS

SEQ ID NO: 47361 - protein, 424 aa, Bacillus subtilis subsp. subtilis str. 168
MAIEQMTMPQLGESVTEGTISKWLVAPGDKVNKYDPIAEVMTDKVNAEVPSSFTGTITELVGEEGQTLQVGEMICKIETEGANPAEQKQEQPAASEAAENPVAKSAGAADQPNKKRYSPAVLRLAGEHGIDLDQVTGTGAGGRITRKDIQRLIETGGVQEQNPEELKTAAPAPKSASKPEPKEETSYPASAAGDKEIPVTGVRKAIASNMKRSKTEIPHAWTMMEVDVTNMVAYRNSIKDSFKKTEGFNLTFFAFFVKAVAQALKEFPQMNSMWAGDKIIQKKDINISIAVATEDSLFVPVIKNADEKTIKGIAKDITGLAKKVRDGKLTADDMQGGTFTVNNTGSFGSVQSMGIINYPQAAILQVESIVKRPVVMDNGMIAVRDMVNLCLSLDHRVLDGLVCGRFLGRVKQILESIDEKTSVY

SEQ ID NO: 47362 - protein, 340 aa, Pediococcus pentosaceus ATCC 25745
MTVKIGINGFGRIGRLAFRRIHELGAKSNDIEVVAINDLTSPALLAHLLKYDSTHGTFAGEVSATDNSIIVDGKEYRVYAEPKAQDIPWVKEDGVDFVLECTGFYTSKEKSQAHLDAGAKRVLVSAPAGSDLKTVVYNVNDDVLTADDRIVSAGSCTTNCLAPMAYFLNEEFGVQIGTMTTVHAYTSTQMLLDGPVRGGNFRAARAAAANTIPHSTGAAKAIGLVIPELNGKLQGHAQRVSVVDGSLTELVSILDKDVTVEEVNAAIKKHTEGNESFGWNEDEVVSSDIIGTTYGSIFDPTQTEVTKAGDKQLVKTVAWYDNEYGFTCQMVRTLLKFATL

SEQ ID NO: 47363 - protein, 400 aa, Pediococcus pentosaceus ATCC 25745
MAKLTVSDLDVKNKKVLMRVDFNVPVKNGVIGDDNRVVAALPTIKYIIENGGKAILFSHLGRIKTEEDKKELTLRPVAQRLSDLLGKPVTFVPVTRGAQLEDAVNGMNDGDVLLFENTRFEDLDGKKESKNDPELGKYWASLGDMFVNDAFGTAHRAHASNVGVAEAMKADGKQVAAGFLMEKEIKFLGEAVDEPKHPFVAILGGAKVSDKIGVIDHLLNKADKVIIGGGMTYTFYAAKGMSIGNSLVEADKIDVAKEILAKGGDKIVLPSDSIVAEKFDNDVPNKVVEGDIPDGYMALDIGPKSVAEFKDVLKDAKTVVWNGPMGVFEMSNYANGTLEVGKFLGTLSDATTIVGGGDSTAAVKQLGVGDQLTHISTGGGASLEYLEGKELPGIAAISNK

SEQ ID NO: 47364 - protein, 251 aa, Pediococcus pentosaceus ATCC 25745
MRTPIIAGNWKMNKNPQETQEFLDAIKGKLPDASVVESVIAAPAIDLSTLVAFSKDEQLKTAAENSYFEDEGAFTGETSPKALNEMGVNYVVIGHSERRQYFGETDEDINKKAKAIFNNNMTPIICCGETLEQREAGETNEWVAGQITNALKDLTAEQVAASVIAYEPIWAIGTGKTASSDQAQEVCHVIRETVAKLYDQTVADKVRIQYGGSVKPANIAELMGKEDIDGGLVGGASLDPESFLELVNYKG

SEQ ID NO: 47365 - protein, 440 aa, Pediococcus pentosaceus ATCC 25745
MSLITDIYAREVLDSRGNPTVEVEVYTEDGGFGRGIVPSGASTGEHEAVELRDGDKNRFSGKGVEKAVANVNGPISKEIVGFEVTDQIAIDKAMIKLDGTPNKGKLGANAILGVSLAVARAAADELQVPLYNYIGGSNAHVLPTPMMNVINGGAHSENKVDFQEFMIMPVGAPSVKEAIRMGSETFHALKSLLSADGKATSVGDEGGFAPDFANNEEPLQYLIKAIEKAGYKPGKDVAIAVDVAASELWNDEDKKYKLRWSTGEEFTTEEFVKYLEGLVNKYPIISIEDPIDENNWDDWASITKELGKKVQLVGDDFFVTNTEYLAKGIKMGAANAILIKVNQIGTLTETMESIEMAKEAGYTAIVSHRSGETEDTTIADLVVATNAGQIKTGSMSRTDRIAKYNQLMRIEDQLEGVAEYKGINSFYNLSADAREEISNK

SEQ ID NO: 47366 - protein, 174 aa, Frankia sp. CcI3
MTRHTLSVLVENKPGVLARVSGLFSRRGFNIESLAVGPTEQLDISRMTIVVVVEDLPLEQVTKQLNKLINVLKIVEMDTSASVQRELMLVKVRADLSVRSQVLETVALFRAKVVDVAQDAVTIEATGTRDKLDALIRMLEPFGIRELVQSGLVALGRGSRSITDRSLRAVDRPA

SEQ ID NO: 47367 - protein, 329 aa, Oryza sativa Japonica Group
MAEEAAAGGLYYCHMCASTVSAVAAAEGEVEIKCPYCHSGFVEEIESARGVATGGGGAISSVWAPIIDGMVGGGGGDAVRRHRRSRRLADAAGADDGYYRDLALLDFSESRRRTAALLLLMQEFRERQLQRLESATATISAAAAEAGAVVGTSRDAEGVALADYFLGPGLDALMQRVGDGDAGRQGTLPAKKEAVESMPTVEVAAGGDCDSACAVCLEDYAAGERATEMPCRHRFHAKCIVPWLKMHSSCPVCRFQLPTDDDDDSSKSARGGAAHSGGGRRLSQPAPRVDGGGLGRLPAVMQELRSILSQPSPASTSGSSSHAQQHSDE

SEQ ID NO: 47368 - protein, 79 aa, Brassica napus
QGFVSERLTMVNAIKGVFITCDIPMAQFIVNMNNSMPSSQKFIIHVLDSTHLFVQPHVEQMIRSAVAEFRDQNSYEKPS

SEQ ID NO: 47369 - protein, 426 aa, Sinorhizobium meliloti 1021
MGEFIIKMPDVGEGVAEAELVEWHVKPGDPVREDMVLAAVMTDKATVEIPSPVTGKVLWLGAEVGDTVAVKAPLVRIETAGEAGEAAPDSIPEALAEQVLDEPVAVSSRLEAKAPPQPEKPAPKPAPAPREAPDLSAKPLASPAVRLRARESGIDLRQVAGTGPAGRITHEDLDLFISRGAEPLPAQTGLVRKTAVEEVRMIGLRRRIAEKMSLSTSRIPHITYVEEVDMTALEDLRATMNRDRKPEQAKLTILPFLMRALVKTVAEQPGVNATFDDHAGVIHRHAAVHIGIATQTPAGLTVPVVRHAEARGIWDCAAELNRLADAARTGTATRDELTGSTITISSLGAIGGIASTPVINHPEVAIVGVNKIAVRPVWDGAQFVPRKIMNLSSSFDHRVIDGWDAAVFVQRLKTLLETPALIFVEG

SEQ ID NO: 47370 - protein, 3195 aa, Lyngbya majuscula
  misc_feature (1041)..(1041): Xaa can be any naturally occurring amino acid
MAELNLNRDLGTSNSEVVQLTELGNGVVQITMKDESSRNGFSPSIVEGLRHCFSVVAQNQQYKVVILTGYGNYFSSGASKEYLIRKTRGEVEVLDLSGLILDCEIPIIAAMQGHSFGGGLLLGLYADFVVFSQESVYATNFMKYGFTPVGATSLILREKLGSELAQEMIYTGENYRGKELAERGIPFPVVSRQDVLNYAQQLGQKIAKSPRLSLVALKQHLSADIKAKFPEAIKKELEIHQVTFNQPEIASRIQQEFGETVIPNLIQSTVEQKIPNPQPVQLRIPSYGLLKNLTWMPQERRKPKSTEVEVQIKAVPVNFREVLNVLGIFQEYIKKRYRSGIISAENLTFGVEGVGTVVAVGSDVSQWKVGDEVILAYPGNAFSSFVICSPDDLLAKPSDLSMVEAATIFMSFFTAYYGLHNLAKVQPGERVLIHAASGGAGQAAVQLAQFFGSEVFATTSPHKISVLREQGIKHVMNSRTTEFASEVRELTQGNGVDVIFNSLTHGEYIPKNIDILAPGGRYIEIGRLNIWSHEQVSQRRPDVKYFPFDMSDEFVRDKQFHAKLWDDLALLFESGSLKPLPYKVFPSEDVVEAFRHLQHSKHIGKIVVTMPELYNGVKNSSQQANQESMSHQEELLHQLQSGDISLENAEQLLLGLTDQQILATVPNNGQNKLINTDKTEQILSLLSSGEISLENAQNLLETVDLNSPTKKNLPTAVPNQGQSNQDEAILNQLQSGEVSLEDAEQLLLEIQQKESVTTKSIPDQRITDDIAIIGISCRYPGAKNWKEFWENLKHGVDSVTEPPPGRWEGRSWYHSDPEHPGTACSKYAAFLDDIDKFDPLFFQISPGEAELIEPQQRIFLEEAYHAIEDAGYAPDSLKGKHCGVFVGAASSDYIKFLSNSGFGHHRLVLSGTMLSVLPARIAYFLDLKGPVVAVEAACSSSLVAVHQACESIKRGESEIAIAGGISTMLTPDFQVLSSQFQMVSPEGRCKSFDAEASGIVWGEGCGAILLKRYEQAVQDQDHIYGIIKGTGTNYDGSTNGXSAPSSKSQARLAENIYQQFGINPETISYLEAHGTATPLGDPIEVEAFTEAFSKWTAQKQFCAIGSVKTNIGNAATAAGMSSLIKTILCLKNQKLVPSLHFNQPNPNIDFANSPFYVNTEFKAWEVPTGIPRRAAVNSFGLNGTNAHVVVEEAPIEDNRQTSPVSPQGGKATGNSEDYLENSVHLLTLSAKTETALGEVISSYQNYLKTNPNLRLGDVCYTASTGRTHFTHRLAVVAPNQQELVEKLRQHQEGKKLAGITSGELLNNTTVAKIAFLFTGQGSQYINMGKQLYQQAPTFRQAINQCEEILSSVETFQETSLRNILYPTDKNSSGSSLLGQTAYTQPALFAIEYALFKLWQSWGIEPDVVMGHSVGEYVAATVAGVFSLEDGLKLIAARGSLMQKLPGDGKMLWAMAPESKVLETLKAKDLSEKVAIAAINGPQSIVISGEGKAVEAIATNLESAGITTKPLKVSHAFHSPLMEPMLAEFEAAAKEITYEQPRIPLISNVTGKQVTEQITTAEYWVNHVRQPVQFAQSMKTLYQEGYELFLEIGPKPVLLSMGRQCLPEKIGVWLPSLRPGVEECQQMLSSLGKLYVEGAKVDWIAFEQNYARQKVALPTYPFQRERYWVSSQNGYEQKSYWLKGKEQHPLLGEKINLAGIEDQHRFQSYIGAESPGYLNHHQVFGKVLFPSTGYLEIAASAGKSLFTSQEQVVVSDVDILQSLVIPETEIKTVQTVVSFAENNSYKFEIFSPSEGENQQTPQWVLHAQGKIYTEPTRNSQAKIDLEKYQAECSQAIEIEEHYREYRSKGIDYGSSFQGIKQLWKGQGKALGEMAFPEELTAQLADYQLHPALLDAAFQIVSYAIPHTETDKIYLPVGVEKFKLYRQTISQVWAIAEIRQTNLTANIFLVDNQGTVLVELEGLRVKVTEPVLTQKSAFKEQLKSASVSERQELLTTQISSAIVNILGLRDGQQIERHQPLFDLGLDSLMAVELKNQLESNLGTSFSSTLLFDYPTVESLVEYLANNVIPIDSFSELPTLIPHPEQRYQPFPLNDIQQAYWIGRNQIFDLGNIATHIYIEVDCENLNLESLHQAWRRLIDHHDMLRMVVLADGNQQILEQVPPYEIEILNLSEESPETIASELEQIRNQMSHEVLPTNQWPLFHLRATRLNEQCFRLHASIDMLIFDAWSTYVLFKQWSELYNNPQSSLPATEISFRDYVLAELELKDSPQYLSSQQYWFNRLDNLPPAPEIPQAKVTSAITDPQFNTHTAQLSQSDWQQLKNKASKANLTPSGVLLSAFASVLNYWSKSSKFTLNLTLFNRLPLHPQVNELIGDFTSVILLEVDNSQAVPFISRAQKLQRQLWEDLEHRYISGVEVQRELYRRGRSQPMGVVFTSTLGLKSLADEEVGRGFGLEHFGEVVYSAAQTPQVLLDHIVTEEKGALAFSWHTVEGLFPEGLIEQMFEAYCDLLQQLATSDEPWMETYHQLLPTAQLALQAQVNQTTQSWSEDILHSLFVKQVQVQSEATAVISPQKSLTYGELYQRSHQLGHGLRKLGVKPNQLVAVVMEKGWEQVVAVLGILMSGGAYLPIDPGLPQERQWYLLEQAQVTQVLTQTHLKQSLGWPEGIKCWSVDTEELAEYDPNPLEPVQTSEDLAYVIYTSGSTGLPKGVMIDHRGAINTILDINQRFKVTPSDRVLALAALNFDLSVYDIFGVLGAGGAIVMPPPKAAKDPACWRELIIAHEVTLWNSVPALMQMLVEHLLGTSATAVGDLRVVMLSGDWLPVDLPSKIQSLWSNVQVMSLGGATEASIWSIGYPIEKVGSDWKSIPYGKPLLNQSFYVLNELMEPRPVWVPGQLYIGGVGLAKGYWKNEHKTQASFITHPVTQEPLYKTGDLGRYLPDGNIEFLGREDFQVKINGYRVELGEIEVALKQFPGIKEAIVTAIGESQQSKRLVAYAVFKEKSVISDSSLTDIHQTEDKNEVGQPDQEINCTSEQLRKYLWQKLPEYMVPDDYVILEALPLTANGKVDRKRLPKPQRQTIADTNQNILPQTKTEQQIAAVWTEVLELEEVGIHDNFFAIGGNSLLVIRVHNKLQELLGIELKVVDLFANPTVHFLSQHLTQIGSKELFMETSKTRGDERVKKGTTRKERRNIRKSLRGKK

SEQ ID NO: 47371 - protein, 464 aa, Sinorhizobium meliloti 1021
MKEISCKLLVLGAGPGGYVAAIRAGQLGVNTVIVEKAKAGGTCLNVGCIPSKALIHAADEYHRLRAAASGKGPLGLSLSAPAIDLRRTIAWKDGIVGRLNGGVTGLLKKAGVKAVIGEGRFVDGKTVDVETETGLQRIRAEAIVIATGSAPVELPDLPFGGSVISSTQALALTDVPQTLAVIGGGYIGLELGTAFAKLGSKVTVLEALDRILPQYDADLSKPVMKRLGELGVEVFTRTAAKRLSADRRGLLAEENGRAFEVPAEKVLVTVGRRPVTDGWGLEEIDLDHSGRFIRIDDQCRTSMRGVYAIGDVTGEPMLAHRAMAQGEMVAEIVAGHKRSWDKRCIPAVCFTDPEIVGAGLSPEEARAAGIDVKIGQFPFQANGRAMTTLSEDGFVRVIARADNHLVLGIQAVGHGVSELSATFALAIEMGARLEDIAGTIHAHPTQSEAFQEAALKTLGHALHI

SEQ ID NO: 47372 - protein, 2199 aa, Lyngbya majuscula
MLNKFTKKEQILSEKQQIKQLSPLQRAALALKKLETKLNNTLHEPIAIIGMSCRFPGGASSPEKFWQLLQGGSSARSQIPRERWNIEAYYDPDPDAPGKMLTCHGHFVDNVDQFDPEFFGISPREATAMDPQHRLLLEVSWEALEQGGQVLERLEEAAVGVFIGNDGRDYEQLLQQHLQQEPESPLVTYAGTGNALSNAAGRLAYTFGFTGPTVTIDTACSSSLVAIHQACNSLRLGECQMALAGGVKLHLTPNSYIDASKARMICADGQCKTFDISADGFGRGEGCGMVLLKRLSDAQADGDQIVAVIRGSAVNQDGPSSGLTVPNGQSQQRLIKQALAQAQVKPSEISYLEAHGTGTSLGDPIEVNAVVAVLGEDRTPEYPLWMASVKTNIGHLEAAAGVSGLIKVVLSLQHRLLPAHLNLHQPNPKIDWQPWLQVPKQLTPWEVSGHRLAGVSSFGFTGTNAHVVIEEAPSSQKSPQVERERPWNILALSAKNQEALLQLVQSYSQHLERAPEQELVDICFTANTGRLSYIHRLSLVAATKAELQERLKAFGTEEEVTGLVSGVVSGGESPKVAMLFTGQGSQYVGMGRQLYETQPTFRKALEQCAEILQPYLDRHLLEVLYSLEAEESVLEQTAYTQPALFALEYALFQLWQSWGIKPDVVMGHSVGEYVAATVAGVWSLEDGLKLIAARGRLMQQLPSGGEMFSVMASESKVRETLKEMALGEQVAIAAINGPQSIVISGESEAVRAIATNLESETIKTKQLQVSHAFHSPLMEPMLVEWEALANQIAYNQPKIPIISNVTGTTADSSITTAQYWVNHVRQPVRFAQSMEALDKLGSEVFLEVGPKPILLGMGRQCLPEGVGVWLPSLRPGVDAWQQMLLSLGQLYVQGVKVDWLGFDRDYARQKVTLPTYPFQRERYWVEAPKTVVLSGQQVHRLLGNKLELASTGQTIYHQDINLNNHPWIGDHRVYDTPVIPGVSYIAMTLAAVGVPAAVEDINFQQPLFLAESNTTRETQLMLHTADNVGKQFVEVFSRDGAKQEEWQQHASMSVSENPPPPPTLSVDIPALCEQLRPLDTDTLTEIYASISLVYGPMLQAVRQAWIGEETSLLEIEVPKALAFQLAGEPIHPVLIDACTRLTPDLFDFSSDSGVFWAPWRVKEMTLSHPTPSRFYAYVEEPSRVNEQLQTRSYDIQLLDETGQAFGRINGFTVKRAPSQLFLKSLQPDVSNWLYQLQWQPSEVKETVPLATSRMWLLFVPEGVWAEQLTSSLAQLDQQYVVVSPGDDFRYLSEYHYQVCPTQKESFQQLLQKIVEKGVTLQGVVHLWSLLSDSQQLNQAQELVCGSTLHLIQALGEVFDSQVPPLWLVTQGAQCIAAQTTIHVQQSPLWGLGRVIALEHPEFKCHRVDLDPDNASIAEGVEMLLQELLAPDAEDQVAYRQGERHVARLERFVPQSSGEYPQQLRLRAYGTLDNLVLQPQQRRQPERGEVEIQVRAVGLNFRDVLTALGMMQEYTQHLFDSAEQVVFGGECAGVVVAVGSDVEHLQVGDEVVLALAIGCLAHYMTIPADLALPKPQHLSFEAAATLPTAFITAHYGLNYLANLQPGERVLIHSAAGGVGQAAVQLVQNRGAEVFATASPPKWKFLQQQGVEQIMNSRTLEFAEQVQAATEDMGVDVVLNSFNEEYIPQSFQALAHGGRFIEIGKINIWSQSKAQEYRPDVKYEVFDLVEMVREQPELVAQLWSELGTELKTGKLQPLPHQVFELGQVHEAFRYLQQAKHIGKVVVAIPPLREQKKEIQAQGSYLVTGGLGALGLEVSKWLVDKGARHLVLMGRRSPSAEAQIKIAQLEDMGVKVSVQLADVSCSQQVSQMMERIERELPSLRGVIHAAGVLDDGVLQNMSWQQFVKVMLPKVQGTWHLHQLTKDLPLDFFVCFSSMSSLLGNLGQGNYAAANEFMDAVAHYRRSMGLPGLSINWGAWASSGMAASLAGQHQQRLETIGIRAIEPQQGMQALGSLLSQTPSQVGVLPINWSKFVSTLPGGQKMPFLEALISTEPSLTQKSAFREQLEAAAVSERQELLTNHIRSAIAKALGWRDGQKIGMRQPLFDLGLDSLMAVELKNRLESSLETNLSSTLLFDYPTVEALVEYLANDVIPIEFSSNLDEIENLEQEEIDNTFRFQEMSEDEMANILARKLESLEGKKS

SEQ ID NO: 47373 - protein, 346 aa, Vibrio vulnificus CMCP6
MLKVAINGFGRIGRNVLRAVYESGKHQQIKVVAVNELAQPEAMAHLLQYDTSHGRFGKRISHDQEHLYVHHDACPQGKGEFDSIRILHLSEINLLPWRDLEVDLVLDCTGVFGCQADGLEHIKAGAKKVLFSHPGASDLDNTIIYGVNHETLKAEHNVVSNGSCTTNCIVPIIKVLDEAFGIESGTITTIHSSMNDQQVIDAYHSDLRRTRAASQSIIPVDTKLHKGIERIFPKFSNKFEAISVRVPTVNVTAMDLSVTINTNVKVNDVNQTIVNASQCTLRGIVDYTEAPLVSIDFNHDPHSAIVDGSQTRVSNGHLVKMLVWCDNEWGFANRMLDTALAMQAAQ

SEQ ID NO: 47374 - protein, 503 aa, Ostreococcus tauri
MSVRARASSSNASAASEVARALGLRRDDLLLDVVREREASTSGTMSVEVTNPATGTTLARCRATSANDVEHILRRSKESQERWANEYTAHARAKIVRRWFELVEANAEDLARVCTAESGKPLAESRAEVAYAASFLEWFADEGRRVYGDVVPSSSTGSRIMAIKQPVGVTAAITPWNFPLAMITRKAGAALAAGCSMVVKPSEETPLSAFALGALAKEAGCPDGVLQFVVGDPVVIGELLCASPIVRKITFTGSTRVGKLLMKQSSDTVKRVSMELGGNAPFIVCADADVDAAVRGAMASKFRNSGQTCVCAQRFIVHESVEDDFVRKLTAAANALKLGNGLEDESVTQGPLINAAQVERVDAHVRDALSKGAVCHSGGKRADGTFYEPTVLSKCTDDMLVMQEETFGPVAAITTFVSDDDALRMANSTNAGLASYVFTSDLKRSYTFSEKLEFGIVGVNTGVISTAQAPFGGVKESGVGREGGKYGMEEYVETKYVCVGGLD

SEQ ID NO: 47375 - protein, 2232 aa, Lyngbya majuscula
MELSSQTTQLSNQQLLLLKIQQATAKLHEIETAATEPIAVIGIGCRFPGGVDSPETYWKLLQEARDLRTEIPKDRWDVDLYYDSDPDVPNKIYVRQGYFLQQPVDQFEPEFFGISGTEAANMDASQRLLLEVTWEALENAGISPKSLKNTDTGVYVGQMTNDYAVIGTNRPDKLPDFYLGIGSNMGMSAGRIAYILGLQGPTLFLDTSCSSSLVALHLACQSLRSRESNLSLVGGVNLMLAPNTTHVLCKGKALSPDSRCKTFDASADGFARGEGCGIVVLKRLRDALADSDRILALVKGSAINHDGPSSGFTVPNQQAQKKVIHQALNNAKVNPLQISYVECHGTGTSLGDPLEVRALDEVYCQQRTKEQLLFLGAVKSNIGHLEAAAGIAALIKVVLALQHQEIPANLHFNQPNPRINWEQIPVKVPTKAFPWLKGEKPRLAGISGFGMSGTNAHVILEEAPIPVKSKSSRATGGQKQVLKDSKGAKLKREEYLERSLHLLTLSAKTQTALDELVSSYENYLKAHPELGVADICYTANTGRTHFNHKLAVVASNQQELVDKLRQQQEGEEVVGIYSGDLPNNSTVPEIALLFTGQGSQYVNMGRQLYQQAPTFREAINQCEEILSSLETFPNKLLQEILYPADDLSDSSLLDQTAYTQPALFAIEYALFKLWQSWGIKPDVVMGHSVGEYVAATVAGVFSLEAGLKLIAARGSLMQKLPAGGAMVSVMASKSKVLETLKAMSRSEKVAIAAINGPQSIVISGEAEAVEAIATHLESVGIKTKQLQVSHAFHSPLMEPMLAEFEDIANQLTYNQPRIPLISNVTGTKADNNIVTGKYWVNHVRQPVQFVQSMKTLHQEGYELFLEIGPKPILLGMGRQCLPEEMGVWLPSLRPGVDEWQQMLSSLGQLYVQGAKVDWFKFDQNYNREKVILPTYPFQRERYWVETQNGYQPKPYGSTAKNLHPLLGEKLNLARIENQHHFQSYLTAESPAYLSQHQVFNKVLFPATGYLEIAAAVGKNLLTTGEQVVVSDVTIVRGLVIPETDIKTVQTVISTLENNSYKLEIFSTSEGDNQQANQWTLHAEGKIFLDSTTNTKAKIDLEQYQRECSQVIDIQQHYQQFKSRGIDYGNSFQGIKQLWKGQGKALGKIALPEEIAGQATDYQLHPALLDAALQILGHAIGNTETDDKAYLPVGIDKLKQYRQTITQVWAIVEIPENTLKGSIKLVDNQGSLLAEIEGLRVTATTADALLKSLQPDISHWFYQINWQTQPLPSTTPSSATDKWLVFAQDTQLVEALQRKSHESIRVSPGDTYKKLTQQHYQINPTSREQFQQLLAENSGITRIVYLWGVQESESKDNLEIQTVQEQSCATVLHLVQAIINSKPETIPKLWLVTRGTQRVISDSEVINPEYGSLWGLGRVIAQEHPELGCKRLDCDPNLEQTQILDSLVAELLSEDVEDQIAIRQGSRYVARLVQKPQQKPITSADQPVQLKLSEYGVIDNLNWQPMQRKTPLANEVEIEVAAVGLNFRDVLNALGLLKDYYAEHFNITSAEQLTFGFECAGKISAVGEQVSQWQVGDEVIGLLLHDGLSSFITTSVEYVVAKPKQMSFSEAATLPLTFLTAQYGLQHLAKIQPGERVLIHAAAGGVGQAAVQIAQVAGAEIFATASPSKWEFLQSLGIKHIMNSRTLDFAEEIMKRTAGEGVDVVLNSLNGEYIPQSLAVLTPKGRFVEIGKIGIWEKEQVKEKRPDVSYFPFDLQEAVQQQPGLIGQLSEELTQQWNQGKLKALPHKVFPSTEITAAFRYMQQAKHVGKVVVSMPEAQSEPKSITADASYLITGGLGALGLEVAQWMVTQGARNIVLTGRRAPKETAQKIIEELETAGASVSVLLGDVSQREDLAKIFQQIQASLPPLKGVIHSAGVLDDALVQNMSWSQFTKVMAPKVQGTWYLHQLTKDFPLDFFVCFSSIASMLGSPGQSNYAAGNGFMDALAHYRRSMGLPGLSINWGAWASAGMAASLAVQNQQRMESMGLSAIEPERGMQALGSLLSESQSQVGVFPVNWSQFIRQFPGGQKIPFLSDFISQTPSLTQKSAFREELEAALVSDRHELLTTHLRLAIAKTLGWKDTQKIGMRQPLFDLGLDSLTAVELKNRLESSLGTSLSSTLLFDYPTVEALVEYLANDVMPIDFSSHLDQTEKALDEEDVVADGSSQLSDITELSEIELEASVLQEIEALEKLI

SEQ ID NO: 47376 - protein, 215 aa, Zea mays
PTAQICALLSLSPCLLDATAATAWAPPPASDAANRSTSRHLHNAVGRASSLRRTGELRRSQVRLGTLVPLTKDNAGSSNGSVSSIPIFQGPNVVGRDHLVVVDKRISRKHLSLHASTDGSIEVVVEGPNPIIVRSKGQRRKVCAKETAKIAHGDVLELIPGDYFVKYVDMGDEHVPMHLSDLMKGKRYSEEHGAAVKRIRQIMEDEALAKTLQVS

SEQ ID NO: 47377 - protein, 223 aa, Ustilago maydis 521
MFARSAIPTLRAASVRAFSTQTASTGTASARRYMGAAALAAGGALTYSAFAAPTVHLEGPKTIAGELGTSTERSYVMIKPDGVSRQIVGEIISRFEKRGYQLVALKTVIPSAELAKEHYIDLAKKPFYGGLVKYITSGTPVVAMVWQGKDVIRQGRRLVGATNPLDAAPGSIRGDFCVSVGRNIIHASDSHESATKEIGLWFHEKELATEYKPIAWDMIMADN

SEQ ID NO: 47378 - protein, 507 aa, Ostreococcus tauri
MTARERESAASTASRDEFFATASWTANESQRYELLEVIGKGSYGVVCAAIDRESGQKVAIKKVRNAFDHASDATRILREVTLLRHLKHPDIVEVLNIMLPPNPREFNEVFIVFELMGTDLHQVIKANDDLTDEHHQFFLYQLLRGLKYMHSANVFHRDLKPKNILANSDCKLKICDFGLARAMTAKTGPQMIFWTDYVATRWYRAPELCGSFFTKYTPAIDIWGVGCIFAELLRGRPLFPGKNVVKQLELITDLLGTPTPLQIAKVRNEKARRFLQQMRIKPATPLSEKFPGVDSKALNLLEKLLAFDPDDRPTAAQALADPYFEGLADVSREPSRHPLPKSVFAWDQRKLSREEVRELLYEEILHYHPQAKREYDGSEKKSGFDYPSGIADMSRKFDSLEQGGPEAKFQTSKSLPKHAVGEYRDKAAQFAGGIDALSRSDSVKPGGSPGLARMDSDDVEYEEPQTDDVDRFDLAEVVQAMSLDAEDARALKMEAEALLEEGGEIAG

SEQ ID NO: 47379 - protein, 454 aa, Escherichia coli K12
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGGRGQGGGRGQQQPRRGEGGAKSASAKPAEKPSRRLGDAKPAGEQQRRRRPRKPAAAQ

SEQ ID NO: 47380 - protein, 224 aa, Triticum aestivum
  misc_feature (168)..(168): Xaa can be any naturally occurring amino acid
MEIYSGAALSRPSERDDMASASSLFLASPTTAPRTRTPSSPCPDRPSLRPRRTTLAVAVEHHVEHQSAAPLVLKRGGFPHRVEHIFDLQRREPRLPIIIDGISIPHDRGCHAHADEEFMLHCVVHASRDALGLPDIGQIYPDNEPRSKDADSWMYMREAVKIMNKAGXSWGTTNATMSLKKPKINPIKETIRSNWCEGRGGEPPVANIKAKTHEKFDSQGKNRI

SEQ ID NO: 47381 - protein, 232 aa, Thermotoga maritima MSB8
MDNVEKKTGFKDIVTEIDREAQRMIVDEIRKFFPDENIMAEEGIFEKGDRLWIIDPIDGTINFVHGLPNFSISLAYVENGEVKLGVVHAPALNETLYAEEGSGAFFNGERIRVSENASLEECVGSTGSYVDFTGKFIERMEKRTRRIRILGSAALNAAYVGAGRVDFFVTWRINPWDIAAGLIIVKEAGGMVTDFSGKEANAFSKNFIFSNGLIHDEVVKVVNEVVEEIGGK

SEQ ID NO: 47382 - protein, 266 aa, Brassica napus
VGCIIMPHNVFLHSALVQSREVDKRQKHRVQEAINYYTIESTIALAVSFMINLFVTTVFAKGFYNTDLADSIGLVNAGQYLQDKYGGGVFPILYIWGIGLLAAGQSSTITGTYAGQFIMGGFLNFKMKKWLRALITRSCAIVPTIIVALVFDSSEATLDVLNEWLNVLQSIQIPFALIPLLCLVSQEQIMGSFKIGPLYQTVAWLVAALVIMINGYLLLEFFTSEVSGVVYTGFVSVFTASYGAFIVYLIARGINFTPWRSKAESS

SEQ ID NO: 47383 - protein, 708 aa, Photobacterium sp. SKA34
MTQSAFSLSYSDNGVAWLKIDVPNEKMNTLQAEFSEQITSVLAELKARSDIKGLVVHSGKPDNFVAGADIRMLSACETAQEAQALAKKGQILFSQLEQLPFHVVAAIHGPCLGGGLELALACHSRVCSDGDKTRLGLPEVQLGLLPGSGGTQRLPRLIGVANALDMILSGKQLRAKKAVKLGVIDQVVPESILLNVAEQMALSPKPSRKSSMQNWALGGNPLGRSVVFDQAAKKAYEKTRGNYPAVDAILEVVKYGLQHGMEKGLEQEAKVFGELVMSPESAALRSIFFATTAMKKETGSEAEPLTVERVAVLGGGLMGGGISHVTATKAGYPVRIKDISNDGIQNALAYNFKLLEKKRKRKIISKATLQKQMLTMTGGTDFTGFNQADVVIEAVFEDLALKHQMVKDVEEHAKPTTIFATNTSSLPINQIAQAAEHPENVVGLHYFSPVEKMPLVEVIPHQGTETGSGTSEETIATVVALAKKQGKTPIVVGDKAGFYVNRILAPYMNEAARVLLSGEPIEHIDTALLNFGFPVGPITLLDEVGVDVGAKISPILLAELGDRFEAPDVFDLLLKDDRKGRKSGKGFYRYNTKKKEVDKSVYKLLELEPKIKESETEIAVRCSLMMLNEAARCLDEGVIRSARDGDIGAIFGIGFPPFLGGPFRYMDHIGITRVVDMLNEYTDKYGDRFKPCERLLEMVQGNLKFYND

SEQ ID NO: 47384 - protein, 238 aa, Oryza sativa
MSSTNSSGDPAAVRVVGGWASPFMNRVVVALKLKGVEHEMLQETVGKKSELLLRSNPVHKKIPVLLHHGKPIAESLIIYIDEVWPASNGAPSILPRDPYGRAVERFWAKYIDDKIPPGIRVLRGSVEEDKDKAAGEMSTALQHLEEAFVKCSQGKQYFGGDNIGYLDIALGSFLGWIRAVEKIAGVELLNETKVPNLAAWADRFCAHPAVVDVVPDADRLVEFTVQHAALLRAVNVPK

SEQ ID NO: 47385 - protein, 323 aa, Escherichia coli O157:H7 EDL933
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 47386 - protein, 575 aa, Escherichia coli O157:H7 EDL933
MISGILASPGIAFGKALLLKEDEIVIDRKKISADQVDQEVERFLSGRAKASAQLETIKTKAGETFGEEKEAIFEGHIMLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAIRIAMDRKEILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 47387 - protein, 457 aa, Bacillus subtilis subsp. subtilis str. 168
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTISPASNAF

SEQ ID NO: 47388 - protein, 371 aa, Streptococcus pyogenes M1 GAS
MALTAGIVGLPNVGKSTLFNAITKAGAEAANYPFATIDPNVGMVEVPDERLQKLTELITPKKTVPTTFEFTDIAGIVKGASRGEGLGNKFLANIREIDAIVHVVRAFDDENVMREQGREDAFVDPIADIDTINLELILADLESINKRYARVEKMARTQKDKESVAEFNVLQKIKPVLEDGKSARTIEFTEDEAKVVKGLFLLTTKPVLYVANVDEDKVANPDGIDYVKQIRDFAATENAEVVVISARAEEEISELDDEDKEEFLEAIGLTESGVDKLTRAAYHLLGLGTYFTAGEKEVRAWTFKRGIKAPQAAGIIHSDFERGFIRAVTMSYDDLMTYGSEKAVKEAGRLREEGKEYVVQDGDIMEFRFNV

SEQ ID NO: 47389 - protein, 403 aa, Halobacillus dabanensis
MHGFHDVFIQILLLLAISVSVIAIAKLLKEPDSIALVLVGLVLGLTELPIIEDAERYITQSEVFQATIISLFLPILLGDATLKLPFHHLFSQKKTVLGLAFVGTFVSSICIGTAAYFLLDLPLAVAFTFAALMSATDPISVLSIFKSLGVPQKMSTVMEGESLFNDGIAVVLFKIASIYLLTYMEMGWAGLGSGVFLFLKFAIGGALVGLVLGYFFSQVIRVFDDYPLEVAFSALLFFGSYFIAEHFHTSGVIAVVVGGFVFGDYGAKIGMSKETKTNINTFWDSVTLIANALIFLMVGLEIRNIDLAGNWGVIVGAILIVLVGRTIAVYLGTGWVQELSSKERLLINWGGLRGSLSVALALSLPMDFAGRDQVLLLTFSVVLFSLIVQGLTLKPLIKKLGMI

SEQ ID NO: 47390 - protein, 125 aa, Glycine max
  misc_feature (122)..(122): Xaa can be any naturally occurring amino acid
MAGRLTAMGSRIMGGHGAAARAAASALRNRAGMGLPAGRHIVPDKPLPVNDELVWDNGTPFPEPCVDRLAPHIGKYEALAWLCGGLSFFAALGLAAVVNDKASKMPYTPKVYPFDNLRAELXDRS

SEQ ID NO: 47391 - protein, 242 aa, Zea mays
  misc_feature (30)..(30): Xaa can be any naturally occurring amino acid
MAGDGELKLLGMWASPFVLRARLALSFKGXLKYEYVEEEIFGNKSELLLESNPVHKKVPVLIHNGKAICESQIIVQYISEVYDGTGPSLLPVGAYDRAVARFWAAYVDEKVFSSFMMMIMGKTDDEKAEGRKQLFAAAETLEGALKECSCSKGRPRPFFGGDSVGYVDIALGGFVAWVQTRDLLSGLEHFDADKTPLLATWLERFCALNETKAVMPDVMKLLEFSKKRQAQADAAAAAVVLR

SEQ ID NO: 47392 - protein, 291 aa, Carboxydothermus hydrogenoformans Z-2901
MKIKKAIIPAAGLGVRFLPATKAQPKEMLPIVDKPTIQYIVEEAVASGIEDILIVTGKNKRAIEDHFDKSPELEMYLEKRGKEDLLEIVRSIGNMVDIHYVRQKEPLGLGHAIYCARKFIGNEPFAVLLGDDLMKARTPVLKQMIDLYEKVEASIVAVQAVEPREVSKYGIIKAEEVGERLYRVYDLVEKPKPEEAPSNLAVMGRYIIEPEIFEFLEKTPPGAGGEIQLTDALRMLCQVKPIYGYVYEGLRYDVGDKLGFLKATVEFALDREELAQGFKAYLKELVEKEIK

SEQ ID NO: 47393 - protein, 303 aa, Nostoc punctiforme PCC 73102
MARITTPFGRHSTASEVAQGIDLSGKRAIVTGAASGIGVETARALAHAGAEVTLAVHNVDAGAKTAADITAITGNQNIHVAKLDLTDRGAIAKFIAAWNEPLHILVNNAGVMALPEQHTPEGWEMQFATNHLGHFALTLGLHDALAADGAARIVSVSSSAHMLSPIVFDDIHFAFRPYDPWLAYGQSKTANVLFAVAGTGRWFRDGITANALMPGAIATNLQRHVGGIQTPAELQKTPEQGAATSILLATSPLVEGIGGRYFEDCNEATIVTQQTKDYSGVAPYALNTNNADRLWEESLRLLA

SEQ ID NO: 47394 - protein, 386 aa, Vibrio vulnificus CMCP6
MSVIKMTDLDLAGKRVFIRADLNVPVKDGKVTSDARIIASLPTIKLCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMFAEVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIANAKTILWNGPVGVFEFKNFEAGTKGISEAIAQSPAFSVAGGGDTLAAIDKFGIKADVSYISTGGGAFLEFVEGKVLPAVEMLEARAK

SEQ ID NO: 47395 - protein, 372 aa, Ustilago maydis 521
MFRLRAAEPSSFPVGSYRTSVSQSGSSTDECLKPWWPSQGSRDLARREVWLGVRLGGGTLVVTESRTLTEPIHDCTASVRVTIRTHDRGSTSVLVNGLHRQRSTLKTCDWHPKANSFCCQGAYTRTWTTSSKARAHPPPRSTSFYLQGRLIVPRRLTHTVCSLALYDHSPNSLMSDYEITLINDSMQEFYVRFHGPQESRYSSAPPSHHIGFLSSPHIKFSLLLNRLAPFAGGVWKIHVELPDQYPYKSPSIGFMNKIFHPNIDELSGSVCLDVINQTWSPMFDCINIFEVFLPQLLRYPNPTDPLNGEAAALLMREPKTYEARVKDYVQRFATREAANAAGQDEDEDEEEEDEMSDVGSFSDHEPMGDMEM

SEQ ID NO: 47396 - protein, 220 aa, Vibrio vulnificus CMCP6
MSMTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINGIPGVVTVGLFAHRGADVVITGTPEGAKIEE

SEQ ID NO: 47397 - protein, 482 aa, Solanum chacoense
MEVEVEAAAAAAEREATNSVICQLADPEGNPLGAALYLPENASPKELNQVVNKLLSNEEKLPYAFYISDEELVVQLGSYLEKNKVSVEKVLTIVYQPQAVFRIRPVTRCSATIAGHTEAVLSVAFSPDGRQLASGSGDTTVRLWDLNTQTPLFTCQGHRNWVLSVAWSPDGKHLVSGSKAGELICWDLQTGKPLGNPLTGHKKWITGISWEPVHLSAPCRRFVSASKDGDARIWDVTTRKCLICLTGHTLAITCVKWGGDGVIYTGSQDCTIKVWETTQGKLIRELKGHGHWVNSLALSTEYVLRSGAFDHTNKHFASPEEMKKVALERYNKMRGNAPERLVSGSDDFTMFLWEPAVSKHPKTRMTGHQQLVNHVYFSPDGQWIASASFDKSVKLWNGTTGKFVAAFRGHVGPVYQISWSADSRLLLSGSKDSTLKVWDIRTKKLKQDLPGHADEVFAVDWSPDGEKVASGGKDRVLKLWMG

SEQ ID NO: 47398 - protein, 153 aa, Streptococcus pneumoniae
EHFIRGQYRSGKIDGMKYISYRSEPNVNPESTTETFTSGAFFVDSDRFRGVPFFFRTGKRLTEKGTHVNIVFKQMYSIFGEPLAPNILTIYIQPTEGFSLSLNGKQVGEEFNLAPNSLDYRTDATATGASPEPYEKLIYDVLNNNSTNFSHWD

SEQ ID NO: 47399 - protein, 646 aa, Oryza sativa
MAKSNASRASATRRKFYFLQKSLLVSSLLAVVAADVVGAGPNQQCFPSSCGDLGNISYPFRLASDSRPCVGTLRPWYNLSCSSGRATIQINTRTYYVTSINYTGEIFSVVDATLQDDDTNGTSCPLPRSDHLPYIDYWPPYLGESSTDSYGFVYLATASDTWACFVNCSRARTDTMPWYRPVTCLLPNNSFVFVSFDDCAVGELQPSCRYLAMIPVDRWNLPDNSSQLQNASYTDIIGFIRKGFSVRFPYRPDQYQSPRMSARECLKDSNRLVLGSLVVFIFLAHKYWKTRITIDAVEKFLRMQQMIGPTRFAYTDIIAITSHFRDKLGQGGYGSVYKGVLLPGNVHIAVKMLTGSSSCNGDEFISEVSTIGRIHHVNVVRLVGFCSEEMRRALVYEYMPRGSLDKYIFSSEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSSQAYYPSRVYRELTRRETSEISDIADMHELEKKLCIVGLWCIQMRSCDRPTMSEVIEMLEGGSDELQVPPRPFFCDDEQFPGVESYNMPSDLTAISEEHEDDDDESICLFESYQ

SEQ ID NO: 47400 - protein, 153 aa, Streptococcus pneumoniae
EHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLTPNSLDYRTDATATGASPEPYEKLIYDVLNNNSTNFSHWD

SEQ ID NO: 47401 - protein, 303 aa, Escherichia coli O157:H7 EDL933
MSTLEQTIGNTPLVKLQRMGPNNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMADRGEGKLLDQFNNPDNPYAHYTTTGPEIWQQTGGRITYFVSSMGTTGTITGVSRFMREQSKPVTIVGLQPEEGSSIPGIRRWPAEYLPGIFNASLVDEVLDIHQRDAENTMRELAVREGIFCGVSSGGAVAGALRVAKANPGAVVVAIICDRGDRYLSTGVFGEEHFSQGAGI

SEQ ID NO: 47402 - protein, 645 aa, Lotus japonicus
MGTIGNNSHEGDHHGVNFTAQRGFYTKLKSGLKETFFPDDPFRQIKEEENRSRRIIKGVQYYVPIFEWLPNYTLRLFISDFISGLTITSLAIPQGISYAKLANLPPIVGLYSSFVPPLVYAIFGSSRHMAVGTLAAASLLIGQTISTVASPETDPTLYLHLIFTTTFVTGVFQACLGIFRLGILVDFFSHSTITGFMGGTAFILIAQQLKGFFGMKHFSTKTNLVEVAKSIITNRHEIRWETTVLGLVFLAFLQFTRHVRNKRPKLFWVSAIAPMTVVIVGSIFVYLVHGQKHGIPIVGHLDRGLNPWSIQYFNFDSKYLPAVMQAALITGVLSLAEGIAIGRSFSVTDNTPHDGNKEMVAFGLMNLFGSFTSCYLTSGPFSKTAVNYNAGGKTAMTNVVQAVLMALTLQFLAPLFGFTPLVALSAIITSAMLGLVNYTEVIYLYKVDKFDFVICMAAFLGVAFLGMDYGLMISVGLGVIRALLYVARPATCKLGKLNEFGIYRDVEQYPASTFPGLIIVQLGSPVYFSNSVYVKERVMRYIKSQQRSNEDVVEQVILDMSGVTSIDTTAIEGLLELNKMLEKNGIEMFLVNPRLEVMEKLIISKFVDKLGKESFYLTLDDAVKASQYSLKKNDNGDIVHETSHA

SEQ ID NO: 47403 - protein, 457 aa, Silicibacter sp. TM1040
MLKNDQLDQWDRDNFFHPSTHLAQHARGESANRVIKTASGVFIEDRDGTKLLDAFAGLYCVNVGYGRQEIAEAIADQARELAYYHSYVGHGTEASITLAKMILDRAPKNMSKVYFGLGGSDANETNVKLIWYYNNILGRPEKKKIISRWRGYHGSGLVTGSLTGLELFHKKFDLPVEQVIHTEAPYYFRREDLNQTEEQFVAHCVAELEALIEREGADTIAAFIGEPILGTGGIVPPPAGYWEAIQTVLNKHDILLVADEVVTGFGRLGTMFGSDHYGLEPDIITIAKGLTSAYAPLSGSIVSDKVWKVLEQGTDENGPIGHGWTYSAHPIGAAAGVANLKLLDELNLVSNAGEVGAYLNATMAEALSQHANVGDVRGEGLLCAVEFVKDRDSRTFFDAADKIGPQISAKLLEQDKIIARAMPQGDILGFAPPFCLTRAEADQVVEGTLRAVKAVLG

SEQ ID NO: 47404 - protein, 491 aa, Silicibacter sp. TM1040
MSLSALSARAEISDKALVRSFSYINGKWCASSNGEVVAVHDPATGDFIGDVTAMTAEDSSAAVDAAHAAFTSWALMLPQDRCALLRRWFELMIEHKEDLARLMVLEQGKPLSEARGEIDYGAAFVEFYAEESKRPNIEGVTSHLPDAEVELWREPVGVAALITPWNFPSAMLTRKAAAALAAGCTVVAHPSAETPFSALALAELAERAGIPKGVFNVITGKAPVVVEPWTRDARVRALSFTGSTEVGKLLYRQSAETVKRLVMELGGHAPVIVFKNCDLDRAVAETIKAKFATSGQDCLGANRIFVERDIYDEFCTRFVAATQALSVGKGIDDPDIGPLMNEKAVQKQEEHVADALEKGATLACGGKRHALGPLFYEPTVLTDVPADALILHEETFGPVAPITPFDSEDEVIQRANDSEYGLVAYVHSHDPRRIYRLSRALQFGMVAVNRTKVTGAPIPFGGTKQSGMGREGARLGMEEFTEVKYVCRDWA

SEQ ID NO: 47405 - protein, 413 aa, Mesorhizobium loti MAFF303099
MDQKVETTPYDVEAIRRDFPILSREVYGKPLVYLDNGASAQKPQVVLDTIQHAYSQEYANVHRGLHFLSNAATDAYEKARETVRRFLNAPSTDNIVFTSNTTSAINTVAYGYGMPNIGEGDEIVLSIMEHHSNIVPWHFIRERQGAKLVWVPVDDLGVFHIEEFEKRLTNRTKLVAITQMSNALGTVTPIKEIVRIAHARGIPVLVDGSQSAVHMPIDVQDLDCDFFVFTGHKVYGPSGIGVLYGKKDILAGMRPFMGGGEMIEEVTEDIVTYNEPPHRFEAGTPPIVQAIGLGAALDYMEKIGRERIAAHEEDLKTYAHERLRAINSLRIFGDAPGKGAIISFELQGIHAHDVSMVIDRQGVAVRAGTHCAQPLLKRFGVTSTCRASFGMYNTRAEVDALAEALEKARKFFG

SEQ ID NO: 47406 - protein, 794 aa, Magnetospirillum magnetotacticum MS-1
MQNLSSVSKATRACQITLGLCAAFALVALLLQNWVAAGFAVVTAVSAWMPLGYLSRTHVSVEKAVKVCQAAASGNLGVRIMDIRGTGNLALMLRSINRLLDLTEAYCRESQAAMEHANQRQYFRKIIQTGLRGDFARYAGVINASLDLMKSRDAEALTFAEQNVRILVQEVSSASTQLRQSSDRLMNNATQTVEQAMTSAAAAEEASVNVQSVAGAAEELAASFGEINMQTTRATAISSEAMVTAQRTDETVRDLGTAAEKIGSVLSLIQDIASQTNLLALNATIEAARAGEAGKGFAVVANEVKTLANQTARATEEISAHVSQIQLASQGAAVAIREIAQIVGTIQETSTAVAGAVEEQNAVTMEISRNVQEAATGTASVSEAVAYVKDTAETPTKRPATSPPPPPVWRRAPTTWKPRSAASSPRSRGRPPEFRAVGEPGIRLSRLLPPPRRGKPGDGFGGGFMKKIGVIGGGAWGTALALTARRAGRDVVLWAREPQVVDDVNTRHVNSDFLPGVDLDPALRATADLAEAADADAVLLVSPAQHLRAACRALAPHWRSGVPAVICAKGIELATCALMQDAVAAELPQAPIAVLSGPTFAIEVARGLPTAITLACGDAALGRKLVDALGTATFRPYLSDDLVGAQVGGAVKNVLAIACGIVEGRGLGDNARAALITRGLAELTRLAMAKGGRPETLMGLSGLGDLILTASSTQSRNYSLGFALGEGRALADILGERHSVTEGVYSAGAVVDMAGRTGVEMPISAAVDAVINGGQSLDEAIRALLSRPFRNEGL

SEQ ID NO: 47407 - protein, 451 aa, Physcomitrella patens subsp. patens
MAERTLLARRTTAFAPSPIQQLSLLAQRCNAINLAEGFPDFPAPPEIKEAAIAAIRSDFNQYRHVQGVCEKVAEAFEMSHGVRVDAATQITICCGQSEAMAATVFAVVEEGDEVVLLDPVYETYQSCIILAGGTPRYVSLNPPHWSLDFENLESAFGSKTKAIIINSPHNPTGKAFSTSELAKIATLCCKYDCLAITDEVYEHIIFDGREHVSIASFPGMQQRTIVTSSLSKTFSVTGWRIGWAVAPATISAAIGNIHVKMTDSAPAPFQEAALVALQSTTNFFTQLKQEYEERRDYVCEMLLQAGFSNFLKPEGSFFVFAELPKACPLNDVDYVAELIQGAGVAVVPGRGFFHQAADTVGQSTQFKDQSNTGEELSAEEVYDSNGATKFGELCIQNYTTRYIRVAFCKDMATLRAAKTAIQKHLALVDPDTGHKQHYSSQCSLDRPHFFT

SEQ ID NO: 47408 - protein, 180 aa, Vitis vinifera
MASSMVSSATVATINRATPAQANMVAPFTGLKSLSTFPGTRKANTDITSVASNGGRVRCMKVWPTEGLMKFETLSYLPPLNDEQLCKEVDYLLRMKWIPCLEFTKLYPYPHREHNRSPGYYDGRYWTMWKLPMFGCTDSAQVIKEVQEARTAYPDAHIRIIGFDNNRQVQCIAFIAYKPS

SEQ ID NO: 47409 - protein, 435 aa, Nocardioides sp. JS614
MSVLTADHERQARLAVRPLVLGRVVGLLGLRVTVSGVSAALGDLLEVQGLTGPVPVEVVASGDGMLTCLPLGDTTGLRVGDHVVNHGEGLRIPVGEALRGRVLDGLGRPMDDGPALDDLPTVVVDNLPPAALSRPRIDQQLGLGVRAMDALISCGRGQRLGIMAGSGVGKSSLLSMIARGTDAEISVIALIGERGREVREFLENDLGPAGLRRSIVVVATSDEPPVVRLRAAFVATRIAEWFRDSGRHVVLMMDSLTRVALAQREIGLSAGEPPATRGFPPSVFALLPRLLERAGTSPEGSITGLYTVLVEGDDLQDPIGDSARSILDGHVVLSRDLATSGHFPSIDVLESISRVASAIIEPSGRADGIRLRRLLAAYRSVRELVEIGAYVAGSDADADDALALMPRINDFLRQDMSDVTPTADTWSALHELVTT

SEQ ID NO: 47410 - protein, 307 aa, Mycobacterium tuberculosis
VIRHFLRDDDLSPAEQAEVLELAAELKKDPVSRRPLQGPRGVAVIFDKNSTRTRFSFELGIAQLGGHAVVVDSGSTQLGRDETLQDTAKVLSRYVDAIVWRTFGQERLDAMASVATVPVINALSDEFHPCQVLADLQTIAERKGALRGLRLSYFGDGANNMAHSLLLGGVTAGIHVTVAAPEGFLPDPSVRAAAERRAQDTGASVTVTADAHAAAAGADVLVTDTWTSMGQENDGLDRVKPFRPFQLNSRLLALADSDAIVLHCLPAHRGDEITDAVMDGPASAVWDEAENRLHAQKALLVWLLERS

SEQ ID NO: 47411 - protein, 140 aa, Rhodovulum sulfidophilum
MAIQRTFSIIKPDATKRNLTGAINAKLEAAGLRIVAQKRIHLSKAQAAVFYAVHKERPFYDELCEFMASEPIVVQVLEGEDAIAKNREVMGATNPAEAAEGTIRKEFALSIGENSVHGSDAEDTAKEEIAYFFSGLELVG

SEQ ID NO: 47412 - protein, 396 aa, Silicibacter sp. TM1040
MSFQNPVFIPGPTNIPESLRKACDMPTIDHRSPLFGQILHPAREGVRKVLKSDSAEVFIFPSSGTGGWETALSNTLSPGDTVLAARNGMFSHRWIDMCQRHGLEVEIIETPWGEGLPADRYEEILTADTSHKIKAVLATHNETATGVKSDIAALRRALDAAAHPALLFVDGVSSIASMDFRMDEWGVDVAVTGSQKGFMLSAGLAIVGFSAKAMDATQSARLPRTFFDVHDMAKGYANNAYPYTPAVGLMNGLNESCKMLLAEGLEDVFARHHRIAEGVRAAVGAWGLELCAATPEVYSDTVSAIRTPEGFNATDIVTHAAEKYGVAFGVGLGEVAGKVFRIGHLGSLTDVMALSGIATAEMCMVDLGLDIRLGSGVAAAQDYYRGHTAAAQKDAA

SEQ ID NO: 47413 - protein, 226 aa, Staphylococcus epidermidis ATCC 12228
MKEATKPGVTTRELDHIAKDLFEEHGAISAPIHDENFPGQTCISVNEEVAHGIPGKRVIREGDLVNIDVSALKNGYYADTGISFVVGKSDQPLKQKVCDVATMAFENAMKKVKPGTKLSNIGKAVHATARQNDLTVIKNLTGHGVGQSLHEAPNHVMNYFDPKDKTLLKEGQVIAVEPFISTHATFVTEGKNEWAFETKDKSYVAQIEHTVIVTKDGPLLTTKIDD

SEQ ID NO: 47414 - protein, 463 aa, Streptococcus pyogenes M1 GAS
MTIFRKKKKYSNKTEMQRHFKVIDLVFLGLGSMVGTGIFTVTGIGAAKYAGPALTISIIISAIAIGILALFYAEFASRMPSNGGAYSYVYATLGEFPAWLVGWYIIMEFLTAISSVAVGWGSYLKGLLANYNIVLPNALNGTFNLKNGTYIDILPVLVMFFVTGIVLMNSKLALRFNSFLVILKFSALALFIFVGIFFIDHNNWSHFAPYGVGQITGGKTGIFAGASVMFFAFLGFESISMAVDEVKEPQKTIPKGIILSLIIVTALYIVVTTILTGIVHYTKLNVPDAVAFALRNIRLYWAADYVSIVAILTLITVCISMTYALARTIYSISRDGLLPKSLYTLTKKNKVPQNATLVTGLLAMICAGIFPLSSLAEFVNICTLAYLIILSGAIIKLRRIEGEPKANEFKTPLVPFLPMLAIIICLSFMSQYKAFTWIAFAIATIIGTLIYLAYGYTHSIENK

SEQ ID NO: 47415 - protein, 285 aa, Arabidopsis thaliana
MALFDTHNTWAFVFGLLGNLISFAVFLSPVPTFYRICKKKTTEGFQSIPYVVALFSAMLWLYYATQKKDVFLLVTINSFGCFIETIYISIFVAFASKKARMLTVKLLLLMNFGGFCLILLLCQFLAKGTTRAKIIGGICVGFSVCVFAAPLSIIRTVIKTKSVEYMPFSLSLTLTISAVIWLLYGLALKDIYVAFPNVIGFVLGALQMILYVVYKYCKTPSDLVEKELEAAKLPEVSIDMVKLGTLTSPEPVAITVVRSVNTCNCNDRNAEIENGQGVRNSAATT

SEQ ID NO: 47416 - protein, 194 aa, Fusobacterium nucleatum subsp. nucleatum ATCC 25586
MKIKKADFVKSAVYEKDYPEQLDKMEFAFVGRSNVGKSSLINSLTSRLKLARTSKTPGRTQLINYFLINDEFYIVDLPGYGFAKVPKEMKKQWGQTMERYIASKRKKLVFVLLDIRRVPSDEDIEMLEWLEYNEMDYKIIFTKIDKLSNNERAKQLKAIKTRLVFDNEDVFFHSSLTNKGRDEILNFMEEKLNN

SEQ ID NO: 47417 - protein, 118 aa, Vitis vinifera
MATGSMMAKRYPWHQVAAVSGAVGIGLGAFGTHVFKPQNPIYKEVWQTASLYHLVHTAALLATPVTKHPNIFGGLVTAGILAFSGTCYTAAYFEDRKYSFLAPFGGLAFIAAWGSLLF

SEQ ID NO: 47418 - protein, 320 aa, Streptococcus pyogenes M1 GAS
MSYSDLKLFALSSNKELAEKVASAMGIQLGKSTVRQFSDGEIQVNIEESIRGHHVFILQSTSSPVNDNLMEILIMVDALKRASAEKISVVMPYYGYARQDRKARSREPITSKLVANMLEVAGVDRLLTVDLHAAQIQGFFDIPVDHLMGAPLIADYFDRHGLVGEDVVVVSPDHGGVTRARKLAQFLQTPIAIIDKRRSVDKMNTSEVMNIIGNVSGKKCILIDDMIDTAGTICHAADALAEAGATAVYASCTHPVLSGPALDNIQRSAIEKLIVLDTIYLPKERLIDKIEQISIADLVAEAIIRIHEKRPLSPLFEMGN

SEQ ID NO: 47419 - protein, 213 aa, Zea mays
MNHHQAQPVRTGDVYPPTAVKREASHERDKIIEQGDQRGGALHVDQTDLPAGRRMVTASAGGQVMAQFTVPVPDTKVAEATDAVTLGEALHAAAQTSAGDKPVDLADAAALQAAEARATGLGGNVRGGVAAAAQQAAETNAKRAEDGGGGDRVTLRDVVGGDAAAAMAADKVATREDAEKVAAAAARNVGKGAGGGVAEAVVAAADMNEGRMM

SEQ ID NO: 47420 - protein, 148 aa, Helianthus annuus
MEQTFIMIKPDGVQRGLVGEIIGRFEKKGFTLKGLKLLTVDQAFAEKHYADLSAKPFFNGLVEYIISGPVVAMVWEGKNVVTTGRKIIGATNPAESPPGTIRGDFAIDIGRNVIHGSDAVESAKKEIGLWFPEGVANWSSSLHPWIYE

SEQ ID NO: 47421 - protein, 249 aa, Carboxydothermus hydrogenoformans Z-2901
MGELTGKVGIVTGGSKGIGFATAKRIAEEGAKVVIANRNKEEGEKAALQLREKGLEVYSIPCDVGKVADIKKLVSEVYGRYGRIDILVNCAGVNVRKPIEEYTEEDWNYMVDINLKGTFFACIEAGKHMIAQKEGVIVNLASIQAEEVLPERGIYATTKGGVKQLTKALAVEWAKYNIRVNAVSPAFIKTEMVEKVLQDPYWGNLIINKTPMRRPGTPEEVAEAILFLVSPKASYITGINLLVDGGWTA

SEQ ID NO: 47422 - protein, 119 aa, Vitis vinifera
MMAAESMMAKLYPWHQVAAVSGAVGIGLGAFGAHVFKPQNPIYKEVWKTASLYHLVHTAALLATPVTKHPNIFGGLVTAGILAFSGSCYTVAYFEDRKYSFLAPFGGLAFIAAWGSLLF

SEQ ID NO: 47423 - protein, 149 aa, Saccharum officinarum
MESTFIMIKPDGVQRGLIGEIISRFEKKGFYLKALKLVNVERSFAEKHYADLSSKPFFQGLVDYIISGPVVAMVWEGKSVVTTGRKIIGATNPLVSEPGTIRGDFAVDIGRNVIHGSDSIESANKEIALWFPEGLADWQSSQHPWIYEK

SEQ ID NO: 47424 - protein, 149 aa, Glycine max
MDEQTFIMIKPDGVQRGLIGEIISRFEKKGFYLKGLKLVTVDRPFAEKHYADLSAKPFFSGLVDYIISGPVVAMIWEGKNVVTTGRKIIGATNPAQSEPGTIRGDFAIDIGRNVIHGSDAVESANKEIALWFPEGPANCQSSQHSWIYE

SEQ ID NO: 47425 - protein, 546 aa, Oryza sativa
MAAAASSVLAYLLVVALLAIVPLVYFGWVARRRGEGGRLPPSPWGLPVIGHLHHLAGALPHHAMRDLARRHGPLMLLRLGELPVVVASSAEAAREVMRTRDIEFATRPMSRMTRLVFPAGTEGIIFAPYGDEWRELRKVCTVELLSARRVQSFRAVREEEVGRLLRAVAATSSSPSPAQAAVNLSALLSAYAADSAVHAIIGSRFKDRDKYLMLLERGLKLFARHTLPDLYPSSRLAMWLSRMPRRMMQHRREAYAFTDAIIREHQENRAAGAGDGDGDDKEDLLDVLLRIQREGDLQFPLSTERIKTTVGIIRVNNMLNNLSQTRHPKNYDITLSHDMFAGGSETAGTALQWIMAELIRNPRVMHKVQDEVRQTLAGRDRVTEDAISNLNYMHLVIKEALRLHPPVPLLLPRECRNTCQVLGFDVPKGAMVLVNAWAISRDPQYWDEPEEFIPERFEDSNIDFKGTNFEYTPFGAGRRMCPGIAFGLANVELMLASLLYHFNWQLPDGMDTADLDMTEEMVVSARRLHDLLLVPVVHVPLPVASS

SEQ ID NO: 47426 - protein, 472 aa, Nostoc punctiforme PCC 73102
MEVDTQHYDDIIIGGGKAGKTLAPALVADGRKTALVERSLNMIGGGCINIACIPTKTMVASANVANTVRNSAAYGVKANTPIVDLAEVIQRKRAVVQSAREMNLHNLETALDKNLIIGEARFVAPKTIEVTTTEGKNRLLTAERLFINTGTRPLIPSIPGLTEVEFLTSESIMELEYLPEHLIVLGSGYIGLEFAQMFRRFGCGVTVIGQSEQILSQQDPDIAIAVQTLLERNGIEFLLKAKVLRVVRKASPLENRTGNETILQIQVGDREITLQGSHLLVAVGRAPNTDSLNLAAAGVATDTRGFIQVNDRLETNIPGIWALGDINGGPQYTHISLDDYRIIKANLIDGGDRSTGDRLVPSCLFIAPELAHVGLTETEAQQQGYAIRVAKIDASAVPRARTLGQTDGLLKAIMDTETGRILGCSLLCHEAGEVISTVQMVMQAQMPYTILRDGILTHPTMTEGLNILFSKL

SEQ ID NO: 47427 - protein, 314 aa, Nicotiana tabacum
MADQENCVRVTRLAKKRAAEAMVQHLQQPNKKRVVLGEIRNLSNQIQMFDSEPLKPKCNKQTTKRKVKRSVSVKEREFREEDVDSKLDDDPQMCSAYVSDIYEYLHQMEIEKKRRPLSDYLEKVQKDVTANMRGVLVDWLVEVAEEYKLLSDTLYLAVAYIDRYLSIKVIPRQRLQLLGVSSMLIASKYEEIKPPRVEDFCYITDNTYTKKDVVKMEADVLQSLKFEMGNPTTKTFLRRFTRVAQEDCKNSNLKLEFLGCYLAELSLLDYNCVKFLPSLVAAAVIFLSRFTLQPKLHPWSVGLEQNSGYRACLL

SEQ ID NO: 47428 - protein, 391 aa, Pediococcus pentosaceus ATCC 25745
MIDDQKIAYLDNAATMPMPDEVLEVIDMYYHAHKVNVHRGMYRLAHQVTEQYEAVRQATADFINAQDSSEIIFTSGTTDALNLVAFGYAEKQLQPDDEIIISVLEHHSNFIPWQRVAHKTGAKLKIVGLDDQQNLDMQQFSELLTEKTKLVAITLVSNVLGSIVDAKQIIEQTHHMGGVVVLDAAQAVGHLPLDVQKLDADFLAFSGHKMYGPTGVGVLYGKRNLLEQVAPLRFGGEMADEVDAQTATFQPLPLRLEAGTPNIAGVLGLGAAIQYLQKIGFTTIHQHEQQLLNQLYQGLRQIPAIKVYGPRSAAERQGVLSFNYGTIHAHDVATIIDTENVAVRAGHMCAEPLMQALGVSSVVRASVSYMNTTRDVEQLLAAMNQVGQILL

SEQ ID NO: 47429 - protein, 180 aa, Brassica napus
  misc_feature (160)..(160): Xaa can be any naturally occurring amino acid
MERYDILRDLGSGNFGVAKLVREKANGKFYAVKYIERGLKIDEHVQREIINHRDLKHPNIIRFKEVFVTPTHLAIVMEYAAGGELFERICSAGRFSEDEARYYFKQLISGVSYCHSMQICHRDLKLENTLLDGSPSSQLKICDFGYSKSSVLHSQPKSTXGTPAYVAPEVLSRKEYNGKI

SEQ ID NO: 47430 - protein, 116 aa, Glycine max
  misc_feature (34)..(34): Xaa can be any naturally occurring amino acid
  misc_feature (82)..(82): Xaa can be any naturally occurring amino acid
  misc_feature (111)..(111): Xaa can be any naturally occurring amino acid
KIYCPNVSTVNHAGAGMVAPFTGLKSMADFPTRXTNNDITSIASNGGRVQCMHVWPPDGKNKVDTLPYLPDLDDAQLANEGXYLHTKGWIPSLEYELEHGNVYPEHNMSPXYYDGR

SEQ ID NO: 47431 - protein, 233 aa, Nanoarchaeum equitans Kin4-M
MRFDGRDYNEIRDTEMKIGVISKADGSAYCRTGNTIAIAAVYLKPGREQSNLKVSYRMLPFAGEERKGLGLTRREIELSYIIAKALEPAIIFEEIPYLTIEASVEIIKADAGTRVAAINALSLALAHAGIPMKALVGAIAVGKVGEKIVLDLNKQEEDYDSEIIKKELPQYYEYYGEGKAVDIPMAMYKNKITLLQLDGSIDRKSLLEAIKLGKDGIKRMIDLQKIAIEDYYF

SEQ ID NO: 47432 - protein, 275 aa, Bordetella pertussis Tohama I
MAQVPVLKLNDGNAMPQLGLGVWQVPNDQAAASVKAALAAGYRSIDTAAIYGNEAGVGEGLRAAGVARKDLFVTTKLWNDRHGYDEAQRAMDESLRKLGLAYVDLFLIHWPVAGSDKFVDAWRAMVAMKEDGRARSIGVSNFTIANLRRLVDETGVVPAVNQVELHPGFAQRELRAFHAEQGIATESWSPLGQGAVMHDATLAGIAARHGKSAAQVTLRWHLQNGLIVIPKSVTPARIQANIDVFDFELSADEMADIDALPEGPRLGPDPATFTG

SEQ ID NO: 47433 - protein, 200 aa, Saccharophagus degradans 2-40
MTVKYVESSKLPTPMGMFAMHGFSDDSSDKEHVVLTMGDVSSEEPVLVRIHSECLTGDALFSLRCDCGAQLQAAMHKIAIEGRGAIFYLRQEGRGIGLLNKIRAYKLQDCGADTVEANERLGFGADMRDYSILKPMFEHLGIAQVKLMTNNPRKIDALTQYGINIVNRIPHETGRNPHNADYLETKKGKLGHMFGEKDGE

SEQ ID NO: 47434 - protein, 356 aa, Gibberella zeae PH-1
MASTAALDPVKKALLSNPLAGALGDVFNSFNERRAKLGLSNPGTIESLAKEVQRDVFLNNYMFTGIRADLTKIFSMAPLFQVSHQFAMGERINPYTFAAMYGTGKVFCQGNLDNEGSLSGRFNWRWSDKLVSKSQLSISPGGQDMAQFEHEYTGNDFSASLKMLNPSYLEGGVTGIFIGSYLQSVTSKLALGLETLWQRPSLSQGPECAVSYAARYKSADWIATAQLQAAMGTLNTSYWRRLSDKVQAGVDLSLGLVPSPGGLMGGGLQKEGVTTIGAKYDFRMSTFRAQVDSKGKLSCALEKRVAPPVMMTFAADIDHFTHQAKIGLGVSIEAAPEELQEQQEVLGAQAPPNIPF

SEQ ID NO: 47435 - protein, 159 aa, Solibacter usitatus Ellin6076
MSEIRTGLGWDVHRIATGRKMILGGVTVPCEFGLEGHSDADVLAHAITDAILGAAALGDIGMHFPDSDPRWKGCDSLVFLRHARDLATQKGYRIVNVDSTIILERPKLKDFRQTIRERLAETLELDVDRVSVKFKTAEKVGPVGEGRSAESQAIVTLEK

SEQ ID NO: 47436 - protein, 430 aa, Magnetospirillum magnetotacticum MS-1
MDLHHPELTYAAIVALAAVLCGGLMTRLKQPAIVGYILAGVVLGPSGFGLVSNRDAVATLAEFGVLMLLFVIGMKLDIIRFLEVWKTAVFTTVLQIAGSIGTALLLRHGLGWSLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSPAYGAFLGGVVLGNSAQRDMLLKRAQPIGSVLLMVFFLSIGLLLDFKFIWKNLGTVLTLLAMVTLFKTALNVAALRLARQDWPSAFLAGVALAQIGEFSFLLADTGKAVKLISAQETKLVVAVTVLSLVLSPFWLFTMRRMHRVAAVHVHSFRELVSRLYGDEARTARRARTLVRRGSWRDDHNAGPGTGI

SEQ ID NO: 47437 - protein, 193 aa, Fusobacterium nucleatum subsp. nucleatum ATCC 25586
MYNPTVIDNNGKSERAYDIYSRLLKDRIIFVGTAIDETVANSIIAQLLYLEAEDPEKDIIMYINSPGGSVTDGMAIYDTMNYIKPDVQTVCVGQAASMGAFLLAAGAKGKRFALENSRIMIHQPLISGGLKGQATDISIHANELLKIKDRLAELLAKNTGKTKEQILRDTERDNYLSSEEAVNYGLIDSVFRR

SEQ ID NO: 47438 - protein, 155 aa, Saccharophagus degradans 2-40
MTIKVIEGDFKASTGKYALLVSRWNSFVVEHLKDGAIDTLRRHGISDENIEVIYAPGAFEFPLAAQKLADAKRYDAIIALGAVIRGGTPHFDYVAGECTKGLAQVSLNAGLPITFGVLTVDSIEQAIERSGTKAGNKGAEAASTALEMVSLISKI

SEQ ID NO: 47439 - protein, 370 aa, Saccharophagus degradans 2-40
MELNTTEEIIDEIRQGRMVILMDDEDRENEGDLIMAAEQVRPEDINFMATHARGLICLTLSEERCKQLDLPLMVRDNHAAHSTNFTVSIEAAEGVTTGISAADRARTIRAAVKRDALPRDLVQPGHIFPLMSQPGGVLSRAGHTEAGCDLARLGGYEPAAVIVEIMNEDGSMARREDLEKFAKLHNIKIGTIADLIQYRAINEKTVTCINERTVHTNHGEFILKTYLDKARKECHFALLKGEVRPDEPTLVRVHVGNTARDVLGVQRTDMDNLSWSFQDAMKRVAEEGNGVLVLICHNETTEEIEESIDWMLSGKKARPRQDVAYKQVGTGSQILKDLGVSKMRLLSAPFKFKAISGFNLEVVEYLKNDA

SEQ ID NO: 47440 - protein, 493 aa, Debaryomyces hansenii CBS767
MADTRALEKAQEFVNFVNNSPTPYHAVDTVKVGLRNAGFKEIQERSNWKEAQLKKGGKYFVTRNGSSLIGFTIGDKFANGNGISIVGAHTDSPCLRIKPISKKNSEGFIQVGVEQYGGLIAHSWFDRDLSIAGRVYVNDTKTGQYVPKLIKIDKPLLRIPTLAIHLHREVNTKFEFNKETKLVPIAGQVALDKNEAESTKDSKSCADDPDLQLSPEQFESVQSVIQRHNKSLIELIAKECDVEPIQIEDFELVLFDHQKPTLGGLNDEFIFSPRLDNLTSCYCAMDGLIRSGENLSEQKGIQLISLFDHEEIGSMSAQGADSTFLPDIIQRLTKIDFSNLADKGVSVEYFHETMSRSFLLSSDMAHGVHPNYGEFYEGQNRPQINLGPVIKINANQRYATNSPGIVLLKKCATLAKVPLQLFVVRNDSPCGSTIGPILAAKLGIRTLDLGNPQLSMHSIRETGGTYDVVRLCDLFVSFFENYTDIDSKILCNI

SEQ ID NO: 47441 - protein, 502 aa, Streptomyces avermitilis MA-4680
MRPGRQSAMTELVEHGQLFIGGVLADPLGKDVIEVISPHTEEVIGRVPHASTADVDRAVAVARKAFDEGPWPRATLDERIEVVTRIKDAIAVRHEEIARVISSENGSPYSWSVLAQALGAMMVWDAAITVARNFTYEETRDGVLGKIVVRREPVGVVAAVVPWNVPQFVAAAKLAPALLTGCTVVLKPSPESPLDAYLLGEIAREAGLPEGVLSILPADREVSEYLVGHPGIDKVSFTGSVAAGRRVMEVASRNLTRVTLELGGKSAAVVLPDADITTSVPGIVSAAWMNNGQACVAQTRILVPRSRYDEFADAFAAAASALVVGDPLDPATQVGPLVARRQQRRNLDYIRIGQEEGAKILTGGGRPPGLDRGWYVEPTLFGDVDNSMRIAREEIFGPVICLLPYGDETEAVKIANDSDYGLSGSVWTADVEHGIDVARRVRTGTYSVNTFSLDMLGPFGGYKNSGLGREFGPEGYGEFLEHKMIHLPAGYEAPTGVEGAGA

SEQ ID NO: 47442 - protein, 303 aa, Solanum lycopersicum
MEKYEKLEKVGEGTYGKVYKAKDKATGQLVALKKTRLEMDEEGIPPTALREISLLQMLSHSLYIVRLLCVEHIDKNGKPILYLVFEYLDTDLKKFIDSHRKGPNARALPTALIQSFLFQLCKGVAHCHSHGVLHRDLKPQNLLVDKEKGILKIADLGLGRAFTVPMKSYTHEIVTLWYRAPEVLLGSTHYSTAVDMWSVGCIFAEMVRRQALFPGDSEFQQLLHIFRLLGTPTDKQWPGVSSLRDWHVYPQWEPQNLASAVPALGPDGVDLLTKMLKFDPSDRISAKAALDHPYFDSLDKSQF

SEQ ID NO: 47443 - protein, 633 aa, Bacillus subtilis subsp. subtilis str. 168
MDLLSIQDPSFLKNMSIDELEKLSDEIRQFLITSLSASGGHIGPNLGVVELTVALHKEFNSPKDKFLWDVGHQSYVHKLLTGRGKEFATLRQYKGLCGFPKRSESEHDVWETGHSSTSLSGAMGMAAARDIKGTDEYIIPIIGDGALTGGMALEALNHIGDEKKDMIVILNDNEMSIAPNVGAIHSMLGRLRTAGKYQWVKDELEYLFKKIPAVGGKLAATAERVKDSLKYMLVSGMFFEELGFTYLGPVDGHSYHELIENLQYAKKTKGPVLLHVITKKGKGYKPAETDTIGTWHGTGPYKINTGDFVKPKAAAPSWSGLVSGTVQRMAREDGRIVAITPAMPVGSKLEGFAKEFPDRMFDVGIAEQHAATMAAAMAMQGMKPFLAIYSTFLQRAYDQVVHDICRQNANVFIGIDRAGLVGADGETHQGVFDIAFMRHIPNMVLMMPKDENEGQHMVHTALSYDEGPIAMRFPRGNGLGVKMDEQLKTIPIGTWEVLRPGNDAVILTFGTTIEMAIEAAEELQKEGLSVRVVNARFIKPIDEKMMKSILKEGLPILTIEEAVLEGGFGSSILEFAHDQGEYHTPIDRMGIPDRFIEHGSVTALLEEIGLTKQQVANRIRLLMPPKTHKGIGS

SEQ ID NO: 47444 - protein, 272 aa, Bacillus subtilis subsp. subtilis str. 168
MTNKLTSFLADRKKTIENQLSVYTEKLDMPDSLKKSMLYSLQAGGKRLRPLIVLAVLNAYGKSEKDGIPVGCAVEMIHTYSLIHDDLPCMDDDDLRRGKPTNHKVFGEATAVLAGDGLLTESFKLITSHVSDEVSAEKRLRLVNELISAAGTEGMVGGQVADMEAGNRQVTLEELESIHERKTSKLLGFCVIAGAILADAPEEDIETLRTFSSHIGIGFQIRDDILDLEGSEEKIGKRVGSDTTNDKSTYPSLLSLEGAKHKLDVHIKEAND

SEQ ID NO: 47445 - protein, 315 aa, Solanum lycopersicum
MEAAKNAGKSVSAMEAFEKLEKVGEGTYGKVYRARDRITGKIVALKKTRLHEDEEGVPPTTLREISLLRMLSRDPHIVRLMDVKQGQNKEGKTVLYLVFEYMDTDVKKFIRTFRAKGETMPLKIVKSLMYQLCKGVAFCHGHGVLHRDLKPHNLLMDRKTNVLKLADFGLGRAYTLPIKKYTHEILTLWYRAPEVLLGATHYSTAVDMWSVGCIFAELVTNQALFPGDSELQQLLHIFRLLGTPNEELWPGVSKLVNWHEYPQWKPQPLSTVVPGLDEDGIHLLSEMLHYEPSRRISAKKAMEHPYFDDLDKTPL

SEQ ID NO: 47446 - protein, 356 aa, Solibacter usitatus Ellin6076
MMTVETSSFCHLGRLVGNTPMLAVEFRFRGRRRVIYAKSEQLNMTGSIKDRMAFHILRQGYADGTLRPDCTIVEASSGNSGISFAALGRALGHKVTILMPDWMSRERMELIHSYGATMIPVSREEGGFMGCMRRAEDMAQGRADVFLPRQFSNPADVMAHEVSTGPEIWAQLAQHGLTADAFVAGVGTGGTVMGVGRYLRRRNPKVRVHALQPAESPTLTAGHKVGRHRMQGLTDEFIPEIVKLDELDEVISVSDGDSILMAQRLASELGIAVGISSGANFLGAIEAQNRLGADAVVATVFSDDNKKYLTTDLLREEPEKPGYLSPDVELISFDTYKRVCDTACEFPGCEGHTPQR

SEQ ID NO: 47447 - protein, 552 aa, Leptospira interrogans serovar Lai str. 56601
MNPNMKLSKKYTFRSRKVLLIILDGVGYSPKGPESGNAIAGAKLPFLNRVWNQFPTLHIQAHGKAVGMPSDDDMGNSEVGHNVLGSGRIFDQGAKLVSNSIASGDIFNGQAWKEVIGNSKKNNSTLHLLGLFSDGNVHSHIDHTKALISQAILEKVPKIRLHILLDGRDVPEKSALDYLNPFETWLDSLRKSGTDIRIASGGGRMTITMDRYEADWSMVERGWKVHVKGEGRYFSSAKEAIETFRSENPKIIDQYLPSFVISDNGKPVGKIQDGDSVVFTNFRGDRAIEISLAFTEKNFDKFDRGPLPNVLYAGIMQYDGDLKLPERFLVAPPAIDRTLGEYMASSNIPQYALSETQKYGHVTYFWNGNKSGYFDQNSEEYREILSDVIPFDQSPEMKALLITEALEKALNENKQDFYRVNYANGDMVGHTGNYLATVQAMEFLDGCVERLWKTCEKQNIVLLVTADHGNADEMFQLDKKGNVEKDSHGNPIPKTSHTLNPVPISILDPENKIRFNSKLSNPGLANVAATILDVMGYETPEGYHPSLIQNES

SEQ ID NO: 47448 - protein, 185 aa, Triticum aestivum
  misc_feature (174)..(174): Xaa can be any naturally occurring amino acid
MASPALISDTDQWKALQAHVGAIHKTHLRDLMTDADRCKAMTAEFEGVYLDYSRQQATTETIDKLFKLAEAAKLKEKIDKMFKGEKINTTENRSVLHVALRAPRDAVIDSDGVNVVPEVWDVKDKSKQFSETFSCGSWVGATGKSLTNVVSVGVGGSFLGPLFVHAALQIDPKXAESAKGWQLRL

SEQ ID NO: 47449 - protein, 333 aa, Triticum aestivum
  misc_feature (160)..(160): Xaa can be any naturally occurring amino acid
  misc_feature (171)..(171): Xaa can be any naturally occurring amino acid
  misc_feature (189)..(189): Xaa can be any naturally occurring amino acid
MAEADITRYWCHECQQAVEEAMVEELKCPLCDGGFVEEMTVEQVEALTEQGATQWDPLDNPFEQAGSPGDSDDEENSDIGREFEGFIRRHRRASALRRVLDSIHDDLRDDRERDNSVLISAFNQALALQGAALDPDEDRGDHGNANNDDGLLDEYVLGAXGISLLSQTYGXIDQGRYGTLPKKKAGFRXVPRVKIEEVVSCSVCLDDLDIGSQAKQLPCEHKFHSPCILPWLELHSSCPVCRFELPSDETKDLSEPSNVDRIESSHEEARADGPGNNGEDSNTNDREDSNRPWALVPWFNGLFSTPEPQTVRATLTDQQLPPASGTNPNAGHS

SEQ ID NO: 47450 - protein, 363 aa, Xanthomonas oryzae pv. oryzae KACC10331
MGIKCGIVGLPNVGKSTLFNALTKAGIAAANFPFCTIEPNVGIVPVPDPRLNQLAGIVKPQKLIPTAVEFVDIAGLVAGAASGEGLGNKFLAHIREVDAITHVVRCFDNDDVIHVNNKVDPIADIETIDTELALADLDSVEKALNRAERSAKGGDKDAAARKPVLAKLQAALADGKSGRAAGLDDEEKALVRDLFLLTLKPVLYIANVLEDGFENNPHLDAVRAHALAEGAEVVPVSAAIEEELSQLDDEDRDTFLADLGLEEPGLNRVIRAAYTLLGLQTYFTAGVKEVRAWTVRAGSTAPQAAAVIHTDFEKGFIRAETIGFDDFIKYRGEAGARDAGRLRLEGKEYRVQEGDVLHFRFNV

SEQ ID NO: 47451 - protein, 77 aa, Sulfitobacter sp. EE-36
MSDVADRVKKIVVEHLGVEEDKVVENASFIDDLGADSLDTVELVMAFEEEFGIEIPDDAAENIQTFGDAVKFIKEAS

SEQ ID NO: 47452 - protein, 346 aa, Xanthomonas oryzae pv. oryzae KACC10331
MKEKPGITSTFSLHHRPHALRRRPRDLMQDQRNLLVFSGNANKPLAQSICKELGVRMGKALVTRFSDGEVQVEIEESVRRQEVFVIQPTCAPSAENLMELLVLIDALKRASAQSVTAVIPYFGYSRQDRRMRSSRVPITAKVAAKMICAMEADRVLTVDLHADQIQGFFDVPVDNVYASPLLLADIWRAYGTDNLIVVSPDVGGVVRARAVAKRLDDADLAIIDKRRPRANVATVMNIIGDVQGKTCVLVDDLVDTAGTLCAAAAALKQRGALKVVAYITHPVLSGPAVDNINNSQLDELVVTDTIPLNEAARICAKIRQLSVAELLAETIRRIAFGESVSSLYVD

SEQ ID NO: 47453 - protein, 773 aa, Pediococcus pentosaceus ATCC 25745
MEENTSYDEGLKVSLSTKDLLVYGITFMIPVAPLAFYGSFLTPANGMVALAYFVGMVAMLFTGFSYATMSRRYPFSGSVYTYVQQGTNAGLGFIGGWGITLDYFLIPTITYLISKSFGESLFPTVPGWAWIIILVIFNTIVNILGANVVTKISWVLFALQGIVLVAFIIGTIRLLLSGAIQPQTISFYNPQHFNIQGVLQATGIVIVSYLGFDAISTLSEEAEDPHRSVGRAIILSILSIGILFVVITVLAGFVAPDYQNLNQNTAFLGILQRVGGTWLVKLADITIILSFGFASGQEGQTAVSRILYAMGRDGILPPAFAKLHKKYRTPIFAIVLVGLASLILSLTLSQDTVSNLVSFGALFGFILLNLSVIWKFYVKGDHGSVFSKERVETKYYEDDTKIYLTLLKKQDILDLDLSRERVKKRVISNISTTGNTKYAEKLISKYYRDFDYVFDMVRAEQALPSKKDNFLKSISEPKPTPRFQIHKYDLVKLIDGRLAIVFSINDANTEYEVRVEKGSESWELITIKQIDIAHVYQHLDSFLSPTKISLSIKDVFFKHDVNFLIEEFPDINVETLCTDSEWFDLENKLEGLLLKYSQISNKQSHNIGIRIQQMLDIIPEKYVDVRLSSVVPPTLEEIDQLEELDVVKLKDGKFATIVFAPPHPYSWDMHFDFDIGDSSTSWATPITEIAEIIFFHSKNLPIHLNKMLTKEAIQNLHVLVPDFDVNKTLSKEEFTKLYDLIDHKLMTQGFDTNDEPTPIGLMAENLLTEFADI

SEQ ID NO: 47454 - protein, 216 aa, Populus trichocarpa
MAPPIETPSKLPISRHSSHPPLNERILSSMNRRSVAAHPWHDLEIGPEAPKIFNCVVEIGKGGKVKYELDKKNGLIKVDRVLYSSVVYPHNYGFIPRTLCEDNDPMDVLIIMQEPVLSGCFLRAKAIGLMPMIDQGEKDDKIIAVCADDPEYRHYNDIKELPPHRLAEIRRFFEDYKKNENKEVAVNDFLPASDAYEAIQHSMNLYADYIVESLRR

SEQ ID NO: 47455 - protein, 181 aa, Photobacterium sp. SKA34
MNQETLNLIKNSIKSIQDYPKPGILFRDVTSLMEQPEAYRATIAILAEKYKDQGITKIIGTEARGFLFGAPLALELGVGFVPVRKPGKLPREVIAESYELEYGKDTLEIHKDAIKPGDRVLLVDDLLATGGTIEATTNLVRRLGGIVDDAAFVINLPDIGGEARLQGLGLNVYAICDFPGH

SEQ ID NO: 47456 - protein, 213 aa, Gibberella zeae PH-1
MADPRLNELLKWSIEQSEATKNDPDAPPAKTQLTPELMAALMGGPSDADLMKASMEIITSDNAEEVSLDDKLVAFDNFEQLIENLDNANNIANLSLWTPLLDQLKHEEREMRKMAAWCVGTAVQNNEKTQERLLAVGGVPMLVDLATKEDEPVDVRRKAVYALSSAVRNYQPAMDLFADELTKKGHKTDKVDATSMEAVDEVVNGLREKIGKA

SEQ ID NO: 47457 - protein, 1491 aa, Ustilago maydis 521
MSASDRHAASDRAAGRSVRSWLRSLLQGPSDQHADRGTYASSQGSAVVSSTGPASVGTDMISFHHTFEDVERPSFAPPPRSFSGGSSNGSLSYDAAAKRTLAQPIATPRAGAAHSSTNLLSANSLATSPSPSASPPKSPRIARTLTSSVASLTDRLHHQRRASETYRRMRSGSTSAEVDSQQIVLSRSLSKTLDRDSPLLASPSAISENEPVSSPPPTHLSHDSQLSPTGSLANPSDSNRYGPETSGVRRSDSSGTTTAIGESLSPSQSSAGAAPSTCEASHELLLPEGEQMLKVTHKKVKPRTFKLDPDRGQILWESKKNNRVNLESIREVRFGPSAASYRTSLNISSAHESRWLTIIYQNNGIYKALHLIALSDQSLSRWRASLLHLQSLRRELLGAVGASSSLENRRHLWMRHHWKDADESNDEKLSIEEVILLCRRLGIESNKAHLRRCFNLADWRNRGFLDFQDFQHFVSLLKQRADIETIFAAWADQPLEQPLEQLRRGSGVTKDDHDLRGQAPELEGSPALSDASSVDTQSCPAPSVMQTSRVMGPEPCRTQAMSIDSFRRFIREEQGNHNFSNGQIDDLFHRHCNSRLSSSHHADAPTERAQMDYDGFLDFLSSSDNPPLLDQLPLFSTIVSNPVDATVLGRPPCSGSIDAVEYSDTQQCSQQQDTDANQCPQQRTPSRAFANTTDELIAAGASDSMANTRKVAAHLRKSTIQHDMTRPLSEYYISSSHNTYLVGGQWKGDSTVEGYIRALLQGARSVELDCWDGPNNVPQITHGRTLTSRVPFQDVISAIARYAFVTSPYPLILSLEVHADPPQQEVMARILIDTLGEMLLSQPIDSQTLPGSTDELPSPEKLKFKVLVKAKNVAAADGHQALPLPKAADGLALSAKQKDGTDVIPTMVLEPPTSATDTTSTTDSEIESRLTSAKQLVCRVTRRSHRVQATSAGQAGYRSGDASDDGTAKASYETPGNGSRSSKATKKMMSTALASLLIYTIGVKCRGFNKKESYATQHMVSLSEKTALKMIRDPISNEALIKHNRSHLTRIYPSMMSFARLHASRNFVPLDMWAAGCQLVALNWQTTDLGFELNQAMFSRNGRCGYVLKPAALRTKEHGKTLQGKVVRFQLDLRIVSAQQLPKKNKAGASKDKDKDKGHSYHDNREPIDPFVVVSLLTPGCWGKQPKGLLQKASTPREAKELPLSPAPPVDHCEAAPDSVIQTRQTSVSEQSSGDGTIAAASSHTDKRLQHSADVGSSSEPSPGPQRAKSSAKTTALAPTHLLRTPTVKGNGFSPEWHTHMSVLIDVPAGASNELAALVEASKASQGAALTYPELERLSRGLLDLCFVRFEVFDDDLDDDVAEEQATSRTTRGSEDTLAPTPSISTAVVESGSRLSLNPTAAIRQSNTEAAADDDAGSKAGSETSSTSSTSSIDAESVAAYSVSVGALQQGYRHLPLYDHQLSQFLFSTLFVHSRLRLVGLVDGVAPGKQS

SEQ ID NO: 47458 - protein, 379 aa, Brassica napus
FTIFNFGTQKVVQNWQLFLCVCVGLWAGLIIGFVTEYYTSNAYSPVQDVADSCRTGAATNVIFGLALGYKSVIIPIFAIAVSIFVSFSFAAMYGVAVAALGMLSTIATGLAIDAYGPISDNAGGIAEMAGMSHRIRERTDALDAAGNTTAAIGKGFAIGSAALVSLALFGAFVSRAGVHTVDVLTPKVIIGLLVGAMLPYWFSAMTMKSVGSAALKMVEEVRRQFNTIPGLMEGTAKPDYATCVKISTDASIKEMIPPGCLVMLTPLIVGFFFGVETLSGVLAGSLVSGVQIAISASNTGGAWDNAKKYIEAGVSEHAKSLGPKGSEPHKAAVIGDTIGDPLKDTSGPSLNILIKLMAVESLVFAPFFATHGGILFKYL

SEQ ID NO: 47459 - protein, 671 aa, Fusobacterium nucleatum subsp. nucleatum ATCC 25586
MDLLTQVMYIGIAVGIISLLAAFYYAKKVEHYQINIPKVEEITAAIREGAMAFLAAEYKILIVFVIVVAVALGIFISVPTAGAFILGAITSAIAGNAGMRIATKANGRTAIAAKEGGLAKALNVAFSGGAVMGLTVVGLGMFMLSLILLVSRTVGISVNDVTGFGMGASSIALFARVGGGIYTKAADVGADLVGKVEAGIPEDDPRNPATIADNVGDNVGDVAGMGADLFESYVGSIIATITLAFLLPVDDATPYVAAPLLISAFGIISSIIATLTVKTDDGSKVHAKLEMGTRIAGILTIIASFGIIKYLGLDMGIFYAIVAGLVAGLVIAYFTGVYTDTGRRAVNRVSDAAGTGAATAIIEGLAIGMESTVAPLIVIAIAIIISFKTGGLYGISIAAVGMLATTGMVVAVDAYGPVADNAGGIAEMSELPPEVRETTDKLDAVGNSTAAVGKGFAIGSAALTALSLFAAYKEAVDKLTSEALVIDVTDPEVIAGLFIGGMLTFLFSALTMTAVGKAAIEMVEEVRRQFREFPGIMDRTQKPDYKRCVEISTHSSLKQMILPGVLAIIVPVIIGLWSVKALGGLLAGALVTGVLMAIMMANAGGAWDNGKKQIEGGYKGDKKGSDRHKAAVVGDTVGDPFKDTSGPSLNILIKLMSIVSLVLVPLFVKFM

SEQ ID NO: 47460 - protein, 448 aa, Debaryomyces hansenii CBS767
MNDLSREDLLQKIRLLELENAKLKESKSAVSTVSDQYEYDAKYPKIDEYFSSDEYKRYGRQMIVPQFGSLISQVKLKKSKVLFIGAGGLGCPALLYLSASGVGEIGIIDDDLVDISNLHRQVLHTTESVGIHKCESAKRYINKLNPHVKVNTYPFRLSNDNAFDIIEKYDLILDCTDTPATRYLINDVSVICGKTIVSGSGLKTDGQLSILNFHGIGPCYRCFYPKPPSPGSVTSCSDGGVVGPAIGLIGITMALEAIKVITDFYTDETFKPFLSMYSGYPQQQIRVFKMRNKQANCAVCGNNPTVLKSTISDNDIDYAEFCGRVNPNVLAPELRISVQEYHNYINSSQGENSILIDVRPKEQYEITKLPNSINIAWDPTFIKADNIDSYLPSNFDKNTNTFVMCRYGNDSQMATKKLIENFGFNEVKDIKGGINKWSKEIDSKIPQY

SEQ ID NO: 47461 - protein, 192 aa, Zea mays
GVPVVMGEPVSAHAFGGVPRESWNSGILSCLGRNDEFCSSDVEVCLLGTVAPCVLYGSNVERLAAGQGTFANSCLPYTGLYLLGNSLFGWNCLAPWFSHPTRTAIRQRYNLEGSFEAFTRQCGCCGDLVEDEERREHLEAACDLATHYLCHPCALCQEGRELRRRVPHPGFNNGHSVFVMMPPMEQTMGRGM

SEQ ID NO: 47462 - protein, 122 aa, Fusobacterium nucleatum subsp. nucleatum ATCC 25586
MAFNKEQFIADLEAMTVLELKELVSALEEHFGVTAAAPVAVAAAGGATEAAEEKTEFDVVLKSAGGNKIAVIKEVRAITGLGLKEAKDLVDNGGVIKEAAPKDEANAIKEKLTAAGAEVEVK

SEQ ID NO: 47463 - protein, 474 aa, Brucella melitensis 16M
MREMLMRPVVLAGGKGTRLWPMSRSQRPKQFLALTGELSLFQMTLKRLSDPNRYSSPIIITNADYRFLVAEQALECGVELSDVILEPMARNTAPAIAAAALIASKDEQTLIHVVASDHNIEINDAYFQAVDTACNAARMGRLATFGITPTEPATGFGYIEAGELEESGACAIKRFVEKPKEEVAREMLAAGGFYWNSGMFLFRSDVFLDECRRYAPAVYEAAEASVATAQRDLDFVRLNSAEFEKAPDISVDYAIFEKTKLASVVPSPIHWSDLGSWDAVWKESKQDPSGNVARGPVSLHNTNNSLVLSEGVHVAVNGVDDLTIVASEDALYVGKLSEAQGVGTIVKALMKQPATAKLAEEHRTIYRPWGGYTHLLSGDRLQVKRLFIKPGKQLSLQKHHHRSEHWVVVRGVAEIVIDDKSLFLSENESTYISQGAIHRVSNPGKILLELIEVQTGAYLGEDDIVRFEDDFGRV

SEQ ID NO: 47464 - protein, 188 aa, Triticum aestivum
  misc_feature (19)..(19): Xaa can be any naturally occurring amino acid
  misc_feature (34)..(34): Xaa can be any naturally occurring amino acid
  misc_feature (45)..(45): Xaa can be any naturally occurring amino acid
  misc_feature (58)..(58): Xaa can be any naturally occurring amino acid
  misc_feature (67)..(67): Xaa can be any naturally occurring amino acid
ARTPWGIIRTVQKYVVAVXLDLKLDLKAIAFQAXNAEYNPQAFCXLSIGIRDPKTTAXLIFGSGKMXVCTGAQSEQQSKLAARRYARIIQRLGFPAKFKDFKIQNIVASCDVNSPIRLEGLAYSHGAFSSYEPELFPGLIYRMRQPKIVLLIFVSGKIVLTGAKVREETYTAFENIYPVLTEFRKVQQ

SEQ ID NO: 47465 - protein, 646 aa, Leptospira interrogans serovar Lai str. 56601
MLQFIDIKHQYGSNVLFNGFSWHIKPGSRVCLVGPNGSGKSTLFRIAEGKFIPDEGSVAKSKNTEISVFQQIPEFNPEALVIDTALEKHKHYREYSERLKEINRKFDLVSHDSKEFTTILDEQSALEEYAFTYGVHELESKARKVLGGLGFSNVQMEMKVREFSPGYQHRLGLAITLLNPGNLLLLDEPTNHLDNTSKEWLADYLNSTGQSFVLVTHDPEFLDATCDTIAELSSSEVIEFRGTLEEYFEHKNELQEKLRAQYRKEETYLKKRMEWIERFRAKATKAKQVQSAIKKLEKRNKVEAPEESFWNSKSDYRFNFISSGKITVRIEDGAFSYSDKTPSIFSGANLEISAGDKIAVVGPNGAGKSTFLRCLLEIHKLTSGKIYYGPKTKIGYFSQNHHEELDPSKNLIQTVMSAYPDLSEQQARSLLGYFSFSDDSVYKQTSLLSGGEQSRLRLAMLVRFPANSIFLDEPTNHLDLVVRDNLLRALMEYEGSLLIISHDPEFLRSLCNRTISVDKGQIRDFNCTFEDYLKYNLQETTSSKQQVGNLVFKKEETGQTRSKRNSDKNRIKKIQKDLEQLETKIELLEKSKKNLEEVLADPDFFKNRSYQLELDNLNETKNEITRLTLEWESLQLELEELSGTVN

SEQ ID NO: 47466 - protein, 338 aa, Streptococcus pyogenes M1 GAS
MKAVVVNQASTGVEVVEHDLPNIGHGEALVKVEYCGVCHTDLHVAHGDFGQVPGRILGHEGIGIVEEIGEGVTSLKVGDRVSIAWFFEGCGHCEYCTTGRETLCRSVKNAGYSVDGGMSEYAVVTADYAVKVPEGLDPAQASSITCAGVTTYKAIKEAGAAPGQWIVIFGAGGLGNLAVQYAKKVFNAHVVAVDINNDKLELAKEVGADILVNGKEIEDVPGYIQEKTGGAHGVVVTAVSKVAFNQAIDSVRAGGTVVAVGLPSEYMELSIVKTVLDGIKVVGSLVGTRKDLEEAFAFGAEGLVAPVVEKVPVDTAPEVFDEMERGLIQGRKVLDFIS

SEQ ID NO: 47467 - protein, 432 aa, Xanthomonas oryzae pv. oryzae KACC10331
MTLWVLGLNHQTAPVDLRERAAFAGDALPRALESLRALPQVSEAALLSTCNRTELYAMADEARSLVNWLETHAPGLSGYLYQHQEAEAVRHLFRVATGLDSMVLGEPQILGQVKDAWAVARAHGALGSGLDRLFQQTFSVAKRARTDTRVGANPVSVASTAVRLAQESFARLNESTVLLIGAGETIELAAKHLSEGRVRRLLIANRTLAHAQTLASQHGGYALPLTDLERHLAEADVVFSATAAREPLVTRVQVEQALRARKRKPMLLFDLAVPRDIEASVDELSDAYLYTVDDLERAVEDNRRGRREAADQAEAIIDLQVARYVETLQATTRQAPLKRLRAFGDSTRDELLAKARQQLHNGKPTDEVLEQLAHALTNRLLHPPTAALRDAALNNDLELTTAADRLFPEKPGYQHPPIATPIVRTDDADPAP

SEQ ID NO: 47468 - protein, 181 aa, Zea mays
  misc_feature (120)..(120): Xaa can be any naturally occurring amino acid
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAXLLVFANKQDLPNAMNAAEITDKLGLHSLRQRHWYIQSTCATSGEGLYEGLDWLSNNIANKA

SEQ ID NO: 47469 - protein, 536 aa, Arabidopsis thaliana
MFVKPLVFKEVEKTEGIPKRERGNVGGGKDANFGNVGVRKETERCLSQTEVEKEAWKLLRGAVVNYCGFPVGTVAANDPGDTQTLNYDQVFIRDFVPSAYAFMLDGEGEIVRNFLLHTLQLQSWEKTVDCHSPGPGLMPASFKVKSAPLEGNDGSFEEFLDPDFGGSAIGRVSPVDSGLWWIILLRAYGKLTGDYTLQERIDVQTGIKLILKLCLADGFDMFPTLLVTDGSCMVDRRMGIHGHPLEIQALFYSALRCAREMLIVNDGTKSLVTAVNNRLSALSFHIREYYWVDIKKINEIYRYNTEEYSADATNKFNIYPEQIPTWLVDWIPDKGGYFIGNLQPAHMDFRFFTLGNLWAVISSLGNQEQNEGVMTLIEEKWDDLVANMPLKICFPALEKDEWRIITGSDPKNTPWSYHNGGSWPTLLWQFTLACIKMGKLELAKKAVAVAEKRLKEDEWPEYYDTKSGRFVGKQSRLYQTWTIAGFLAAKKLIEQPEKASLLFWEEDYQLLETCVCGLSKSSGRKNKCSRFTPPRS

SEQ ID NO: 47470 - protein, 151 aa, Brassica napus
  misc_feature (10)..(12): Xaa can be any naturally occurring amino acid
  misc_feature (16)..(16): Xaa can be any naturally occurring amino acid
  misc_feature (21)..(22): Xaa can be any naturally occurring amino acid
  misc_feature (32)..(32): Xaa can be any naturally occurring amino acid
  misc_feature (34)..(34): Xaa can be any naturally occurring amino acid
  misc_feature (39)..(39): Xaa can be any naturally occurring amino acid
  misc_feature (41)..(41): Xaa can be any naturally occurring amino acid
  misc_feature (47)..(47): Xaa can be any naturally occurring amino acid
  misc_feature (54)..(54): Xaa can be any naturally occurring amino acid
  misc_feature (57)..(57): Xaa can be any naturally occurring amino acid
  misc_feature (60)..(60): Xaa can be any naturally occurring amino acid
  misc_feature (75)..(75): Xaa can be any naturally occurring amino acid
  misc_feature (82)..(82): Xaa can be any naturally occurring amino acid
  misc_feature (86)..(86): Xaa can be any naturally occurring amino acid
  misc_feature (90)..(90): Xaa can be any naturally occurring amino acid
  misc_feature (92)..(92): Xaa can be any naturally occurring amino acid
  misc_feature (98)..(98): Xaa can be any naturally occurring amino acid
  misc_feature (103)..(104): Xaa can be any naturally occurring amino acid
  misc_feature (108)..(108): Xaa can be any naturally occurring amino acid
  misc_feature (110)..(111): Xaa can be any naturally occurring amino acid
  misc_feature (113)..(113): Xaa can be any naturally occurring amino acid
  misc_feature (116)..(116): Xaa can be any naturally occurring amino acid
  misc_feature (118)..(118): Xaa can be any naturally occurring amino acid
  misc_feature (123)..(123): Xaa can be any naturally occurring amino acid
  misc_feature (127)..(128): Xaa can be any naturally occurring amino acid
  misc_feature (131)..(134): Xaa can be any naturally occurring amino acid
  misc_feature (136)..(136): Xaa can be any naturally occurring amino acid
  misc_feature (141)..(147): Xaa can be any naturally occurring amino acid
MASSMLSSAXXXTSPXQATMXXPFTGLKSSAXFXVTRKXNXDITSIXSNGGRVXCMXVWXPVGKKKFETLSYLPXLTEVELXKEDXYLLXAXKWIPCXEFQLXXGLVXRXXGXPPXTXNGRYXTLGXXPLXXXXDXDQVLXXXXXXXRPQF

SEQ ID NO: 47471 - protein, 498 aa, Rhodopseudomonas palustris CGA009
MRTVGHFIGGKEVEGKSGRFADVFEPMTGEVKAKVALATKAELRAAVENAKAAQPEWGATNPQRRARVLMKFLELVQRDYDKLAELLAREHGKTIPDAKGDIQRGLEVAEFACGIPHLMKGEYTEGAGPGIDIYSMRQPLGVVAGITPFNFPAMIPMWKFAPAIACGNAFILKPSERDPGVPMALAALMLEAGLPPGILNVVNGDKEAVDAILDDPDIKAVGFVGSSPIAQYIYERAAQTGKRAQCFGGAKNHAIIMPDADIDQTVDALIGAGYGSAGERCMAISVAVPVGKATADALMSKLIPRVEALKIGPSTDPTADYGPLVTKEALERVKNYVDIGVKEGATLAVDGRGFKMQGYENGFYMGGCLFDNVTKDMRIYKEEIFGPVLSVVRAHDYAEALSLPSDHDYGNGVAIFTRDGDAARDFAAKVNVGMVGINVPIPVPIAYYTFGGWKKSGFGDLNQHGPDSIRFYTKTKTVTSRWPSGVKEGAEFSIPLMK

SEQ ID NO: 47472 - protein, 326 aa, Zea mays
MASTLLHAATASLQSSSQPARAGAATAFHPLASTPSIRLARSSFSSNRRLEVSLRAVSAGHRFAGRGAPRGRRVVAALAGEQTEGSEVGDDKDNSNGEIKPEEAQEAWKVMLEQFKAEALRMQALSMQAYDVYSKRAREVLLEASEKLKIQADKAQKDLSVIATEVSQEGQEYLVMAARNSPDSIKDITTTFRALGRLNWPSEYEDYHVGIPFGTFLTVGGFLNFMLTGSTSALRFGIVLGLALLTLGISSLRSHREGDRRPRLLVKGQAAIALVIFFREFSVLLQNGWFPKIFIVLLSGVVAAFYFYRIATGNPKDLSSKNDSAN

SEQ ID NO: 47473 - protein, 407 aa, Sporothrix schenckii
MSFSSMLSRLHGQPDSYDKKSKYHFGRMLGAGTYGIVREADGPTGKVAIKVILKKNVKGNEQMVYDELNLLQNLKHSHIVRFVDWFESRDKYYIVTELATGGELFDRICEQGKFTEKDASQTIKQVLSAVDYLHKNNVVHRDLKPENLLYLTKQSDSDLVLADFGIAKMLDSKDEVLTTMAGSFGYAAPEVMLKKGHGKPVDMWSMGVITYTLLCGYSPFRSENLPDLIEECTSARVIFHERYWKDVSEDAKDFIIGLLQPNPDDRWSSGDALKHKWLSGESATEHNLLPEIKAYMAKARLRRGIELVKLTNRIEALKMQEDDPENSDMQTDTAAPLQKAAAAAAAQDDGASGSVGAESGPTDKTKQTIQKVKGAIFREVVMAKVREMRQQEEVRKEVEEASKQGSP

SEQ ID NO: 47474 - protein, 305 aa, Populus trichocarpa
MVADSKGKSDISFAGTFASSAFAACLAEICTIPLDTAKVRLQLQKSAVAGDGLALPKYRGMLGTVATIAREEGLSALWKGIVPGLHRQCVFGGLRIGLYEPVKNYYVGSDFVGDVPLTKKILAALTTGAIGITVANPTDLVKVRLQAEGKLPPGVPRRYSGALNAYSTIVRQEGVRALWTGIGPNVARNAIINAAELASYDQVKQTILKIPGFTDNIVTHLFAGLGAGFFAVCIGSPVDVVKSRMMGDSAYKSTLDCFIKTLKNDGPLAFYKGFIPNFGRLGSWNVIMFLTLEQAKKFVRNLESS

SEQ ID NO: 47475 - protein, 433 aa, Vibrio vulnificus CMCP6
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALAGRAPFNGLKEVKGQA

SEQ ID NO: 47476 - protein, 519 aa, Rhodopseudomonas palustris CGA009
MSWKPELDELARRENFAQQMGGIDKVKRQHDQGRLTVRERIDRLSDAGSFHEIGAVAGLGEYDANGELINLTPANCVFGRAKIDGRTVVVVGDDFTVRGGSADASIHAKPQMAEEMAHDYRLPIIRVIEGSGGGGSVRTIESKGAANLPGGVDGTRWYWYTTANLAQVPVVGLGLGSVAGLGAARLAASHYSIMTRNSAMFVAGPPVVARLGQDLTKQELGGADIQTRAGAIDHAVDTEEEAFACARRFLSYLPSSVHELPPTLACDDDPERTDEKLLKAVPRNRRQVYKMRPIIESVVDQGSFFEIGSAFGRSIITGLARLEGRAVALLAGDPYHYGGSWTSDTCQKVIRFVDLAETFHLPVVYLMDCPGFMIGLEAEKSATIRHGVRAMTAVNQSTVPWCTIIVRNAFGVAGVVHQPANRFSMRYAWPSAYWGSLPLEGGIEAAYRADLDAAEDRDAKMREIEDRLNKLRSPFRSAEKFWVEEIIDPRKTRSLLCEFARLAEPLRTPGVATGMRMRP

SEQ ID NO: 47477 - protein, 134 aa, Saccharomyces cerevisiae
MSAPNPKAFPLADAALTQQILDVVQQAANLRQLKKGANEATKTLNRGISEFIIMAADCEPIEILLHLPLLCEDKNVPYVFVPSRVALGRACGVSRPVIAASITTNDASAIKTQIYAVKDKIETLLILEHHHHHH

SEQ ID NO: 47478 - protein, 338 aa, Escherichia coli O157:H7 EDL933
MIIERCCELALRAPARVVFPDALDQRVLKAAQYLHQQGLATPILVANPFELRQFALSHGVAMDGLQVIDPHGNLAMREEFAHRWLARAGEKTPPDALEKLTDPLMFAAAMVSAGKADVCIAGNLSSTANVLRAGLRIIGLQPGCKTLSSIFLMLPQYSGPALGFADCSVVPQPTAAQLADIALASAETWRAITGEEPRVAMLSFSSNGSARHPCVANVQQATEIVRERAPKLVVDGELQFDAAFVPEVAAQKAPASPLQGKANVMVFPSLEAGNIGYKIAQRLGGYRAVGPLIQGLAAPMHDLSRGCSVQEIIELALVAAVPRQTEVNRESSLQTLVE

SEQ ID NO: 47479 - protein, 513 aa, Arabidopsis thaliana
MTTTEFQSCFIFLLLCLFSLVCYSLFFRKPSSRRDAHGCDLPPSPPSLPVIGHLHLILSSLVHKSFQKISSNYGPLLHLRIFNVPIVLVSSASVAYDIFRVHDLNVSSRGSPPFEESLLFGSTGFISAPYGDYFKFMKKHLVTKLLGPQALERSRLIRTNELERFYINLLDKATKKESVEIGKEAMKLSNNSICKMIMGTSCLEEKGEAERVRGLIIESFYLTKKFFLAFTLRGLLEKLGISLFKKEIMGVSRRFDDLLERYLREHEEKPDNEHQDTDMIDALLAAYRDEKAEYKITRNQIKAFLVDIFIAGTDISALTTQGTMAEIINNPNIFVRIREEIDSVVGKSRLIQETDLPKLPYLQAVVKEGLRLHPPTPLMVREFQEGCKVKGFYIPASTTLVVNGYAVMRDPNVWEDPEEFKPERFLASSRLMQEDEIREQALKYIAFGSGRRGCPGANVAYIFVGTAIGMIVQCFDWRINGEKVDMKEAIGGLNLTLAHPLKCTPVARFPKPF

SEQ ID NO: 47480 - protein, 424 aa, Rhodopirellula baltica SH 1
MSSAAAASETTQNSDPYIQSLFAERIGGANYGKSTEIYKFEKIKRAKRKALADHPERQLLDFGIGENDSMADASIREVMGREINQVENRGYADNGVAEYKEAAARFMQRQFGVKLDPETQINHCIGSKPAYAMLPACFINPGDITMMTVPGYPVAGTHTRYYGGDVYRLPLLAENKFLPDLDAIPDDVFRRTKLMILNYPNSPTGGTAPKSFFEDVITLAKEKEFVVVNDAAHIMLTFDGKPTSFLEVPGALDVGVEVHSMSKGYDMIGWRMGFVAGHPLVVKAFSDVKDNSDSGQFIATQKAAAAALDDDSIPERIRTKYRRRMEKLVKVLRDCGFEAEMPGGTYFLYTKSPTGTASGETFAAAEDATRFLIEENGIVTVPWDDAGSFLRFSVTYIAEDEAAEDALMAETAARLSGAGFQWKS

SEQ ID NO: 47481 - protein, 759 aa, Escherichia coli O157:H7 EDL933
  misc_feature (177)..(177): Xaa can be any naturally occurring amino acid
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNXLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKAGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSPLKGSANILVMPNMEAARISYNLLRVSSSEGVTVGPVLMGVAKPVHVLTPIASVRRIVNMVALAVVEAQTQPL

SEQ ID NO: 47482 - protein, 324 aa, Triticum aestivum
MDRYQRVEKPRNETPIRENEIRITALGRMRNYIGYGMSLLEENGHDEITIKAMGRAINKTVMVAELIKRRVAGLHQNTSIESVGITDTWEPLEEGLVPLETTRHVSMITLTLSKEPLDTSSPGYQPPIPAEEVKPAFDYEHEGSFPSARGRGRGGPGGGRRGRGRAISNGPPPYDWGEEWEEDGDYYYNGRGRGRGRLRGRGRARGYYGGGRRGGYGYDYGYGGRGGYYEEQGGYFDGEPDEYHPPPGRGRGRGRRMEQSEYYNGEPDEYRPPPGRGRGRGRWMEQNEYFDEPYEYPPPGRGRGMGRRGGPWRARGRGRGPMLD

SEQ ID NO: 47483 - protein, 277 aa, Zea mays
AEAMESPFRADVVKDKAALVTGGGSGICFEIAAQLARHGAQVAIMGRRREVLDKAVAALRSRGLREDAARVLAATVAHFGKLDILVNGAAGNFLASPEDLTPKGFRTVLEIDTLGTYTMCYEALKYLKKGGPGKGPSTGGLIINISATLHYTASWYQIHVSAAKAGVDSITRSLALEWGTDYDIRVNGIAPGPIQDTPGLRKLAPEEMSKGLREMMPLFKFGEKRDIAMAALYLAFDAGKYVNGTTLVVDGGLWLSHPRHIPKEEVRELSKVVEKKV

SEQ ID NO: 47484 - protein, 207 aa, Taxus wallichiana var. chinensis
  misc_feature (201)..(201): Xaa can be any naturally occurring amino acid
  misc_feature (203)..(203): Xaa can be any naturally occurring amino acid
CAMEMIHTMSLIHDDLPRMDNDDFRRGKPTNHKVFGEDTAVLAGDALLSFAFEHIAVATSKTVPSDRTLRVISELGKTIGSQGLVGGQVVDITSEGDANVDLKTLEWIHIHKTAVLLECSVVSGGILGGATEDEIARIRRYARCVGLLFQVMDDILDVTKSSEELGKTAGKDLLTDKATYPKLMGLEKAKEFAAELATKAXEXLSSF

SEQ ID NO: 47485 - protein, 172 aa, Triticum aestivum
SQYYVLIRLGRSGFKKIMSNLTATADHLADRLKATGRFEIMSEGQGRGLPLVAFRLKDEHHYNEFDISSKLRERGWIVPAYTMAPNVEHIKMLRVVVREDFSRSRCEILVKDIIAALRALDTSDKEAVAKRREHIEEHSHSSIYSNDVNPKSKTTGTESESTEDSKTAQGIC

SEQ ID NO: 47486 - protein, 179 aa, Oryza sativa
  misc_feature (70)..(70): Xaa can be any naturally occurring amino acid
MMSAKLLRSMSVRRLLGQQRNSVEFYRKSQAWNSTASFSDVDEKNRKGGDAEDDFTHSRPDHVFRGVHRXIVCGKVGQVPVGMFDQRTVGAENLPMPAQWHRISVHNEQLGAFAVQKLVKNSAVYVEGDIETRVYNDRINDQVKNIPEICVRRDGKIQLMQSGDSNVGKSLEELREGLF

SEQ ID NO: 47487 - protein, 316 aa, Cryptococcus neoformans var. neoformans JEC21
MSPEPPAKRMKETKRVEMAFLGPRGTYGEQAARAFATSYSDPIDLVPCTTITATDVYNHSAPLIVLPLENTLQGCVLETLDCLLSVLKPSKPEDPKPLERKIVADFVLPIRHCLVVRKGTKMEQIKWVRSHEQALGQSSSFLAERLPGVKLEKWSSTAGAAVSLLQNTGNADDKGAAICSKAVLDLYPDHLEVLHEGTQYGNENYTRFILLTVPAPTIVPKSDKQLSSADRTSFIAVPNPSLGAILLSLHPSSSASSSVSVTAIHTRPAVEGMAHKDEKFPRWCLLEVVNEPTKEMEDAVSLGSLRESLGPEILCK

SEQ ID NO: 47488 - protein, 692 aa, Arthrobacter oxydans
MAKGIYVSATTPGSGKSLVALGLADTLHRHADRIGFFKPVVHGPDAAADPMVALMKSRFALEDERCRGGLTHEEVRTLLAEGNRAEIDARCVEIFADISRHCDVVIVEGTDLVGQDSAVEFDLNARLANNLAAPIVAVVGAKGRTVAEAAAAVEVARKELAAERCSLLAIMVNRADPADLDAIAAAVKPGASKRPVYILPELEAIARPTTGEVAAALGVRQIAGRPDMERDVKDIKVAAMNVGNFLNVLDEGALVIVPGDRADVMVACLAASFSPEFPVASALILTGGLAPDANIYPLLAQAPFPVFAAREDTYTTARRVSEVRSEIWSGHRRKVASALGLWSRRVDEAELVERLHLPRAERMTPLRFLHDLIERARSQRRHVVLPEGTDVRILRAAEILHRRDVCDLTVLGPESEVRELAAARGIDLSGINIVDPATSDLRQKFAEKYAELRAHKGVDLPKALEIMQDVSYFGTMMVQLGVVDGMVSGAAHTTAHTIRPALEFVKTREGVKIVSSVFLMLMPDRVLVYGDCAVNPDPNVEQLADIALASAETAAQFGVEPRVAMLSYSTGGSGSGEAVDAVRQATELVRQRRPDLAVEGPIQYDAAVDASIAESKMPGSSVAGQATVFIFPDLNTGNNTYKAVQQSSGAVAVGPVLQGLRKPVNDLSRGCTVEDIVNTVAITAIQAQAPAS

SEQ ID NO: 47489 - protein, 321 aa, Acidovorax sp. JS42
MQTNPPDFVVFTGNANPGLAAEIAQNLGTTLGAIDVGRFSDGEVTVEIKQNVRARDVFVVQSTCAPTNENLMELLIMVDALKRASAERISAVIPYFGYARQDRRPRSTRVPISAKVVANMLQAVGVARVLTMDLHADQIQGFFDIPVDNIYASPVLLGDLNQKKYENLIVVSPDVGGVVRARALAKQLGTDLAIIDKRRPKANVSEVMHVIGDIEGRNCVIMDDMIDTAGTLVKAAEVLKERGAKNVYAYCTHPIFSGPAIERIAQGTALDEVVVTNTIPLSDAAKGCSKIRQLSVAPLIAETIQRIAKGESVMSLFSDQA

SEQ ID NO: 47490 - protein, 158 aa, Vibrio vulnificus CMCP6
MIRIGHGFDVHKFGGEGPVIIGGVAVPYEQGLIAHSDGDVALHALSDALLGAIAAGDIGRHFPDTDDKWKGVDSRELLKDVYRRVKEQGYKLGNADVTIIAQAPKMAPYIDAMREAIAHDLETDIRNINVKATTTERLGFTGRKEGIATEAVVLLIKQ

SEQ ID NO: 47491 - protein, 273 aa, Sulfitobacter sp. EE-36
MANARTNIATVDPVWDQIQTEAQNAVRDEPLIGGFVHATILHHKSIEKALSYRIAAKLASNEMSMMVVHEMVEEAFASDPDLIKAARADLVAIYERDPACHRLLQPILYFKGYQAVQAYRVGHHLWKQGKRDLAYFVQMRVSEIFGVDIHPAATIGKGIMIDHAHSVVIGETAVVGDNVSMLHSVTLGGTGKEEQDRHPKIGNGVLIGAGAKVLGNISIGHCSRIAAGSVVLESVPPCKTVAGIPARVVGEAGCDQPSVLMDHMLGPQGDINM

SEQ ID NO: 47492 - protein, 285 aa, Populus trichocarpa
MKRPQFTPERSCLFVVALSGLIIGALLFSNLIRSVGNISSFGLCSFASAKARAAAEYAATPTQLQSILHYATSKIVPQQSLAEISVTFDVLKTRSPCNFLVFGLGFDSLMWTSLNPHGTTLFLEEDPKWVQTIVKNTPTLNAHTVQYLTQLKEADSLLKTYRSEPLCSPSKAYLRGNYKCRLALTGLPDEVYDKEWDLIMIDAPRGYFPEAPGRMAAIFSAAVMARERKGSGVTHVFLHDVNRRVEKMFAEEFLCRKYLVKAVGRLWHFEIPPAANVSQSDGWFC

SEQ ID NO: 47493 - protein, 631 aa, Bacillus thuringiensis serovar konkukian str. 97-27
MKMLTVENLSKSYGEKPLFDGLSFSIAEGQRAGIIGVNGTGKSTLLKIIAGAEIPDTGDMTHSRGYTISYLSQQPEFDEQLTVLEQVFHGDTPLIRLLRDYEKALLHIEKDPSNEKVQEQLFAVQQRMDAMSAWEANANAKSLLTKLGITDFTATVGNLSGGQKKRIAMAQCFIETPDLLILDEPTNHLDHETVEWLEEYLARYTGAVLLVTHDRYFLDRVTNRIFELDNGKLYSYEGNYSTFLEAKALREEQELAQESKRQNLYRRELAWIRRGAKARSTKQKARIQRFDELKGQEGPAAKQSVDIALSGSRLGKKVLELKDVTKKFGDKTVLNNFNHIVKPGDRIGIIGANGSGKSSLLNMLAGKISPDSGEIEVGQTVKIAYYTQENEEMNLNQRMIEYIKEIAEVIHTTDGKVIGASQMLERFLFPPHSHGTPLGKLSGGERRRLYLLRILMGEPNVLLLDEPTNDLDTQTLTVLEDYLEDFPGVVLTVSHDRYFLDKVVDELFIFTGEGEVREFLGSYTDYLEMEKTRELIEKAEVQKEKKVVEEAPKQQRKRKLSYNEQREWETIEDTIAELEEKLESIGEELANVGSDFTKAQELSEAQQKTEEELEKTMERWSELSDIVEGLK

SEQ ID NO: 47494 - protein, 659 aa, Escherichia coli O157:H7 EDL933
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAAGKVKATAHKCDLCAGRENGPACVENCPADALQLVTDAALSGMAKSRRLRTARQEHQPWHASTAAQEMPVMSKVEQMQATPARGEPDKLAIEARKTGFDEIYLPFRADQAQREASRCLKCGEHSVCEWTCPLHNHIPQWIELVKAGNIDAAVELSHLTNTLPEITGRVCPQDRLCEGACTIRDEHGAVTIGNIERYISDQALAKGWRPDLSHVTKVDKRVAIIGAGPAGLACADVLIRNGVAVTVYDRHPEIGGLLTFGIPSFKLDKSLLARRREIFSAMGIHFELNCEVGKDVSLDSLLEQYDAVFVGVGTYRSMKAGLPNEDAPGVYDALPFLIANTKQVMGLEELPEEPFINTAGLNVVVLGGGDTAMDCVRTALRHGASNVTCAYRRDEANMPGSKKEVKNAREEGANFEFNVQPVALELNEQGHVCGIRFLRTRLGEPDAQGRRRPVPVEGSEFVMPADAVIMAFGFNPHGMPWLESHGVTVDKWGRIIADVESQYRYQTTNPKIFAGGDAVRGADLVVTAMAEGRHAAQGIIDWLGVKSVKSH

SEQ ID NO: 47495 - protein, 367 aa, Physcomitrella patens subsp. patens
FEAPIFSGLAFGTGEYFAVVGVGTPRRDMYLVVDTGSDITWLQCAPCTNCYKQKDALFNPSSSSSFKVLDCSSSLCLNLDVMGCLSNKCLYQADYGDGSFTMGELVTDNVVLDDAFGPGQVVLTNIPLGCGHDNEGTFGTAAGILGLGRGPLSFPNNLDASTRNIFSYCLPDRESDPNHKSTLVFGDAAIPHTATGSVKFIPQLRNPRVATYYYVQITGISVGGNLLTNIPASVFQLDSHGNGGTIFDSGTTITRLEARAYTAVRDAFRAATMHLTSAADFKIFDTCYDFTGMNSISVPTVTFHFQGDVDMRLPPSNYIVPVSNNNIFCFAFAASMGPSVIGNVQQQSFRVIYDNVHKQIGLLPDQC

SEQ ID NO: 47496 - protein, 575 aa, Oryza sativa
MSGSAATLGMRCGSYGSLASAGGGRKGGGRGWGWRGGGEKERLQLLHRALRLVGRRRAGVLLLLAAASAAVFCSIFAVVKDDNASMIIANNYEVANTIQNSVYPSMTRPLMTSSDQFSASSVNKTELPNRLRLSFANFTHHPCEGFSVAPPLVDPKRTGPRPCDVCYVPVDQAFALMPPQPSPSPVLKNLSYVFEDNITANFSNQGSVFGGHPSLEQRNKSFDISESMTVHCGFVRGKKPGQGSGFDINDDDLLEMEKCRELVVASAIFGNYDMIQHPRNASEFSKANACFYMFVDEETEAYVKNSSSLYRNNKVGLWRLVVVRNLPYEDPRRTGKIPKLLLHRLFPNVRFSVWIDAKLKLVVDPYLLLERFLWRKNATFAISRHYKRFDVFEEAEANKAAGKYDNASIDYQIEFYRNEGLTYYAPAKLPITSDVPEGCVIIREHIPITNLFTCLWFNEVDRFTSRDQISFSTVRDKIRARVGWMPEMFLDCERRNFVIQGYHRELLEQMIASGWKPPPTASEPSRKLRLGSRKAPPSKKSSMKRKRVKKSSSRRRLPKPITRMTDTTTWQKLGA

SEQ ID NO: 47497 - protein, 1481 aa, Debaryomyces hansenii CBS767
MNSSTHYDDVSQKSSTVNDLADDNKIPEYHGFDKEVSSEVQNLARMMSRPSIDKASSLARTLSNMSQVPGLNPMAKDEGELDPRLDPDSDSFDSKFWVKNLRKMHNSDPAYYKPASLGVAYKDLRAYGIATDADYQANVGNVVYKTISQTIKGFFDKNNDDAKFDILKPMDGLIRPGEVTVVLGRPGAGCSTFLKTISSNTHGFTVAKDSVLSYDGLKPNDIIKHFRGDVVYCAETESHFPQLTVGQTLDFAAKLRTPQNRPEGVSREEYAAHMTKVIMATYGLSHTRNTKVGNDFIRGVSGGERKRVSIAEVALSFASLQCWDNSTRGLDSATALEFIKALKTSATVLNATPMIAIYQCSQDAYDLFDKVILLYEGYQIFFGDCKQAKLYFLEMGYDCPQRQTTADFLTSLTNPSERVVRPGYENKVPRTPEEFYTYWQNSPERKALLGEIDDYLNKTDNEERLQQFKDAHNTKQSNHLRPASPYTVSYGLQVKYIMGRNIMRTKGDPSITLFSIFGNTVMGLIISSIFYNLDDTTGSFYYRTVAMFFAVLFNAFSSLLEIFALYEARPIVEKHKTYALYHPSADAFASIITELPPKLLVSISFNLVLYFMVNFRRNAGNFFFYLLVNFTATLSMSHLFRTIGSATKSLSQAMTPASVLLLALTIFTGFVIPTPEMLGWCRWINYLDPIGYAFEALIANEFHGRDFDCSQFVPSGPGYPTSGNSIICSVVGSQPGSDIVNGDDYIRGSYEYYFSHRWRNWGIVVGFVVFFLFVHIIICEYNKGAMQKGEILLFQRSALKKNKRQRKDIESGNIEKVGPEFNNEKTPDNEIDNKLPSSGDIFHWRELTYQVKIKSEDRVILNSVDGWVKPGQVTALMGASGAGKTTLLNALSDRLTSGVITSGVRMVNGHELDASFQRSIGYVQQQDLHLQTSTVREALTFSAYLRQPKSVPKSEKDSYVDYIIRLLEMEKYSDAVVGVSGEGLNVEQRKRLTIGVELVAKPKLLVFLDEPTSGLDSQTAWSICKLIRKLADHGQAILCTIHQPSAILLKEFDRLLFLQRGGKTVYFGDLGDNCQTLIDYFEKYGAPKCPPDANPAEWMLEVIGAAPGSHASQDYYDVWMNSTEYREVKGELDVMEQELVKKPKDDSPESMKTFAVPMWQQYINVTHRVLQQYWRTPSYTYSKVLMSIFSSLFNGFAFFKANNTMQGLQNQMFSVFMFFVIFNTLTQQYLPNYVSQRDLYEARERPSKTFSWVAFITAQITAEIPWQILTGTLAFFCWYYPIGLYGNAEATDTVSQRGALMWIIIVLFFIYCSTMAQLCISFMEVADNAANLASLLFTMCLTFCGILASPDAMPGFWIFMYRCNPFSYLVSAILSVALQDSSVTCSDKELLRFEPEGGQTCGEYMQSYIQNAGGYLISNDTTGSCEYCTISSTNVFLESVSVDKTKRSRDIGIFFCFIVINMIGTVFFYWLARVPKRSRQK

SEQ ID NO: 47498 - protein, 590 aa, Oryza sativa
  misc_feature (224)..(224): Xaa can be any naturally occurring amino acid
MGSYAYKYCMCFTRKFRSPAADPPPDVRAAFLAAGGGDGGLRRFLAQAQGETPAEVDRILALLSGGGGGGGGGGIAARLVGPRPGPAPSLDDFFGFLFNADLNPPIATQVHQDMSAPFSHYYIYTGHNSYLTGNQLNSDSSDIPIIKALQRGVRVIELDMWPNSAKNNIDILHGGTLTAPVQIIKCLKSIKEYAFCASPYPLVITLEDHLTPDLQAKVAEMLVXTFGNLLYIPRSDPINEFPSPESLRKKIIISTKPPEEYKKFLKSKDNQNINGGLANLAEEGSLRRIDSNAEESDGKDELDDQDEDSSDEDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTRYKSVRLLMRFDFL

SEQ ID NO: 47499 - protein, 200 aa, Nicotiana tabacum
MATEAPIEATEVPPASATETVAKQPHKLERRWTFWFDNQSKPKQGAAWGSSLRKAYTFETVEEFWSLYDQIFKPSKLTANADFHLFKAGIEPKWEDPECASGGKWTVTSSRKANLETMWLETLMALVGEQFDESEEICGVVASVRRSQDKLSLWTKTASNEAIQMSIGRKWKEIIDAEKISYSFHDDSKRERSAKSRYTV

SEQ ID NO: 47500 - protein, 459 aa, Arabidopsis thaliana
MAQQEASPSPGAEVVGRAFVEQYYHILHQSPGLVHRFYQDSSFLTRPDVTGAVTTVTTMQAINDKILSLKYEDYTAEIETADAQESHERGVIVPVTGRLTGNDNVRKKFSQSFFLAPQDKGYFVLNDVFRFLEEKEVTAQARSVPINGTTRDVQAPIEPERVVVSHEPEVEPEPVASIEEEDLDNVAEVYDPSDKDEGVVVDVEPIEPPTQISHNEILSVPQGDAPKHSYASILKQMKSSPAPTTHVARNKPRPAPVNQKLTAPPAEPAARPEASAHENVPNSSHVDVEDDGHSIYVRNLPFDSTPTQLEEVFKNFGAIKHEGIQVRSNKQGFCFGFVEFETSSGKQSALEASPVTIGDRQAVVEEKKTNSRGGGNNGGSRGRYFSGRGSFRNESFKGGRGGGGRGGYGRGGGEFSGRPKSSNPRNGGEGYQRVPQNGGGGRGGRGEGGRGGARGGGSS

SEQ ID NO: 47501 - protein, 1463 aa, Debaryomyces hansenii CBS767
MTDDNEVPNYRGFDEGVSSEVQNFARSMSRPSIDKASSLARTLSNVSQVPGVNPMSKEEDIDPRLDPDSDNFDSRFWVKNLRKMYNSDPAYYKPSSLGVAYKDLRAYGIATDADYQSNFGNAAYKVVARTIRRFMDRNNEAAKFDILKPMDGLIRPGEVTVVLGRPGAGCSTFLKTIAAHTYGFTIDKNSVLSYDGLTPKDIIKHFRGDVVYCAETESHFPQLTVGQTLEFAAKLRTPQNRPEGVSREEYAEHLTKVVMATYGLSHTKNTKVGNDFIRGVSGGERKRVSIAEVALSFASLQCWDNSTRGLDSATALEFIKALKTSATVLNATPMIAIYQCSQDAYDLFDKVILLYEGYQIFFGDCKQAKLYFLEMGYDCPQRQTTADFLTSLTNPSERVVRPGYENKVPRTPEEFYTYWQNSPERKALLGEIDDYLNKTDNEERLQQFKDAHNTKQSNHLRPASPYTVSYGMQVKYIIKRNIMRTKGDPSITIFGVFGNIVMGLIISSIFYNLEDNTGSFYYRTAAMFFAVLFNAFSSMLEIFSLYEARPIVEKHKTYALYHPSADAFASIITELPPKIFTCLAFNLVLYFMVNFRRNAGNFFFYLLVNFTATLSMSHLFRTIGSSTKSLSQAMTPASILLLALTIFTGFVIPTPKMLGWCRWINYLDPIGYAFEALIVNEFHGRDFDCSQFVPSGPGYPTSGDSIICSVVGAVAGRDYVTGDAYINEQYVYYWSNRWRNWGIVVAFVVFFLVVHIMICEYNKGAMQKGEILLFQRKALKKNKRRRNDIESGNIEKISPDYNNDNVTDNEMESKLPSAGDIFHWRELTYQVKIKSEERVILNSVDGWVKPGQVTALMGASGAGKTTLLNALSDRLTSGVITSGVRMVNGHELDASFQRSIGYVQQQDLHLQTSTVREALTFSAYLRQPKSVPKSEKDSYVDYIIRLLEMEKYSDAVVGVSGEGLNVEQRKRLTIGVELVAKPKLLVFLDEPTSGLDSQTAWSICKLIRKLADHGQAILCTIHQPSAILLKEFDRLLFLQRGGKTVYFGDLGDNCQTLIDYFEKYGAPKCPPDANPAEWMLEVIGAAPGSHASQDYYDVWINSSEYVTINHELDIMEQELVKKPKDDSPESMKTFAAPFWYQYKYVTQRVFQQYWRTPSYTYSKVLMSIFSSLFNGFAFFKADKSLQGLQNQMFSVFMFFVLFNTLVQQYLPHFVAQRDLYEVRERPSRTLSWFAFITAQITAEIPWQIASGTLAFFCWYYPIGLYRNAEPTDAVAQRGALMWIIIVLFFIYCSTMAQLCISFNELADNAANLSSLLFTMCLTFCGILASSDSMPRFWIFMYRCNPFSYLVSAILSVALANSDVTCDYNELLRFKPEDGQTCGEYMQTYMSFAGGYLISNDTTVTCEFCTVASTNVYLQQVGADYSKKSRDIGIFVCFIAINIIGTIFFYWLARVPKTSRQKNK

SEQ ID NO: 47502 - protein, 316 aa, Rhodopirellula baltica SH 1
MRELKIFSGRANHDLAEKLCRHLHLKPARITLGQFPDGENYCKLDEDVRGRDVFLVQPTCPPVNDNLIELLTMIDCCKRASAERITAVIPYFGYARQDRKDEGRVPITAKLVANLITRAGADRVLTMDLHAAQIQGFFDVPVDHLYAAPVINDHFVSRRFAGDEVVVVSPDEGSIKRALGHTKRLGGNLAIVDKRRTNALEVRQNTIIGGPVEGKVALMFDDMISTAGSICGAARLVHEAGAKEIHIACTHGVLCGPAIERLREAPIDSITVTDTIPVTGEKLLPNLVQLSVAPLLAEAIKRIHHDQSISELFRER

SEQ ID NO: 47503 - protein, 270 aa, Arabidopsis thaliana
  misc_feature (15)..(15): Xaa can be any naturally occurring amino acid
  misc_feature (44)..(44): Xaa can be any naturally occurring amino acid
  misc_feature (52)..(52): Xaa can be any naturally occurring amino acid
  misc_feature (73)..(73): Xaa can be any naturally occurring amino acid
MASVASSTTLISSPXSSRVFPAKSSLSSPSVSFLRTLSSPSASXASLRSGFXARRSSLSSTSRRSFAVKAQAXDDLPLVGNKAPDFEAEAVFDQEFIKVKLSDYIGKKYVILFFYPLDFTFVCPTEITAFSDRHSEFEKLNTEVLGVSVDSVFSHLAWVQTDRKSGGLGDLNYPLISDVTKSISKSFGVLIHDQGIALRGLFIIDKEGVIQHSTINNLGIGRSVDETMRTLQALQYIQENPDEVCPAGWKPGEKSMKPDPKLSKEYFSAI

SEQ ID NO: 47504 - protein, 175 aa, Triticum aestivum
MAPTVMASSATSVVPFQGLKSTVGLPVSRRSNGASLGSVSNGGRIRCLQVWPIEGIKKFETLSYLPPISREALLKQVDYLIRSKWVPCLEYSKVGFIFREHNASPGYYDGRYWTMWKLPMFGCTDATQVINEVEEVTKEYPDAYVRIIGFDNMRQVQCVSFIAFKPPGCEESGKA

SEQ ID NO: 47505 - protein, 880 aa, Arabidopsis thaliana
MKSIHGFLLFLITAYVILESVQAQDQLGFISLDCGLVPKNATYTEKTTNITYKSDANYIDSGLVGRISAEYKAQLQQQTWTVRSFPEGERNCYNFNLTAKSRYLIRATFTYGNYDGLRQVPKFDIHIGPSKWTSVKLDGVGNGAVLEMIHVLTQDRLQICLVKTGKGIPFISSLELRPLNNNTYLTQSGSLIGFARVFFSATPTFIRYDEDIHDRVWVRQFGNGLKSISTDLLVDTSNPYDVPQAVAKTACVPSNASQPLIFDWTLDNITSQSYVYMHFAEIQTLKDNDIREFNITYNGGQNVYSYLRPEKFEISTLFDSKPLSSPDGSFSLSFTKTGNSTLPPLINGLEIYKVLDLLELETDQDEVSAMINIKATYDLSKKVSWQGDPCAPKSYQWEGLNCSYPNSDQPRIISLNLAENKLTGTITPEISKLTQLIELDLSKNDLSGEIPEFFADMKLLKLIKLNVFICRNLSGNLGLNSTIPDSIQQRLDSKSLILILSKTVTKTVTLKGKSKKVPMIPIVASVAGVFALLVILAIFFVVRRKNGESNKGTNPSIITKERRITYPEVLKMTNNFERVLGKGGFGTVYHGNLEDTQVAVKMLSHSSAQGYKEFKAEVELLLRVHHRNLVGLVGYCDDGDNLALIYEYMANGDLKENMSGKRGGNVLTWENRMQIAVEAAQGLEYLHNGCTPPMVHRDVKTTNILLNERYGAKLADFGLSRSFPVDGESHVSTVVAGTPGYLDPEYYRTNWLSEKSDVYSFGVVLLEIVTNQPVTDKTRERTHINEWVGSMLTKGDIKSILDPKLMGDYDTNGAWKIVELALACVNPSSNRRPTMAHVVTELNECVALENARRQGREEMHTSGYVDFSRSSASEFSPGAR

SEQ ID NO: 47506 - protein, 337 aa, Bifidobacterium longum NCC2705
MSAILEGTPDKRLVLVTGRAYPELAEKVAECLGTEILETTSYDFANGEMYVRFTEPVRGADVFVLQCHSGDINKWIMEQLIMIDALKRASAKSITVVAPFLGYSRQDKKHRGREPITARLIFDLFHAAGADRIMTVDLHAAQEQGFFDGPVDHLTAMPVLLDYVRSTLDLGNTTIVSPDAGRIKVSEQWAAKLGNLPLAFIHKQRDITRPNHAEAHGIIGDVDGRDCVVIDDMVDTAGTICEAVRTLNESGAKSVTLVATHGLLSGPAVERLSHCGAHEIVFMDTVPIPEEKRLPNMTVLSCAPLLAAGIRSVFEEGSVAILLDGLPEDMRPRNIYA

SEQ ID NO: 47507 - protein, 294 aa, Bifidobacterium longum NCC2705
MCAYETTMVGNLRTGAAMTAYMDHKDLANEVIDQARAQEITDGVHRVLDRIASAESAAGRAAGSVQLLAATKTRDVGEILAAIDAGIRVIGENRPQEITVKADGLAKRLGERGYSLGVIDAAEADTANAAAATHIPFHLIGQLQANKIGKVLPVVDTIESVDSIELAEKIARRATMRGITVGVLLEVNESGEESKSGCAPSHAIDLAQRIGAMGGLRLQGLMTIGAHVDDERTIRAGFAHLRRTRDQILASGAEGTADCTELSMGMTHDMAYAIEEGSTIVRVGTAIFGERAFI

SEQ ID NO: 47508 - protein, 254 aa, Oryza sativa
MVGPLGPRPSPLCGGEGEDDEEGGGVMIGPPRPPPRSSSRGEGEDGGEMDEEAMRAFFPMSFGKAPTRAGAAASAHASTLRKPPQNPSAKPSTSSAAAAAAAGDDDDEDDGPMVGPPRPPPQPAGGGEGEDDEEGGGVMIGPPRPPPRSSSRGEGEDADGGVIGPPRPPPVKDDDEEDEDDDDDDDDDGDDSDDEMEDDGERYNRIPLSNEVVLRGHTKVVSALAVDHTGSRVLSGSYDYPVRMYDFQGMNSKL

SEQ ID NO: 47509 - protein, 474 aa, Oryza sativa
MAQQLSAPFRAAAAAGSRASAAAADPAKVSPSLPFLLCSLSLTFFPTPPPEFSGLFRVGVRLAEGWDVFVRCVTSCVADTAPRFRLKLGFRESGNLGLGGGGANAGVRFLFIARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAGIGLSSSFMKLVSWYDNEWGYSNRVLDLIAHMALVNAKH

SEQ ID NO: 47510 - protein, 831 aa, Debaryomyces hansenii CBS767
MPDDKKNLLDASGAQTAEDRTATAILRRKKKDNALIVDDAENDDNSVITMSSNTMELLQLFRGDTVLVKGKKRKDTVLIVLADDDMDDGVARINRCVRNNLRVRLGDIVSIHPCPDIKYANRISVLPIADTVEGITGSLFDVYLKPYFVEAYRPVRKGDLFTVRGGMRQVEFKVVEVDPEEIAIVAQDTIIHCEGEPINREDEENNMNEVGYDDIGGCRKQMAQIRELVELPLRHPQLFKSIGIKPPKGILMYGPPGTGKTVMARAVANETGAFFFLINGPEIMSKMAGESESNLRKAFEEAEKNSPSIIFIDEIDSIAPKRDKTNGEVERRVVSQLLTLMDGMKARSNTVVIAATNRPNSIDPALRRFGRFDREVDIGVPDAAGRLEILRIHTKNMKLNDDVDLEAIASETHGFVGADIASLCSEAAMQQIREKMDLIDLEEETIDAEVLDSLGVTMENFKFALGNSNPSALRETVVENVNVTWNDIGGLDTIKNELKETVEYPVLHPDQYQKFGLSPSKGVLFYGPPGTGKTLLAKAVATEVSANFISVKGPELLSMWYGESESNIRDIFDKARAAAPTVVFLDELDSIAKARGGSHGDAGGASDRVVNQLLTEMDGMNAKKNVFVIGATNRPDQIDPALLRPGRLDQLIYVPLPDEVARLSILQAQLRNTPLEPGLDLLEIAKITNGFSGADLSYIVQRSAKFAIKDSIEAHIRLQKSKADSKQGDDVEMTEESKPAGDEEEEEEEDPVPYITRAHFEEAMKTAKRSVSDAELRRYEAYSQQMQASRGQFTNFRFSEGEGNEGAQSNSTGNENAAAFGNVEEDDDLYS

SEQ ID NO: 47511 - protein, 151 aa, Leptospira interrogans serovar Lai str. 56601
MIQELKADLNGKGQKHCVIVSRFNEFITESLLKGALESFRMHGVEDVTVVRVPGAYEMPMVVSKAAASKKYDSIVCLGAVIRGATAHFDLVAGESAKIGSIGVQHSIPVIFGVLTTDTIEQAIERAGTKAGNKGAEAAATAVEMVNLLSLL

SEQ ID NO: 47512 - protein, 562 aa, Vibrio campbellii AND4
MNNDKRPLYIPYSGPALLATPLLNKGSAFSGEERSSFNLEGLLPETTETIQEQVERAYQQYKSFESDMDKHIYLRNIQDTNETLYYRLVQNHISEMMPIIYTPTVGAACENFSNIYRRGRGLFISYPNRDRIDDLLNNAANHNVKVIVVTDGERILGLGDQGIGGMGIPIGKLSLYTACGGISPAYTLPIVLDVGTNNPQRLADPMYMGWRHPRITGADYDAFVEEFIQAVQRRWPDALIQFEDFAQKNAMPLLERYKDRICCFNDDIQGTAAVTVGSLLAACKAAGTKLSDQRITFLGAGSAGCGIAEAIIAQMVSEGISDQKARSQVYMVDRWGLLQEGMPNLLDFQQRLVQKFNNTKEWQNEGNGFSLLDVIHNAKPTVLIGVSGAPGLFSEEVIKEMHKHCERPIVFPLSNPTSRVEATPNDIIRWTNGEALVATGSPFEPVVHEGRSYPIAQCNNSYIFPGIGLGVLAVNAKRVTDEMLMESSRALATCSPLAINGNGALLPPLEEIHLVSKKIAFAVGKKAIEQGVALEITDEALNDAIDQAFWQPVYRRYKRTAF

SEQ ID NO: 47513 - protein, 389 aa, Sulfitobacter sp. EE-36
MDLRGKRVLVRVDINVPVENGKVTDDTRIQRIIPTLRDILEQGGTPVLLAHFGRPKGKRVQDLSLRVVLPALEDALGRKVVLAETLEAAEAGTEEINAADVLLLENIRFYPGETENDPDFAKRLAGLGDIYCNDAFSAAHRAHASTEGVARLLPSCAGRLMQAELSALEAALATPKRPVGAVVGGAKVSTKIELLENLVNRLDLLVIGGGMANTFLGAQGADLGKSLSEPDFYDTAKDILAQAEKAGCRVLLPVDGLVAREFAAHAAHEVAALGADTVLAADQMVLDAGPKTVELVKDAFNGLKTLIWNGPMGAFEIAPFDTATVAAAKAAAALTRDGALISVAGGGDTVAALNQAGAADDFTYISTAGGAFLEWMEGKTLPGVAALDA

SEQ ID NO: 47514 - protein, 517 aa, Physcomitrella patens subsp. patens
LSLTGWGGDPCLPVPLSWVLCSPVTATAAARVISVRLSRYNLTGIIPVEFAELTALQTLHLNDNGLSGSIPDSLSFIPTLEELFLQNNNLTGTVPDALKNKSGLNLNINGNPVCGPTCSNPGPGSKSNVGLIAGVVGGVVGVLVVGGILLFCFCRKRQTTEGMGQNGTNGQGAKPFSHAEIKAATSNFSTQIGAGGFGPVYYGKLANGREVAVKVSDMNSRQGAAEFNNEVQLLSRVHHRNLVSLLGYCQEDGKQMLVYEYLHKGTVREHLWGSPLATKEPLDWKQRLDVSLNAAQGLEYLHTGCSPIIIHRDIKSSNILLTDKYVAKVADFGLSRLGPEESSGATHVSTVVKGTAGYLDPEFWSTNHLSERSDVFSFGVVLLEVLCGRQPINNGLPDKSQSNIVEWVRNSLLAGDIESILDPAVRDCHPNMDSVWKVAELAIQCVEPRGIHRPWMRDVVKELREAIVLEDGDSGALSEMDRSNNIGTSSTPAPYMEGNSDDVSLNFEHYRKGPQVR

SEQ ID NO: 47515 - protein, 322 aa, Thermosynechococcus elongatus BP-1
MSDQPRPTVIITGASSGVGLYATKALANRGWHVIMACRNLEKAEQAAKNLQIPPEAYTILHLDLSSLASVRGFVESFRALNRPLRALVCNAAVYYPLLKEPIYSVDGYEITVATNHLGHFLLINLLLEDLKNSPESDKRLVILGTVTANRKELGGKIPIPAPPDLGNLEGFEKGFKKPIAMINGKPFKSGKAYKDSKLCNMLTARELHRRFHESTGIVFNSLYPGCVADTPLFRHHFPLFQKLFPLFQKKITGGYVSQELAGERVAMVVADPEFRQSGVHWSWGNRQKEGRKAFVQELSAEASDEQKARRLWELSEKLVGLA

SEQ ID NO: 47516 - protein, 355 aa, Brassica napus
GTRGEEGARNGPSLMPGGSFDAYKNIEDILLKVAAQVRDSGPCVTYIGKGGSGNFVKMVHNGIEYGDMQLIAEAYDVLKSVGKLSNEELHGVFTEWNKGELESFLVEITADIFAIKDDKGDGHLVDKVLDKTGMKGTGKWTVQQAAELSVPSPTIESSLDARFLSGLKDERVQAAKVFKEGGFGDVLTDQTVDKKQLIDDVRKALYASKICSYAQGMNLIRAKSVEKGWGLKLGELARIWKGGCIIRAIFLDRIKQAYDRNAELANLLVDPEFAKEIIERQSAWRRVVCLSINSGISTPGMSASLAYFDSYRRERLPANLVQAQRDYFGAHTYERTDVEGSFHTEWFKIARQSKM

SEQ ID NO: 47517 - protein, 480 aa, Thermosynechococcus elongatus BP-1
MSQQDFGVIGLAVMGENLALNVERNGFSVAVYNRTPARTEAFMAERAAGRRFKATYTLEELVASLSRPRRILAMVKAGQPVDDLIQQLKPLLEPGDILIDGGNSLYTDTERRVAEMESAGLCFFGMGVSGGEEGALNGPSLMPGGSREAYQALEPILTKIAAQVDDGPCVTYIGPGGSGHFVKMVHNGIEYGDMQLIAEAYDLLKNLLGLNHQQLHEVFKSWNETPELNSFLIEITSQIFTYIDPETHLPLVDVIVDAAGQKGTGRWTVESALEMGVAIPTITAAVNARIMSSIKAERMAAAQVLPGPAAHFSGNTEEFIGKIRDALYCSKICSYAQGMALIAKGSQELFDHQLNLSEIARIWKGGCIIRAGFLNKIKQAYSENPQLANLLLAPEFRQTILDKQAAWREVLVEATRAGIAVPAFGASLEYFDSYRRDRLPQNLTQAQRDFFGAHTYERIDKPGTFHTEWVPIQEAGKASV

SEQ ID NO: 47518 - protein, 190 aa, Triticum aestivum
MAAPVLPLQQVKLASLPSTRLTPEQQYWRTFKNPLLIPSPANGPVNLITQPSAPSSSAAFPSLTQPPDVFTVTTGARVQIYSIRTRKLLRTITRFDDTVRGTDVRPDGRIFVAGDDTGKVQVFDVNSRAILKTWTDHKQPVWVSKFSPSDPTALLSASDDRTVRLWDLSSDSSARTFVGHTDYVRSGSYM

SEQ ID NO: 47519 - protein, 77 aa, Geobacter sulfurreducens PCA
MSSIEKRVKEIVAEQLGVDEAQVTNDASFMDDLGADSLDTVELVMALEEEFDIEISDEDAEKIQNVQDAIDYITEHT

SEQ ID NO: 47520 - protein, 186 aa, Brassica napus
  misc_feature (178)..(178): Xaa can be any naturally occurring amino acid
MSDAPDVDDRVDYEDGSSSEMEEEEHVEEYEEEEDDDDNQDAEELDVDGYGGRKGGDREEGQEELAEDEDNNIDIDIETAEDEEKSASHIDEEGKEEYSRLLSLPPHGSEVFIGGLPRNVGEEDLRDLCEPMGDIFEVRLMKDRDSGESKGYAFVGFKTKDVAQKAIEKLHSKEFKGXTLRCSLSE

SEQ ID NO: 47521 - protein, 247 aa, Chlamydomonas reinhardtii
MATRLERREQQDAQRQRKAAASMDEARATNVFLVRHGQTDWNAEMRLQGQLDPPLNSLGVEQAEEVAAALADRPLDAVYSSDLTRAVQTARAVAGRRPGGQTLEVRTSPQLRERSLGVLQGLTIAEAAVQQPEALRLLRSHDPATSVPGGESPGAMRQRVVADIERICEQHRGQSILIVAHGGVLHHVYAHVCGHSYGGPITNASVHHIKVQPPKWALVQWNMGTDTASGDGGGGPHAAFGGGANEG

SEQ ID NO: 47522 - protein, 186 aa, Xanthomonas campestris pv. campestris str. ATCC 33913
MPESAVTPIRPFLEHTPQLGARVYVDPACTIIGKVQLGDDVSVWPGTVIRGDVNSVQIGARTNVQDGTIIHVSHHSPFNKGGYPTVIGEDVTVGHGTILHACTIEDLCLIGMGACVLDNATIKRYGFVGAGAVVGPGKVVGEAELWLGNPARLARRLSDQEIESLHYSAQHYVRLKDQYLGAASAG

SEQ ID NO: 47523 - protein, 132 aa, Brassica napus
MEAPSLTLNLLLLIIVSLLFISLPRSEPLPENPSLVLLGDGFEWPTSHVDAFDIESFDDAGEEEDDDVGVSDRRSLYWKRRRYYISYGALSANRVPCPPRSGRSYYTHNCFRARGPVHTYTRGCSSITRCRR

SEQ ID NO: 47524 - protein, 218 aa, Gracilaria gracilis
SQTRILLAGAVGALVAATCRIPQEVLKQPLQAEIYPNVFVALKETVGKNGIGALYKGSIATISRDIPWNALSFMFHGQGKKMFKSTKGRDPANDENLVIAGVAGALAAIIMTPIDVVKTRIMTQRVGSTVYSGVIGTFSKIVREEGAGTLMKGVIPRIVFLAPLAGITFSVYEAVAANIKKRKTVAEPVAYNSLQEAFMTHLQPGLKERTRTTTLALR

SEQ ID NO: 47525 - protein, 179 aa, Glycine max
LFSAEQLKDLGCKWVVLGHSERRHIIGENDEFIGKKAAYALSQGLGVIACIGELLEEREAGKTFDVCFQQLKAYADAVPSWDNIVIAYEPVWAIGTGKVATPQQAQEVHVAVRDWLKKNVPDEVASKTRIIYGGSVNGGNSAELAKQEDIDGFLVGGASLKGPEFATIVNSVTSKKVAA

SEQ ID NO: 47526 - protein, 209 aa, Prochlorococcus marinus str. MIT 9211
MSDTPNKNQTKETSSAVPAAAEGQQQQQRKGGGNRGEKRNRRSGRNQERDSEWQERVVQIRRVSKTVKGGKKMSFRAIVVVGNEKGQVGVGVGKAGDVIGAVRKGVADGKKNLVKVPLTRNSSIPTLSNGRDGAASVLIRPAAPGTGVIAGGSIRTVLELAGIKNVLAKRLGSKTPLNNARAAMVALAELRTHKGTAKERGISLEQIYS

SEQ ID NO: 47527 - protein, 312 aa, Frankia sp. EAN1pec
MAEAPERRRWSAADVPDLNGRTAVVTGANSGIGFEAAKLLAGRGATVVMACRNPVKAQDALDTIRIAVPEADVSVLQMDLSSLTSVRKAADALVTERPVIDLLINNAGVMLLPQGKTEDGFEQHFGINHLGHFAFTGLVLEAVTASDAGRIVTVSSNGHRMGKIDFDDLDLAQKYRPFRAYARSKLANLLFTYELQRRLTAAGGSARSVAAHPGGANTEVGGNPSPVQRKLKKVVDHIPNPIVHSAFKGSLPLLRAAVDPSTRGGEYYGPSGLLKMTGHPVLVTSNAASRDTGTAERLWELSERLTMVTYPL

SEQ ID NO: 47528 - protein, 154 aa, Pisum sativum
MDVGQMRRQWMDYIKTMFEEGFLDGQFLQLQQLQDENNPEFVFEVVSLFFDDSERILKDLSFALEQQSVDFKKVDAHVHQFKGSSASIGAQGVKNACIAFRNFCEEQNIDACRRCLQQVKQEYFVVKNKLETLLRLEQQIVAAGGSIPTMELSF

SEQ ID NO: 47529 - protein, 536 aa, Physcomitrella patens subsp. patens
LNLTGWGGDPCLPVPLSWVLCSPVTATAAARVISVRLSRYNLTGIIPVEFAELAALQTLHLNDNGLSGSIPDSLSFIPTLEELFLQNNNLTGTVPDALKNKSGLNLNINGNPVCGPTCSNPGPGRKSNVGLTAGVVGGVVGVLVVGGILLFRFCRKRQTTKGMEQELPKSNSDPYKSGGKGKGKGKGGAKPFSHAEITAATLNFSKQIGAGGFGPVYYGKLANGREVAVKVSDMSSRQGAAEFNNEVQLLSRVHHRNLVSLLGYCQEDGKQMLVYEYLHKGTVREHLWGKPFIEQPQWFLNCPLVLVYSGLEYLHTGCSPIIIHRDIKSSNILLTDKYVAKVADFGLSRLGPEESSGATHVSTVVKGTAGYLDPEFWSTNHLSERSDVFSFGVVLLEVLCGRQPINNGLPDKSQSNIVEWVRNSLLAGDIESILDPAVRDCHPNMDSVWKVAELAIQCVEPRGIHRPWMRDVVKELREAIVLEDGDSGAFSEMDRSNNTGTSIIPAAFKRGNSDDHYFVMDSSSNLEQINVGPQVR

SEQ ID NO: 47530 - protein, 539 aa, Physcomitrella patens subsp. patens
LNLTGWGGDPCLPVPLPWVLCSPVTATEAARVISVRLSRYNLTGIIPVEFAELTALQTLHLNDNGLSGSIPDSLSFIPTLEELFLQNNNLTGTVPDALKNKSGLNLNINGNPVCGPTCSNPGPGSKSNVGLIAGVVGGVVGVLVVGGILLFRFCRKRQTTKGMEQELPKSNSDPYKSGGKGKGKGKGGAKPFSHAEIKAATSNFSKQIGAGGFGPVYYGKLANGREVAVKVSDMNSRQGAAEFNNEVQLLSRVHHRNLVSLLGYCQEDGKQMLVYEYLHKGTVREHLWGSPLATKEPLDWKQRLDVSLNAAQGLEYLHTGCSPIIIHRDIKSSNILLTDKYVAKVADFGLSRVGPEESSGATHVSTVVKGTAGYLDPEFWSTNHLSERSDVFSFGVVLLEVLCGRQPINNGLPDKSQSNIVEWVRNSLLAGDIESILDPAVRDCHPNMDSVWKVAELAIQCVEPRGIHRPWMRDVVKELREAIVLEDGDSGAFSEMDRSNNTGTSIIPAAFKRGNSDDHYSVMDSSSNLERINVGHQVR

SEQ ID NO: 47531 - protein, 766 aa, Burkholderia vietnamiensis G4
MKQTETQQQAAYDYHEFPTPGKISVVASKPLVTQRDLALAYTPGVASVCESIAAEPLNAHRFTSRGNLVGVITNGTAVLGLGNIGALASKPVMEGKAVLFKKFAGIDVFDIEINETDPDKLVDIIAGLEPTFGGINLEDIKAPECFTVERKLRERMKIPVFHDDQHGTAITVAAAFINGLKVVGKSISDVKVVTSGAGAAALACLDLLVDLGLPIENVWATDIEGVVYRGRTTLMDPAKERFAQETDARTLAEVIGGADIFLGLSAGGVLKPEMLSAMAARPLILALANPTPEIFPELAHATRDDVVIATGRSDFPNQVNNVLCFPYIFRGALDVGATTITREMEIAAVHAIAGLAQEEQSDIVAAAYGGDEVSFGPQYLIPKPFDPRLIVRIAPAVAKAAIEGGVATRPLADLDAYVEQLQQFVYHSGAFMKPLFAAARQLVRDGGKARIVFTEGEDERVLRAVQVIVDEKLARPILVGRPEVLLARIERFGLRLRLGQDVEVTNPEYDERFPQYWTTYWELRCRDGISKEMARVEMRRRLTLIGAMMVRLGDADGMICGTVGEYHNHLRFVDEVIGRKPDASTYAAMNILLLNQRTVALVDTHVNDNPDAEQIAEFTIAAARQMEWLNLTPKVALLSRSNFGSGSAASGAKMRNALEIIRAQAPDIQADGEMHGDCALDESLRLRLLPMSPLKGAANLLVCPNVDAGNIAYNLLKTEAGSNVAVGPFLLGVNAPVNILTSSATVRRIVNMTALTVIEANRNAAA

SEQ ID NO: 47532 - protein, 384 aa, Burkholderia vietnamiensis G4
MPDSLPEANVPGLLPDVDRDGLLEYSVVYTDRSINHMSQRFQHVMRDISAALKQVYHAKAVAIVPGSGTFGMEAVARQFATNRKCLVIRNGWFSFRWSQIFEMGGIPSEAIVLKARPVEPGRQAAYAPAPIDEVVAAIREHKPDLVFAPHVETASGMMLPDAYLRAVADAVHAVGGMFVLDCIASGTVWVDMEATGVDVLISAPQKGWSASPGCGLVMLGALARERIDATTSTSFACDLRKWLQIMEAYENGGFAYHATMPTDSLATLRDVIAETQAYGFDKVKAEQLELGARIRALLAQKGFRSVAAEGFEAPGVVVSYTDDDGIRSGKKFADVGVQIAAGVPLQCDEPADFKTFRIGLFGLDKLHDVDAAVARFAAALERIV

SEQ ID NO: 47533 - protein, 178 aa, Zea mays
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 47534 - protein, 199 aa, Klebsiella pneumoniae subsp. pneumoniae MGH 78578
MHLVKTILTAGLLLSAAAQAHNVLEFPQPENNPEEFYAVTEIPTGGIVKYETDAKTGFIVADRFQSMPVAYPANYGSLTQSLAGDGDPLDVVYYTRAPMAPGTLIKLRAIGVLKMIDGGEKDDKIIAVPASKIDPTYDDIKTISDLPKIEQQRLEAFFRVYKELPEGRKKVELAGFNDAAAAKQEIKSAWEAWKAKNPQ

SEQ ID NO: 47535 - protein, 336 aa, Klebsiella pneumoniae subsp. pneumoniae MGH 78578
MKAAVVTHDHQVNVTEKTLRPLEYGEALLKMECCGVCHTDLHVKNGDFGDKTGVILGHEGIGVVQKVGPGVTSLKPGDRASVAWFFEGCGHCDYCNSGNETLCRSVKNAGYTVDGGMAEECIVTANYAVKVPDGLDSAAASSITCAGVTTYKAVKVSHIKPGQWIAIYGLGGLGNLALQYAKNVFNAKVIAIDVNDGQLELAASMGADLTINSRNEDAAKVIQEKTGGAHAAVVTAVAKAAFNSAVDAVRAGGRVVAVGLPPEAMSLDIPRLVLDGIEVVGSLVGTRQDLVEAFQFAAEGKVVPKVTLRPLEDINAIFKEMEQGQIRGRMVIDLRS

SEQ ID NO: 47536 - protein, 311 aa, Salmonella enterica subsp. enterica serovar Paratyphi A str.
MALPIIIDCDPGHDDAIALVLALASPELEVKAITSSAGNQTPEKTLRNVLRMLTLLKRPDIPVAGGAVKPLMRELIIADNVHGESGLDGPALPEPSFAPQSGTAVELMAKTLRESSQPVTIVSTGPQTNVALLLNSHPELHAKIARIVIMGGAMGLGNWTPAAEFNIYVDPEAAEIVFQSGIPVVMAGLNVTHKAQIHAADIERFRAIGNPISTIVAELLDFFMEYHKDEKWGFVGAPLHDPCTIAWLLKPEIFTTVERWVGVETQGKYTQGMTVVDYYFLTGNKPNATVMVDVDRQGFVDLLAERLQYYA

SEQ ID NO: 47537 - protein, 167 aa, Cryptococcus neoformans var. neoformans JEC21
MAEKKQTVILTTSDDEQFTVEKIVAERSAMIKSMMEDLGDQEGQPIPLPNVSSSVLTKILEYCDHHKNDPLPTGDANDADDSRRKTSEIGDWDARWIQVDQEMLFEIILAANYLDIKPLLDVGCKTVANMIKGKTPEEIRKLFNITNDFTPEEEEQIRKENEWAEDR

SEQ ID NO: 47538 - protein, 440 aa, Vibrio angustum S14
MSSDTGTKKMGLVGLTVLVAVNMMGSGIIMLPASLAQVGAISMLSWVVTALGAMCIAYTFAKCGAFCKRSGGMSAYAEEAHGKSSFFISSYTYYVCLVISCVAIAVSAVGYIKPFMPWLDTPVHTFFGVCAILIITMVANFGGPKITGQISAFTVWGIILPVLGLSVIGWWWFDPQTFMSAWNPHHDTTMHSVSSGIALTLWAFLGIESAGANSDTVENPERNVPLAVLFGTGFAAVIYIASTGVIQGIIPNAELAASTAPFGLVFSHMFNPTVGNIVTLAAVIACIGSLLGWQFTNAQVSKSAAEEGLFPKIFAKTNKAGAPIAGMLIMLVAELLLAVMTISPNLISQFNALLNLAVFINMVPYILSMTGLEVLLRKNKVTPKQYRLGAVVGTLAVIYSIYGVYACGATAVFGGTILMLFGYIFYGFIAARDVKPLESN

SEQ ID NO: 47539 - protein, 247 aa, Geobacter sulfurreducens PCA
MRTLVLIRHGESVWNRENRFTGWTDVGLTDKGAAEALRAGRTLKNEGFAFDEAFTSVLKRAIKTLWIVLEEMDQMWIPEHRHWRLNERHYGALQGLNKAETAERHGMEQVHVWRRSYDIPPPPLAAGDPRNPARDPRYAELDPADIPLTESLKDTVARFLPYWHETIAPRILAGRRLLIAAHGNSLRALVKYLDGIGDDAIAGLNIPTGIPLVYELEDDLHPIRSYYLGDPDEVARATQSVADQVKR

SEQ ID NO: 47540 - protein, 187 aa, Xanthomonas oryzae pv. oryzae KACC10331
MSLINTQVQPFKANAYHNGNFIEVTEASLKGKWSVLIFMPAAFTFNCPTEVEDAADNYAAFQKAGAEVYIVTTDTHFSHKVWHETSPAVGKAKFPLIGDPAHKLTRAFGVHIEEEGLALRGTFIINPEGVIKTLEIHDNSIARDVTETLRKLTAAQFVANNPGQVCPAKWKEGAKTLAPSLDLVGKI

SEQ ID NO: 47541 - protein, 384 aa, Oryza sativa
MERALMSLMRRRSLLQSGGRAPPAMAAAAGGSPFFSTLQQAAAADPVQSPGILPGLKIRDSASQLIGRTPMVYLNKVTEGCGARIAAKLEFLQPSFSVKDRPAISMLEDAEKKGLITPGKTTLIEPTSGNMGIGLAFMAALKGYELILTMPSYTSLERRVTMRAFGAKLVLTDPTKGMGGTVRKAAELYENHPSAFMLQQFENPANVKVHYETTGPEIWEDTLGQVDIFVMGIGSGGTVTGVGKYLKEKNPNAKIYGVEPAEANVLNGGKPGPHLITGNGVGFKPEILNMDIMEKVIEVKGEDAVKMARELALKEGLLVGISSGANTVAALELAKKPENKGKLIVPMRLFFQTVLPSLGERYLSSALFEELRAEAEAMQPVPVD

SEQ ID NO: 47542 - protein, 359 aa, Plectranthus barbatus
MSLIASPFPTWPLTKLKKPPTNSNLFSSTTKSIRRPSWEFLIPTRPSATVAVLVKEDSNKFSLNNFDFEAYMKEKAERVNRALDAAVAQREPRWIHESMRYSLLAGGKRVRPLLCIASCELVGGDERTAMPAACATEMIHTMSLIHDDLPCMDNDDLRRGKPTNHKVYGENVAVLAGDALLALAFEHVAAATEGVAPERVVRAVVEFGRYIGSEGLVGGQVVDIHSEGLAEVGVEQLEYIHLHKTAALLEAAVVMGAILGGADDEAVEKLRKFARCIGLLFQVVDDILDVTKSSEELGKTAGKDLLTDKTTYPKLLGLEKSREFAEKLRADACDQLVGFDPARAAPLIALANYIAYRNN

SEQ ID NO: 47543 - protein, 265 aa, Zea mays
MAPAPAAASAGRKSHVTVLLLYVVCGLILLLLLASYSPRLQPHAHGRSLHRRLKLHPKSSLPSDASSGGNGGQQKTQHQNHHAASFDPTIAELERRLDDKEWEREHYSLLHGGEPDDHMKEWEEFLKEEEDFINDDDRFNIADRIRALFPKIDVAPQDGFVSLDELTAWNLQQARADQHHRSAREMELYNKNGDEIVSFEAFNALRQESHGEGNMLGFEWWKEDHFNASDANADGFLDKTEFNDFLNPSDSDNPKIINLLCKQEI

SEQ ID NO: 47544 - protein, 503 aa, Xanthomonas campestris pv. campestris str. ATCC 33913
MDPQPAGGSTMHALPSIATPTTATPAWHGCIFNGDWVPGSGGTLQIHEPATGGLLHEVGKADLSDVEAAIAQAKHAQRAWAITSPRERAAVFHRAAQLMEAHRAEATLLIARETGGIMPKAEREVSEAIAYYQQAAGLPLQAMGQVLPTAAGQLSLARHLPLGIIAVISPFNFPLILSLRSVAPALAMGNAVILKPDPRTPYTGGVIIAQVLEEAGLPKGLLHVLHGGADIGQALVEAPDVPMIAFTGSTAAGRRIGELAGRHLKKVALELGGNNAVIVLDDADLERAASAIAFGAYLHQGQICMATGRVLVQRGVADALTKLLADKARHLPVGDPVSGTVALGPIIGQRQLQRVLDIVDDSIDAGAVVEAGATHDGLFYAATVLSNVRPGMRVFDEEVFGPVINITVFDTDEEAAVLANHGEYGLVAGIMSASVSRAMVLGEQLHTGLLHINDQTVADEVINPFGGTGASGNGTSVGGPADWEQYMHWQWLTIKHAVPQYPF

SEQ ID NO: 47545 - protein, 92 aa, Glycine max
ATFTGLKSMAGLPIRKTNRVISCTASNGGRMQCMQVMSPLGTKKFETLSYMTDLDDAQSAKEVEYLFTKGWINCLEIQLEHRVLYLEHNMSP

SEQ ID NO: 47546 - protein, 520 aa, Physcomitrella patens subsp. patens
MATKTDIAHILGLDANEDDGHLKISKTKIVCTLGPKSREVHVLEKLLRAGMNVARFNFSHGTHEYHQYTLDSLRQAMANTQTMCAVLLDTKGPEIRTGSLAAGKPIQLKRNNEIWITTDYSHLGDENMIAMSYAKLAVDLEPGNTILCSDGTITMTVLDCHPEKGMVKARCENTAMLGEKKNVNLPGIVVDLPTITQKDIDDIMQWGVPNKIDFIAASFVRKGSDVVTIKKLLGEASDSIHVISKVENQEGLVNFDDILKETDGVMVARGDLGMEIPTEKIFLAQKMMIYKCNSAGKPVVTATQMLESMIKSPRPTRAEATDVANAVLDGTDAVMLSGETANGSYPELAVAVMSQICQEAEAALDYASIFKEIMKSVPLPMSPLESLASSAVRTANKVRASLIIVLTRGGSTARLVAKYRPCVPILSVAVPVMTTDGLEWTFSAPSPAHHSLCCRGLIPLLAEGSAKATDSESTEEILNAAVKYALKRKLCLVSDSVVALHRIGVASVIKIIEVKDLASS

SEQ ID NO: 47547 - protein, 324 aa, Methanopyrus kandleri AV19
MRSEILKELNRARELVDAKIEEVLPRGGPEDLYDACWHLIEAGGKRIRPLLAIKSCLMLGGSEEDVLPEAVAVELIHTFTLIHDDIMDEDDERRGVPAVHVKWGVPVAILAGDTLFSKAFEVAAEGGDVEAVKELARACTEICEGQAMDIGFENRTEVTEDEFLEMIRKKTAALIRTSCVVGGLKAGANREQLEALREYGENLGIAFQIQDDVLDLVGDESELGKPVGSDIVEGKKTLIVIKGLELADEEQRERILSVLGNEDASREDVREVIQILEDLGAIDYAKKRAREYADRAKAALRELPENEHREFLEKLADFVVEREF

SEQ ID NO: 47548 - protein, 562 aa, Nanoarchaeum equitans Kin4-M
MYKEIIAYLKLKYGKVKPQSVIGKIIAKNPELKAKIKELIPIIEQEIKEVEQMDIEQIKELAKAYEQTIEKKEKDIEIPVKDKVITRFAPNPSGLLHIGHARAIVLNHYIAKKYNGQFILRIEDTDPDVKKPMIEAYELIPKDVEWLIQEKPDKIVVQSDRLDIYYKYIEELIKQGKAYVCLCKAEEFREYRNKGLPCPHRNQSIEENLELWSKMLKGEFKKGEAVVRLKTDLTHKDPGVRDFPIARIVENPHPRIGYKPVFPLYNFAVVIDDHLLGITHVIRMKEHTNNAIKQSFIYKAFGWEEPIYLEYGALLTDMPTHKSEIRKLIEQKQIEGWDDIRLPTLIALRRRGILPEAIYEYIVKDVGLNKADIKVDWNKIYYYHKIRIDKQTPRYFMIRDPIAIVIENYDDIIDKFEIKNGIPYKKISKHPDVDLGYRELPIKEVLYIDKRDAERLKQKPLRLFELFNIKFVGEIEIEYGDEYSKTKEKAYAVRVISFDVQEAIKNKYPIVQWLPEYEETTLFELDGYKKAYVEPNIKENYVHFIREGYYKRENDKWIFSVK

SEQ ID NO: 47549 - protein, 508 aa, Xanthomonas campestris pv. campestris str. ATCC 33913
MGETYDLLVIGGGINGVGIARDAAGRGLSVCLCEQDDLAAHTSSASTKLIHGGLRYLEQYEFALVGKALAEREVLLRLAPHIIWPLRFLLPHQPHLRPAWMIRAGLFLYDHLGGSKRSLPRSRRLSLRTHPVGQPLQESLRTGFVYSDAWVQDARLVVLNAMDAAKRGAQIHTRTRCVGAWRDAGFWYAELEGCDGRRRTVQSRALANAAGPWAVSFLDKVAAVPHQHALRLVKGSHIVVPKLFDHDHAYIFQQPDRRIVFAIPYEHDFTLIGTTDVDYEADPSAPKIDAAEVQYLCDAVNLYFQQQITPQDVVWNYSGVRPLLDDAEDNAAEVTRDYQLEVLTDGAPLLNVFGGKLTTYRKLAEEAVDRLTQALGARKPAWTARGEALPGGEQRDIASLLERVRTARPWLPAATAQRLVRNYGTCAEQLLGDAQDMAALGQHFGADLYQAEVDYLCAREWAQTADDILWRRSKLGLRVDAEARARLEAYLQTRPAAHANAQTHVVPA

SEQ ID NO: 47550 - protein, 308 aa, Silicibacter sp. TM1040
MNTPQILCLGEPLVEFNQTPEGPFAMGFGGDVSNVAISAARHGAQTGLITRVGDDPFGAALCDLWANEGLVTDHAARAQGEETGVYFVTHDASGHHFTYRRKGSAASRLTPQDLPMNALQTCPIFYASGISLAVSSSMQDAVIEAAQQARAGGGIFAFDPNLRVALWPLEVARETTHRCMQICDVALPGLEDARQLTGLHDAKDIASFYHELGPRIVALTLGAEGVLISVEGTQRVLSGHRVDAKDATGAGDCFNGAFLATLLATNDPFSAAEHANMAAALSTTGYGAVTPIPTLSQTRSALETAQRA

SEQ ID NO: 47551 - protein, 175 aa, Nanoarchaeum equitans Kin4-M
METLLMIKPDGVKRKLIGKIIERIENAGLEITDIKMLQFTREMAEQFYVFPESWYEKVGNKLIKIFEEKGLDIEQVYKTRDPIEIGKKVREALIEYILSGKVVAIRIKGDKAIEKVRTLIGDTDPLKALPGTIRGDFSSDSIEVANLEGRAVYNVVHASDSEENAKRELKIVFGY

SEQ ID NO: 47552 - protein, 555 aa, Bifidobacterium longum NCC2705
MRTRLRTRLAQRTAQHTQCGPNRSPNRISPLAIDSRRRLPLYIMSESPNWSNPLRDSRDLRLPRIAGPCSLVIFGVTGDLAQKKLLPAVYDLANRGLLPPSFGLTGFARRDWTQERFIEFVKAAVQAHCRTPFKESTWRNLAAGIRFVQGTFDDPEAFERLSATVQELDRDRGTQGNHAFYMSVPPRAFPQVAKQLAASGLSRSSEGAWRRVIIEKPFGHDLASAKELDSVVSEVFDPSSVFRIDHYLGKETVQNLLALRFANAMYEPIWNANYVDHVQITMAEDIGIGGRAGYYDGIGAARDVIQNHLLQLMALTAMEEPVSFTAKDLTAEKTKVLSAVRLPKDLAANTARGQYAKGWQGSHEVVGYLEEKGIDPKSTTETYAAIRLDIDTRRWAGVPFYLRCGKRLGKRVTEIAVVFKRAPHLPFEQTAVRELGKNAIVIRVQPDEGVTMRFGAKVPGGSTMEVRDVNMDFSYGRSFTENSPEAYERLILDVLLGDPPLFPTTEEVNLSWEILDPIEQFWSTLGQPQAYRAGTWGPAQADEMLARDGRHWRMP

SEQ ID NO: 47553 - protein, 335 aa, Methanopyrus kandleri AV19
MAYKIAVIPGDGIGPEVIEAALHVIEPLIDAEFVEGEAGDECAEKHGDPLPEDTLELCHEADAILFGAAGETAADVIVRLRQELDLYANIRPVRGFPGLRELTGEPYVRDDVDFVIVRENTEGLYSGIEGRFRDTAYTLRIITEEGTRRIAEVACDLAEERGSNTVTCVHKANVMRETCGLFREVCKEVVESRGLEFEEYYVDAAAMFMITEPERFDVVVTPNMFGDILSDEAAALVGGLGLAPSGNVGDRHGLFEPVHGSAPDIAGKGIANPFATILSAVMMLEWLGEDEAAEAVREAVGEAIREGVVTPDLGGDKKTMEVAEFVREAALNRVQ

SEQ ID NO: 47554 - protein, 458 aa, Listeria monocytogenes EGD-e
MAQTSTIQNDTKAAEEYAARVFETIKQRNPGETEFHQAVEEFLNSVIPALAKEPKYEANGILEQLTEPERLISFRVPWVDDSGTVHVNRGYRVQFNSAIGPYKGGLRFHPSVTGSIVKFLGFEQIFKNSLTGLPIGGGKGGSDFDPKGKSDSEVMRFCQSFMTELQKHIGPDTDVPAGDIGVGGREIGYLFGQYKRLRGAYDAGTITGKGLSYGGSLARTEATGYGLVYFTVEMLEAAGETIRGKKIVVSGSGNVAIYAIEKAHELGAKVVACSDSAGFVYDKEGIKVETVKQLKEVERKRISEYTTIHPSAEYYAGGDVWSVPCDIALPCATQNEINADQARALVKNGVIAVAEGANMPSTLDAVDIYHENKVLFGPAKAANAGGVAVSALEMAQNSTRMSWTFQTVDEHLQNIMKDIYKNSSNAASEYGAPGNLVIGANIAGFLKVADTMISQGII

SEQ ID NO: 47555 - protein, 506 aa, Silicibacter sp. TM1040
MTTPKPVVLCILDGWGSAEPGPANAPYLAKTPTLDAIMQSCPTARLVTHGPDVGLPSGQMGNSEVGHTNIGAGRVVAMDLGQIDLAIEDGSFYDNDALQAFIAKLKETGGAAHLMGLVSDGGVHGHVTHILAAIKAIRDAGVPVWLHAITDGRDVAPKSALTYLDQLEAGMAPGAQIATVTGRYFAMDRDNRWERVSEAYDAMVKGAGQFTAATARDAVENAYGRDELDEFVKATVVEGFDGIKEGDGFFCLNFRADRAREILRAIGEPGFAEFDTGPRPALAALLGMVEYSEGHNAYMTTAYPKRAIVNTLGEWVAKQGKRQFRLAETEKYPHVTFFLNGGKETPEVGEDRFMPKSPKVATYDLQPEMSAPEVTAKFVEAIRAGYDLIVTNYANPDMVGHTGDLDAAIKACEAVDQGLGEVVAALKDAGGAMIVTADHGNCELMVDPETGGAHTAHTTNLVPVALVGGPEGTALKDGRLADLAPTLLALMGLDQPEEMTGESLLV

SEQ ID NO: 47556 - protein, 171 aa, Leifsonia xyli subsp. xyli str. CTCB07
MTIVTLADGSTPTLADDAFVAAGAVLSGRVRLDAGSSVWYNAVLRAEAEEIVLGARSNIQDNVSCHVDHGYPLTIGADVNVGHNAVLHGCTIEDGVLVGMHATVLNGAVVGAGSLLAAGTVVLEGAVIPPGSLVAGVPGKVRRELTEDERAAIRQNAEAYLRHIGEHPAAV

SEQ ID NO: 47557 - protein, 489 aa, Physcomitrella patens subsp. patens
MSTNGENGYYKEYDYDLIAIGAGSGGVRAARFASQFGANVAVCEMPFAPISSDEAGGVGGTCVLRGCVPKKLLVYGANFPHDFESSRGFGWSFETEPKHDWKTLITNKNAELNRLTGVYKSLLQKSEVDLIEGRGKIVDAHTVEVKGKQYTTQHILVSVGGRATVPNIPGKENAITSDEALNLSERPNKICIVGGGYIALEFAGIFAGLGTEVHVFVRQPKVLRGFDEEIRDFIAAQLQAQGIVFHFGESPTAIEKRNDGTFCLVTDSGKEVSDLVMFATGRAPNTKNLGLEEVGVKLDKRGAIEVDSFSRTNVDSIWAIGDVTNRINLTPVALMEGMAMAKTAFGNEPTKPDYRFIASAVFTQPPIGTVGYTEEQAVEKFGDVDVYTSTFRPMKATLSGLPEKTFMKIIVDASSDKVVGIHMCGDETPEILQGFAVAVKAGLTKKMFDSTVGIHPTAAEELVTMRTPTRKIRKKSEQTGVSACTFVSF

SEQ ID NO: 47558 - protein, 473 aa, Carboxydothermus hydrogenoformans Z-2901
MNVGRVVQVIGVVVDVEFEPGKVPPIYNALKIRSEDQDTPTEVPINLTLEVAQHLGNNRVRAVAMSSTDGLVRGMKVVDTGAPITVPVGRPVLGRLLNVLGEPIDGKGPVESDHYYPIHRPAPPLEEQSTRAEILETGIKVIDLLVPFLKGGKIGLFGGAGVGKTVIVMELINNIAKQHGGISVFAGVGERTREGNDLYHEMKEAGVLDKTIMVFGQMNEPPGVRLRVGLTGLTMAEYFRDEEGQDVLLFIDNIFRFTQAGSEVSALLGRMPSAVGYQPTLATEMGQLQERITSTRKGSITSVQAVYVPADDLTDPAPATTFAHLDATVVLSRQIAELGIYPAVDPLDSTSRILDPHIVGEEHYQVARGVQRVLQRYKELQDIIAILGMDELSDEDKLIVARARKLQRFLSQPFTVAEAFTGRPGKYVPVKETIRGFKEILEGKHDDIPETCFYMAGTIDEVVERARELEGSA

SEQ ID NO: 47559 - protein, 413 aa, Arthrobacter oxydans
MPVVRQTAAEEAQATGRRRPSFHTLAVKEVRRLTDDAIEVSFHVPAELAGQFDYLPGQYVALRTTLPDEAGEPKEIRRSYSICAEPRSFEDGTSEIRVAIKKDLGGLFSTWANAELKAGDTLDVMSPMGAFVSRHGRDGQAVEQNRMNSMNNPEELAGDVASQGEANFVAIAAGSGITPVIAIARTLLAANPECRFDLIYANKAAMDVMFLEELADLKDKYPQRLAIHHVLSREQRIAPLLSGRIDSEKLQQLLGTAIHADDVDEWFLCGPFELVQLCRDTLADRGVKPENVRFELFTSGKPDKPEGNAGRPVLVDESKETYKITFKLDGLQGEVASPTHARESILNAALRVRPDVPFACAGGVCGTCRAKVVTGSVTMDENYALEQDELDKGYVLTCQSHPTSKEVTVDFDV

SEQ ID NO: 47560 - protein, 167 aa, Arthrobacter oxydans
MTTGKAITKAVIPAAGLGTRFLPATKAMPKEMLPVVDRPAIQYVVEEAVKSGLTDLLMITGRNKRSLEDHFDREPGLERALELKGDKDKLESVQYASELGPIHYVRQGEAKGLGHAVLCAAQHVGDEPFAVLLGDDLIDEAEDLLTTMMEVQQKTGGSVIALIEVDP

SEQ ID NO: 47561 - protein, 275 aa, Rhodococcus sp. RHA1
MTNLDGKVAVVTGAASGIGAATARAFAERGARVVVADIDDPRGQAVAAGLGDRGAYLHTDVRNEADVEAAVAVAVDRFGRLDCMVNNAGRVGAWTFLEDTSLDEWENGFAMLARSAFLGTKHAARVMRGQGSGSIVNVSSVAGIRTGFGPHPYSAAKAAVLQLTRTAAVELAEYRIRVNALIPGGVATRIVGHGAGLEDDALDRSVDAVRRSLTNFQPIPRAGEPEDLAHAAAYLASDDSTFVTGQSLGVDGGLTLGKKWPSNYRDEAQAASTLR

SEQ ID NO: 47562 - protein, 534 aa, Chromobacterium violaceum ATCC 12472
MSRIESRLPASGEAYERNMAAYGQLRGQIAAARDAALQGGGADARAKQAAKGKLSPRERLSLLLDPGTPFLEIGQLAGHEVYDHAVPCAGIVTGIGIVSGHAVAVFANDASVKGGTYYPLTLRKHLRTQDIARELGLPCLYLVDSGGVYLPLQEEIFPDEHHFGRIFRNIAEMSALGLPQISAVLGSCTAGGAYIPAMSDETIIVRGNGSIFLGGPQLVRAATGVIVDAETLGGADVHTRDSGVADHYALSDEHAIQLLRDIVARRGVGRQYAPPQAPRPPRHDPAELPGIISANPREHIPAREILARLLDDSAFAEYRARFGTSILCGTGHIGGYPVGVLINDGVLFSESAQKAANFIEICSQRGIPLLFLHNINGFMVGAEYEAGGIAKHGAKMVNAASCARVPKFSILIGGSYGAGNLAMCGRAIGPQLMAMWPNAKTTVVGGEQAATVLALIRAEQLEKQGKSWTAEEEEAFKRPIREAYERQGQALYVASRLWVDAIVDPAQTREWLALSLALAAAAPVRETRFGVFRM

SEQ ID NO: 47563 - protein, 204 aa, Zea mays
KLHVDGWRTNRIGDFGFMAVARGCPNLQELVLIGVNPTVLSLRMLGEHCRTLERLALCGCETVGDAEIICLAERWAALKKLCIKGCPVSDRGMEALNGGCPSLVKVKLKRCRGVSYECIENLKVTRGGSFSFSLDIVLEHDARSASENGAQENGQAQIIALTDQMAGMDLPVNAAGAQSSIHTITRMRSVVSALRRRFGNPPPP

SEQ ID NO: 47564 - protein, 654 aa, Geobacter sulfurreducens PCA
MAIRYIDEISELKDKKVFIRVDFNVPLDEHQNITEDTRIRAVLPTINFALDAGAKVVLASHLGRPKGERKPKYSMAPAAKRLSRLLGKEVLLAPDCIGSEVRQMIDAMKSGDIIMLENVRFYEGEEKNDENFARELANGCEIYVNDAFAVSHRAHASVEAITKFFPVVAAGFLMKNEMNYFEKAMQKPIRPLVAILGGAKVSGKLEVLESLLNKVDKIIIGGGMAFTFLKALGYNVGKSLVEEDLIETARSTYAKAREKGIKFYLPVDCVAADRFNPEAETKVTTIQEIPEEWMALDIGPATVALFTEALQSAKTIIWNGPMGVFEMDAFSRGTFAMVTAVANSYALTIVGGGDTDSAVHRAGEYAKISYISTGGGAFLELLEGKKLPRHQGAGRKRKIGGAAMRTPVIAGNWKLFKKRAEARELVNGLVSLVKDVQGVEIVVAPVFTVLAAVKGALDGSAIKLAGQDCFWEEEGAYTGEISPGMLVDAGCSHVIIGHSERRQYFGETDETVNRKIKAALKAGLAAIACIGESLAEREAGTTFDVLRTQLNGGLAGLSADDLKDVIIAYEPVWAIGTGKTATDAQAQEAHAFIRGVVSELLGKPAAEAVRILYGGSVKPENIKGLMTQPDIDGALVGGASLKADSFAAIASFSM

SEQ ID NO: 47565 - protein, 333 aa, Geobacter sulfurreducens PCA
MALRVAINGFGRIGRSVLRAAAKEKGIEIVAINDLTDAKTLAHLLKYDSVHGPFPGKVEVGDGAIVVNGKPITIIAERNPELLPWKKMKIDVVLEATGLFTAREKAELHLKAGAKKVIISAPATNEDITIVMGVNHDAYDPKKHNIISNASCTTNCLAPVAKVLHETFGIEKGLVTTVHSYTNDQQILDLPHKDLRRARAAAMSMIPTTTGAAKAVSLVLPELKGKLDGMAIRVPTPNVSVVDLVVTLKKKTDAEKVNAALKKAAKGSLKGILRFEEEPLVSIDFNGTTHSSIVDALSTKVIDGTMVKVLSWYDNETGFSNRVVDLMKLIASK

SEQ ID NO: 47566 - protein, 703 aa, Arabidopsis thaliana
MASSAFAFPSYIITKGGLSTDSYLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGNTINHSFGMAVGRDLKGKNNNVVAVIGDGAMTAGQAYEAMNNAGYLDSDMIVILNDNKQVSLPTATLDGPSPPVGALSSALSRLQSNPALRELREVAKASLLHFFSRMGMTKQIGGPMHQLAAKVDEYARGMISGTGSSLFEELGLYYIGPVDGHNIDDLVAILKEVKSTRTTGPVLIHVVTEKGRGYPYAERADDKYHGKTSVVKFDPATGRQFKTTNKTQSYTTYFAEALVAEAEVDKDVVAIHAAMGGGTGLNLFQRRFPTRCFDVGIAEQHAVVHDVDLQKLPVRFAMDRAGLVGADGPTHCGAFDVTFMACLPNMIVMAPSDEADLFNMVATAVAIDDRPSCFRYPRGNGIGVALPPGNKGVPIEKISLGVFQIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 47567 - protein, 994 aa, Oryza sativa Japonica Group
MPPAGDAAHAPPPPHRRLVFAFYLTGHGFGHATRAIEVVRHLIAAGHEVHVATAVPEFVFTAELPRSPSSQGLLHIRRAILDCGAVQTDALTVDPLASLLKYHETAVVPRESILRTEAEWLTSINADLVISDVVPVACRVAADVGIPSVCIGNFSWDYIYAEYIVASGDHHRSIVWQIAEDYSHCDILLRLPGYCPMPAFRDVTDVPLVVRGLRKSRSEVRKELGIAENAKVVVFNFGGQPAGWNLKQEWLPDGWICLVCGASDSQEVPPNFIKLAKDAYTPDAMAASDCMLGKIGYGTASEALAYKLPFIFVRRDYFNEEPFLRNLLEHYQSSIEMTRRDFLHGHWKPYLLRALTLQPCYDGPTNGGEVAARILEDTAVGKKCISDKFNGARRLQDAIVLGYQLQRAPGRDVAIPDWYSLSETEVGACPISENIKTKESTESCFEDFEILHGDLQGLPDTMSFLKSLSEFNQSELKSNGKQPQERIAASVLFDWEEEMYIARAPGRLDVMGGIGDYSGSLVLQLPLREACHVAVQRNHPSNQKLWENTQARRLENGGMEPVVQIVSFGSELSNRSPTFDMKLSDLMDVDKPISYEKAREFFCRNPSQKWAAYVAGTILVLMTELDVKFTDSMSILVSSDVPEGKGVSSSASVEVATMAAIAAAYGLNIAPRDLALLCQKVENHVVGAPCGVMDQMTSACGEANKLLAMVCQPAEVKELVAIPNHMRFWGLDSGIRHSVGGGDYGSVRVGTYMGRKMIKCAASDLASESSVSDAPVQSNDYKQNAIELLKSEASLEYLCNIPPHRYEAIYAKDIPEVITGDAFLKKYGDHDDTVTAIDPKRSYNVKAPTRHPIYENFRVETFKALLEAANTDEQLSALGELMYQCHYSYNACGLGSDGTDLLVNLVQEMQHRNMSKGESPSLFGAKITGGGSGGSVCVMGKNCLKSSEEIIEIQQRYKAATGYLPILFDGSSPGAAKFGYLKIRRRPSSPIAAK

SEQ ID NO: 47568 - protein, 404 aa, Bradyrhizobium japonicum
MSVEISKLASGLTVVTDKMPHLETAALGVWAGVGGPHEGKPNEHGISHLLEHMAFKGTTKRSSRRRIVEEIEAVGGDLNAGTSTETTSYYARVLKADVPLALDVLADILANPAFEPDELEREKNVIVQEIRAAQDTPDDVVFEHLNELCYPDQPMGRSLLGTAKSLRAFNRDMLRGYLSTHYRGPDMVVAAAGAVDHSQVVAEAEKRFASFEGTPGPKPQAAQFGKGGAKVVHRELEQAHLALALEGVPQNDLSLFSLQVFTNILGGGMSYQLFQEVREKRGLCYSIYSFHAPYTDTGFFGLYTGTDPADAPEMMEVVVDVMNDSVETLTEAEIARAKAQMKAGLLMALESCSSRAEQLARHVLAYGRPQTVQELVARIDAVSVESTRDAARALLSRTALRLSH

SEQ ID NO: 47569 - protein, 102 aa, Arabidopsis thaliana
MKIPTPKQPLTQLPPRIGKKVSNRSKSNQVHAISHQLEMSPNSDSSPGNEYRALRRKYLLLEEDSFALERELKEAEDEVKALEDEKLELLDKLVVMEGLVDP

SEQ ID NO: 47570 - protein, 480 aa, Salmonella typhimurium
MIMRQTKLYPVVMAGGSGSRLWPLSRVLYPKQFLCLKGDLTMLQTTICRLNGVECESPLVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 47571 - protein, 249 aa, Methylococcus capsulatus str. Bath
MVGGEAASPSLAELLREDVGCVFERDPAARSRLEVMLTYPGVHAVLLHRFAHRLWRAGHRLSARLLAAFARWLTNVDIHPGATIGRRFFIDHGAGVVIGETAEIGDDVTLYHGVTLGGTSWNKVKRHPTLGNGVLIGAGAKVLGPIVLGDQVRVGANSVVIKDVPAYCTVVGIPGKVVQPKSSRKSDPHGIDLDHHLIPDPVGRAVQCLLDRIEILEDELVKRRVEAAHECRQCDGEAVCREPAAADLE

SEQ ID NO: 47572 - protein, 484 aa, Bifidobacterium longum NCC2705
MAEATANIGVIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQTGLECGSPVAAIGEAVFARALSSHGELREDAQKEGLAGPNKTIDLAGEDKAAFVEDVRKALFASKVVAYAQGLNEIQDGAKEYGWDINLSEVARIWRGGCIIRAQFLLDRITEAFRGDNPPASLLFDPYFEKIIGESQDAWRRVIVRAVEAGIPTPVFSSSLAYYDGLRSKRLPTALTQSQRDFFGAHTYGRVDKPGVFHTLWAEEGKPEIEA

SEQ ID NO: 47573 - protein, 376 aa, Aquifex aeolicus VF5
MTYLMNNYARLPVKFVRGKGVYLYDEEGKEYLDFVSGIGVNSLGHAYPKLTEALKEQVEKLLHVSNLYENPWQEELAHKLVKHFWTEGKVFFANSGTESVEAAIKLARKYWRDKGKNKWKFISFENSFHGRTYGSLSATGQPKFHKGFEPLVPGFSYAKLNDIDSVYKLLDEETAGIIIEVIQGEGGVNEASEDFLSKLQEICKEKDVLLIIDEVQTGIGRTGEFYAYQHFNLKPDVIALAKGLGGGVPIGAILAREEVAQSFTPGSHGSTFGGNPLACRAGTVVVDEVEKLLPHVREVGNYFKEKLKELGKGKVKGRGLMLGLELERECKDYVLKALEKGLLINCTAGKVLRFLPPLIIQKEHIDRAISVLREIL

SEQ ID NO: 47574 - protein, 406 aa, Xanthomonas campestris pv. campestris str. ATCC 33913
MKESPPMAPKPKNTNAAGGTAKSATKASSKKATKLAGKDSAKPLATAAPVLADVRAKIDEIDRGIQALIAERANFAHQVGKAKGKLAAAVDYYRPEREAQVLRMVVDRNEGPLSDEVLVHVFREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLAGHVEDESMKQALAELEAHSAQIKVLGSYPVAIP

SEQ ID NO: 47575 - protein, 437 aa, Aquifex aeolicus VF5
MKLSVIGGGYVGLVTAACFSHLGHEVLVVEKIPEKVELLRRGKSPIYEPGLEELLREGINEGRLSFTTDIKEGIEFSEVIFICVGTPSNPDGSADLSQVEEVARFTAKYMDSYKLLVNKSTVPVGTQRKVKRTVRLYLKNKELEFDVASNPEFLREGHAVKDFLEPDRIVVGVESERAKEVLLEIYKPITDKGFPILITNPPTAEIIKYASNTFLATKISFINMISDLCEKVGANVEEVAQGMGYDKRIGKEFLRAGLGWGGSCLPKDTKAFIRILEELGVDATILKGALGINESRVDRLLQKLKDALWILKGKTIAIWGLSFKPNTDDIREAPSLKVVERLLREGAKIRAYDPKATENFKRVFIEGEDLRYFDDKYKAVEGAEALLILTEWDEFKRANLERVKRLMELPIIIDGRNIYDPQEVRNLGFEYYSMGRP

SEQ ID NO: 47576 - protein, 483 aa, Prochlorococcus marinus str. MIT 9211
MLEAYAHNYLKNLLKKNSFAWPHNLTLSRLISRSLRRKDRSFIQLETSDMKQSWPGVLVPLCLHSSEVVLVLTTSQRQRLLSFELPRLKLEGLHLSSWEGPMPPTGNQLWLLDHLEFFKAFCEGHLHSKQLIIPEAELLSSRLRDCMSIKVCANHWDSLRRAHPSAASALIKLHERLTRKLFAHATCVDGTVRMDFSETVVLMDLVAVLGHAPSPWPEVVAAIRHGWASWAELDHKLLDWCWNLKPLEPLKDLHIVFERNSLVLLSLTKQNDFFLKQLEPFVGSFDVKVKLGDEFCQHQEPIQLFAPRRQPLPNTEYFAEHLLDQCRRLILGRKGITIILLDDYQLLRQLTSELAAEFGKRVILESTSPETNGVICCQSFWWMNFQDQLPIPEQLILGILPFPSLELPLTAARVDAYKRQGQDWFRDLLLPELLNLLPRLIWPVRKHHGRIAILDGRLRSRSWGERVLQSLEPWTPLERLLPD

SEQ ID NO: 47577 - protein, 350 aa, Zea mays
MAFLSRSRSHAVPSALLVLLLLSVASAAAVGVAAKTDVHDVAEESNKDEESWTGWAKDKISEGLGLKHHADVDEEETARKAGHTVKSARESAQHTASGKNSTVPHHSFIRSSRSCYDRADAGQVHATEIGKKAGYAKETAGDAAAGASNKAGQAKDQAKDTVKDAAGEASNKAEYGKQKTKEAAEAASESGAEAHERSKKGKAMVEEKAREKAGQGYESAKDAAGKAQETLSQTADAAAEKAGTAKDAAWEKADKAGKKAQESKEAAKGKATEKAASAKDAAWETVEAAKEKAGEGYERVKEKARETADTAKERLEEVKERVAGPDVAAVDGKGKHRRADVDKYRSEDEL

SEQ ID NO: 47578 - protein, 416 aa, Oryza sativa Indica Group
MASSTSDIPEGREKLKRSGSLGSSDTAYVRADKIDLTSLDIQLEKQLTKTWGKANLKAQGPKEDWEIDLAKLEIRYVIAQGTYGTVYRGTYDGQDVAANKIFLQSLKLNIPYSMLHVFLLDKDLLSLTPWLSSQVKLLDWGEDGFATEAETAALRTSFKQEVAVWHKLSHPNVTKFVGASMGTTDLKIPTNNSNAGARTNLPARACCVVVEYLAGGTLKQYLIKNSRRKLAYKVVVQLALDLARGLSYLHSRKIVHRDVKTENMLLDTQRNLKIADFGVARVEAQNPKDMTGATGTLGYMAPEVLDGKPYNRKCDVYSFGICLWEIYCCDMPYPDLSFADVSSAVVHQNLRPDVPRCCPSAFANIMRKCWDANPDKRPDMDEVVQLLEALDTSKGGGMIPDGQSSGCLCFTKARGP

SEQ ID NO: 47579 - protein, 294 aa, Thermosynechococcus elongatus BP-1
MLGQLHPDLIQEWLEAAATEIPRGEPLQRLPKVGSEAFAFAVVTPEQEFTLGRSRLRFPLMSAIKPFLLLYALTLWQEQVWTWVGQRPSDYPYNSVLQLTLDQGWPRNPMINSGAIALAGQLAYVGGATAFQTWLNECAGTQFEVDQEVLGAVHRHPNWQNRTLAHFLVESGRIADAEVALEIYNQVCCFQGTVEEVARLGLLLALPQAKVSDRHRQQVNVLMLTCGLYEDSPRYGLEIGLPMKSGVSGVMLAIVPRQGAIACYSPPLDKSGNSILGLYLLQRISRHLGLSPLG

SEQ ID NO: 47580 - protein, 497 aa, Nocardioides sp. JS614
MSTSTRFVEQYGLYSSEQQRAAKQSLEKVLEHGIEIVRLVWPDQHGLLRGKALTVDAYIGALETGNEITMAPFFFDPANAIVFNPFSPDGGFAIDGLGGSPNVKMVPDPGTFTVLPWARNTALVFCDLYMTNGQPFPLAPRTILKDALAALAQHGAKLVTGVEMEWYLTRLVDDQLATGSLGAPGSPADPPQVAPVARGYSYLLMEHLDEIDHVLEPIRKAVLQMGLPLRSIDDEWAPSQVETTFDVLEGLAAADSAALFRTTVKQIAKRHGHLASFMCTPAIAGFYANGWHLHTSLADIDSGANLMVPTDNSPLSEIGRHYVGGTLEHGIAASVFTTPTINGYRRRRPYSLAPDRLAWGQDNRAAMMRVISAPNDKASHVENRVGDSAANPYLYVAAQAASGLDGVVNKIDPGPISLDPYAADVPQLPTTLADAVDALESDGFFRKVFGDVFVDYMVAMKRSEVDRYQAWVEQNPDPDTYVNGVTGWEHREYFELF

SEQ ID NO: 47581 - protein, 438 aa, Leptospira interrogans serovar Copenhageni str. Fiocruz L1-130
MNFSHGTHDSHKRVYDTLRKCEQIFGFPLGIMADLQGPKIRTGKLKLNSILLHKNQEIEIVPDSDILGDEHKIGCTYPNLIRDIQEEDKILIDDGKLILKVISKKSNSAILKVIVGGILWSNKGINLPGTPISAPALSEKDIEDLKFALSLGVDYAALSFVRTGADLELARSYLEGTYTGLIAKIERPEAIGNIEEIIERADGIMIARGDLGVEIDTEKVPILQKELIYKLNQAGKPVITATQMLESMIENPRPTRAEASDVANAVMDGTDAVMLSAESANGHYPVESVEIMSKIIQETETIDHIYEIHWNIKKTFLESERTALGNAAREIAHGIHAKAIVNFTRSGYSALITSEMRPKVPIYSFTPFATTARKMKLYRGVVPFVMPFFTRLEDMIAYMNQKLKEDEFLFPGDKVVILSGAPGTTVRSVDFLQVYKIH

SEQ ID NO: 47582 - protein, 480 aa, Brassica napus
MRMLTTAVNTLLKRENSLLQRHGFAHVVAQRTNSVHQTETKVPKIPPFSYSPPPYDGPSTGEIIAKRREFLSPALFHFYNTPLNIVEGKKQYVFDETGRRYLDAFGGIATVSCGHSHPEVVESVIKQLKLIQHSTTLYLNHTISDFAEALVSTLPGDLKVVFFTNSGTEANELAMMMARLNTGCNDVVSLRNSYHGNAAATMGATAQSNWKFNVVQSGVHHAINPDPYRGIFGSDGEKYARDVHDLIQFGTSGQVAGFIGESIQGVGGIVELAPGYLPAAYDIVRRAGGVCIADEVQSGFARTGTHFWGFQSHDVIPDIVTMAKGIGNGIPLGAVVTTPEIAGVLSRRFYFNTFGGNPMCTAAGHAVLRVIQEEKLQENAFLVGSHLKRRLTQLKDKYELIGDVRGRGLMLGVEFVTDRDLKTPAKLETLHLMDQMKEMGVLVGKGGFYGNVFRITPPLCFTLNDADFLVDVMDHALSKM

SEQ ID NO: 47583 - protein, 297 aa, Prochlorococcus marinus str. MIT 9211
MESYLLEQIIGSKGPLAGAKIKSITAVNGGSIHNAWRLNLNDNEKIFAKTTSIENFEMLQFEEIGLNTLSKYADKSLISLPVPICLQKLETHSILIMPWVNFSNGNKVNLGKGLALVHKTTSESSVGTFGWETNGFIGLGPQTGGWETNWGECFTSLRLIPQIKIAEKWGLKLIELTKLLTKIKSFLNRHNPSPSLVHGDLWQGNAGIDESGLGVIFDPAIWWADREVDIAMTKMFGGFSKEFYLGYEEVWPLPKLWMQRVDIYNLYHLLNHANIFGGIYPNQCIESIKKLNLVLKD

SEQ ID NO: 47584 - protein, 382 aa, Burkholderia vietnamiensis G4
MMRDAANFEPVDSRVTHPAFWNALPERWTSDVEETLVCCHVRQETHDVKSFFFRSPQGRTFSFEPGQFITLELDIDGETINRCYTISSSPARPHTISITVKRVPGGKVSNWLHDNLQPGAPVRVLGPAGEFTCARHPARKYLFLSAGSGITPLMSMSRAHHDLAEDRDIMFVHSARTPDDIIFARELDLIASNHTNFRTSFVVERVGARTNWPGVTGFLTLPLLKLIAPDFMEREIFTCGPAPYMKAVRDLLDEAGFDRKQYHEESFSFETLAQTASDDVLAELVPAADGGDVATKQYTVSFAKSNREISCGSEQHVLDAARQSGVRLPASCTQGMCGTCKVKLVSGQVEMKHNGGIRQREIDQGMVLLCCSKPLSDLVIDK

SEQ ID NO: 47585 - protein, 425 aa, Zea mays
  misc_feature (167)..(167): Xaa can be any naturally occurring amino acid
  misc_feature (295)..(295): Xaa can be any naturally occurring amino acid
  misc_feature (386)..(386): Xaa can be any naturally occurring amino acid
  misc_feature (405)..(405): Xaa can be any naturally occurring amino acid
AFPSRFHWYQVATIQHGTPVHRCLSSTVHPACARSLALSPLALSGASGRPPPRPSVRCPGVASSAPPSGLRRPPRRRAPTSRSHSFDEAEAAENAKSADIDRRILQETKAEQHIHKLLLLGAGESGKSTIFKQIKLLFQTGFDEAELRSYTSVIHANVYQTIKVCYXKRILYEGAKELAQVEPDSSKYVLSPDNQEIGEKLSEIGARLEYPSLNKECVQDVRKLWQDPAIQETYSRGSILQVPDCAQYFMENLDRLSEVDYVPTKEDVLHARVRTNGVVETQFRYSLVILFAYYXLDITLIIKFVYFVFCSPLGESKRGGEVYRLYDVGGQRNERRKWIHLFEGVNAVIFCAAISEYDQMLFEDETKNRMMETKELFDWVLKQRCXEKTSFMLFLNKFDIFERKXQKVPLSVCEWFKDYQPTAPG

SEQ ID NO: 47586 - protein, 459 aa, Aspergillus nidulans FGSC A4
MAPFSKSIPIAIIGDGAFGLSTALHLVQNGYTDITVLEQDEKIPPPYSAANYLNKIVREEYEDPFYTNLTVLCPMGSGYINTDKATGVSHSPFPVNQEASSGFLPAEDETRIRKLLQQTLPALANRPLVLKSLCWFADTKDSDFIIDFVPGSKGSVVIESADSGHGFKMFPIVGSWTSLLSKRHTPNSIHSGKPNLRANMGQSTYRGNYGLPWVLPSVQQARRGFNEKGLVHEYLPILRLKGLREGAARYCTLREKGGAADADAASDAVAARKVYIPSTTWSNHRLLFSSLGFTVGQFNYYNNATRSLNIDSYLAALRSADHGSVVLLHACAHNPTSLDPYIEQWKQIWDIIKERRLFPIFDAAYLGLNSGDYDKDAWAIRGRLTEPGEGVGRIILQPTPFSQSVLESLQRSEISNLPAFRAKIAEAIMSDDMLKNVWLEDLKTMSGRIAEMRRAFSTG

SEQ ID NO: 47587 - protein, 348 aa, Physcomitrella patens subsp. patens
AEESMSSAAEFVEGGAQDPCDDACSICLESFCDDDPATVTNCRHEYHLQCILEWSQRSKECPMCWQPLTLKDSKSQELLIAVEQERALRRHKTQAAQMYHRPSVEEYGFDRFASYGDENCIMQHLAAMAMGRAHPMSWREHIRSRPSTTAQGRPHYVLVSGAPAGAPSSPASSSPVASPPQTSDIETSLATVFSFPCYSAPTRDSHSANSSTPRIRSENLQLDEHGTSSSESLDTFKSRLVAASTRYKESLTKSTKGFRERLRTRGGMMQDIGARAREMSAGVCRTWVSVEPGTDRTDGSNSSSGQLSRTPHPPPDRPSDLVGSGSVSAGLPRSNSAVSPKPEPCYYT

SEQ ID NO: 47588 - protein, 624 aa, Arabidopsis thaliana
MEAVIQTRGLLSLPTKPIGVRSQLQPSHGLKQRLFAAKPRNLHGLSLSFNGHKKFQTFEPTLHGISISHKERSTEFICKAEAAAAGDGAVFGEGDSAAVVASPKIFGVEVATLKKIIPLGLMFFCILFNYTILRDTKDVLVVTAKGSSAEIIPFLKTWVNLPMAIGFMLLYTKLSNVLSKKALFYTVIVPFIIYFGAFGFVMYPLSNYIHPEALADKLLTTLGPRFMGPIAILRIWSFCLFYVMAELWGSVVVSVLFWGFANQITTVDEAKKFYPLFGLGGNVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 47589 - protein, 172 aa, Triticum aestivum
  misc_feature (3)..(3): Xaa can be any naturally occurring amino acid
  misc_feature (8)..(8): Xaa can be any naturally occurring amino acid
LTXGLALXFAVVAILAALVASSPTKGWSGRSLSLLDPMDIILYIPIIASVSEHQPPTWPSYFMAINVLAFLVPAGIISCFLPLSDASSFSVLYLVTSVYFSGVMVRLMLVLAPAVCILSGIALSEAFNVLTRSMKFQRPISDDTLPTAGDSTPGSSSTATITTSTKNANKKK

SEQ ID NO: 47590 - protein, 636 aa, Vibrio vulnificus CMCP6
MAIEINVPDIGADEVEVTEILVSVGDKVEEEQSLITVEGDKASMEVPASQAGIVKEIKVVAGDKVTTGSLIMVFEVEAAGAPGAAAAAPVPAVAPVAAPAAASELKEVCVPDIGGDEVEVTEILVAVGDSIAEEQSLLTVEGDKASMEVPAPFAGTLKEIKVAAGDKVSTGSLVMVFEVAGSGAAAPAPVAAAAPAAAPAAVSGVKEVNVPDIGGDEVEVTEIMVTVGDTVSEEQSLITVEGDKASMEVPAPFAGTVKEIKVAAGDKVSTGSLIMVFEVAGAAPVAAAAPAQAAAPAQAAAPAPAVAPVAKAEAQATTSDFKENDEYAHASPVVRRLAREFGVNLSKVKGSGRKSRILKEDVQAYVKDALKRLESGAVAAASGKGDGAALGLLPWPKVDFSKFGETEVQPLSRIKKISGANLHRNWVMIPHVTQWDNADITELENFRKEQNAIEAKKDSGMKITPLVFIMKAAAKALEAFPAFNSSLSDDGESLILKKYVNIGIAVDTPNGLVVPVFKDVNKKGIYELSEELMVVSKKARAGKLTAADMQGGCFTISSLGGIGGTAFTPIVNAPEVGILGVSKSEIKPVWNGKEFAPRLQLPLSLSYDHRVIDGAEGARFITYLNECLSDIRRLVL

SEQ ID NO: 47591 - protein, 487 aa, Vibrio vulnificus CMCP6
MSKEIKAQVVVLGAGPAGYSAAFRCADLGLDTVLIERYNTLGGVCLNVGCIPSKALLHVAKVIEEAKALAEHGIVFGEPQTDIDKIRLWKEKVINQLTGGLGGMAKMRKVNVVNGFGKFTGPNTIEVEGEDGKTVVNFDNAIVAAGSRPIKLPFIPHEDPRIWDSTDALELKEVPGKLLIMGGGIIGLEMGTVYHSLGSQIDVVEMFDQVIPAADKDIVKVYTKRISKKFNLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITYLPNAKAKKKKIIFLASRQNKNR

SEQ ID NO: 47592 - protein, 340 aa, Corynebacterium glutamicum ATCC 13032
MKLAVIGGDGIGPEVTAEALKVLNAVRDDIETTDYDLGARRYLKNGELLTDEDLASLREHDAILLGAIGAPGSVPPGILERGLLLKMRFALDHHVNLRPSKLYDGVESPLRNPGKIDFVVVREGTEGAYTGNGGAIRVGTPHEIANETSVNTRYGAERVIRYAFELAQSRRKKLTLVHKTNVLVHGGGLWQRTVDEVAKEYPEVAVDYNHIDAATIYLVTDPSRFDVIVTDNLFGDILTDEAGAVSGGIGLAASGNIDATGTNPSMFEPVHGSAPDIAGQGIADPTAAILSAAMLLRHLGDEDNAVRIETAIAADVAGRDNSQPISTTEVGDRIVKALQS

SEQ ID NO: 47593 - protein, 590 aa, Burkholderia mallei ATCC 23344
MSFTLHGIPVSRGIAIGRAYLIAPAALDVAHYLIEAERIEAEIERFRTALGAVRRELDVLRADLTDDTPTEVAAFIDVHAMILGDAMLVQETIDLIRTRRYNVEWALTEQLDVLAGHFDDIEDEYLRERKADIEQVVERVLKALAGAPSAAQALDRAAGNGRDEMIVVAHDIAPADMMQFKTQSFQAFVTDLGGRTSHTAIVARSLGIPAAVGVQHASALIRQDDLIIVDGDQGIVIVDPAPIVLEEYSYRQSEKALEQRKLQRLKFSPAQTLCGTKIDLLANIELPDDAKAAVDAGAVGVGLFRTEFLFMSKVRMPEEEEQFAAYKRAVELMHGMPVTIRTIDVGADKPLDVYDEGYETAPNPALGLRAIRWSLSEPQMFLTQLRAILRASAFGQVKILVPMLAHAQEIDQTLDLINEAKRQLDAAGLAYDPNVRVGAMIEIPAAAIALPLFLKRVDFLSIGTNDLIQYTLAIDRADNAVAHLYDPLHPAVLHLIAFTLREAKRAGVPVSVCGEMAGDPALTRLLLGMGLTEFSMHPSQLLVVKQEILRAHLKALEKPTADVLASFEPEEVQAALARLASAEPRADVAA

SEQ ID NO: 47594 - protein, 358 aa, Frankia sp. EAN1pec
MRVAVAYEAEKPLVVEDLDQPAVGPRDVLVRIAASGICHTDLHVINGHSPLPLPIVPGHEACGVVEEVGSEVRRVKVGQRVLAAVSPACGTCWWCVNGMSNHCELGGPVKAAPRFTLADGRTAAAVCGCGTFAEAMVVDEASVVPTNTDLADEELALLGCGVTTGLGAALITAGVTPGSSVAVIGCGGVGQSVIQGARISGAATIIGIDLVPARREASLRVGATHVVDPAEADPVEQVRALTEGRGVDFSFEVVGLPNLMVQAFDMARKQGAVTLVGMPTTTATLTLPAISAIFSGKRLAGSVVGGAQILRDMPRFIRLAETGQLDLGGMVSNRIRLDDINEGIALLDRAEGTRTVII

SEQ ID NO: 47595 - protein, 379 aa, Prochlorococcus marinus str. MIT 9211
MKSIKANNMQLSPEEFARYSRHLSLPEIGIKGQKKLKGSSVLCIGCGGLGSPVLIYLAAAGIGNLGIVDNDLVEESNLQRQIIHTHKSIGKSKIESARSRIIDINPYCKVTIFSELLNNENALEIIKPYDLVCDCTDNFESRYLINDACVLLGKPYIYGAISKFEGQASVFNLDKDSPNFRDLIPQPPSMDLLPSCSESGVIGVLPGIIGLIQATEIIKIIAGIGTTLSGRILIFNALEMKFKELKLKKDYAAKPITELIDYKDFCGSSGVTKVEDSIKSISAKKLRVLLEDNPNKNILLDVRTEEEFKLNAIKGSILVPLKNIQNGQEIDKIRKLASNKNIFVHCKTGKRSRKAILSLRSNGIDAVNLEGGINSWNES

SEQ ID NO: 47596 - protein, 394 aa, Listeria monocytogenes EGD-e
MKNLVKVKVFPKFTKGYKEGYPLILKERMEKWPKELQEGDVLELTDTNGQFIARGYHGEQNKGSGWLFTWDKKQQLDEDFLTNLITTAIEKRQFLFADDSTTAFRIFNGEGDGLGGFTVDFYDGYLVIQWYSLGIYAFQKMIIDIFLSFPEIKGIYEKRRFQEDTKDDFVAGQKATFPLIIKENGINYATYLDDGWMTGIFLDQRDVRRRISEDYSVSKNVLNTFSYTGAFSVAALFGGASKTTSVDVAGRSLSKTKEQLEVNGLDPNEQAIIVEDVFHYFKYAARKQLTFDLVVVDPPSFARTKKVTFRAAKDYPAMLREIIDITAPNGTIIASTNYAGFGMKAFKKLIAEAFQTSDRTYKIVETHSLPTDFTVNKNFPEGNYLKVLFLTLDI

SEQ ID NO: 47597 - protein, 307 aa, Glycine max
  misc_feature (114)..(114): Xaa can be any naturally occurring amino acid
MAKKSVKYYVVDAFTDSAFKGNPAAVCFLEEERDEEWLQAVATEFNVPVTCYLTRIAESHHNLNSFRGTSNIPRFHLRWFTHTNEVKLCGHATLAAAHTLFSYGLVNFNIIEFXTASGVLTTKKIPPINNCTSGSNLQNGVARDGFYIELDLPAHPIIEFNCDESSQISGALNGASIVDIKRTLIGDDILVVVTSGENVTEVQPQFDAISKCPGRGIIVSGIAPPGSGFDFYSRFFCPKDGVNEDHVCGSAHCALASYWSKKLGKCDFNAYQASPRGGILNIHLDEQNKRVLLRGKAVIMMEGCVLV

SEQ ID NO: 47598 - protein, 257 aa, Fusobacterium nucleatum subsp. nucleatum ATCC 25586
MIQKEAPKVKDDKNIKNVIAVMSGKGGVGKSTVTTLLAKELRKKGYSVGVMDADITGPSIPRLMGVSEQKMTSDGKNMYPVVTEDGIEIVSINLMIDENEPVVWRGPVIAGAVMQFWNEVVWGNLDYLLIDMPPGTGDVPLTVMKSFNIKGLIMVSVPQDMVSMIVTKAIKMARKLNMNIIGLIENMSYITCDCCNNKIYLTDENDTQTFLKENDVELLGELPMTKQIAKLTKGESEYPEETFSKIADRVMEKVKEL

SEQ ID NO: 47599 - protein, 381 aa, Thermosynechococcus elongatus BP-1
MKAMILAAGKGTRVRPITYTIPKPMIPILQKPVMEFLVELLRQHGFNQIMVNVSHLAHEIESYFQDGQRFGVEIAYSFEGYIKDGELVGKALGSAGGIKRIQDFNPFFDDTFVVLCGDALIDLDLTAAVAWHRQKGAIATVVMKTVPREDVSSYGVVVTDKSDRIVAFQEKPSVEEALSNHINTGIYIFEPEVIDYIPSNQEYDIGSQLFPKLVEMGAPFYGLAMDFEWIDIGKVPDYWQAVRGVLNGTIKNVSIPGHEQFPGIYTGLNVAVNWDKVTIQGPVYIGGMTKIEDGATIIGPTMIGPNCHICSGAVVDNCVIFEYSRLGSDVRLVDKLVFGRYCVDKTGTTIDLKAAALDWLITDSRQTDIQLSPLELKEMMS

SEQ ID NO: 47600 - protein, 299 aa, Aspergillus nidulans FGSC A4
MSTKPTTQTLCILGCGNLGTAILKSVLATPEPDRLFTHYIACIGSPSSKERLEFQFKDQANLTIALDDNIAAIRAADVVILALDPALIPAGLAQPGFRDALGQKLLISVAAGWTVKKLTETIYGDGLAEEGKARATIIRTLPNICALVGQSLTAIEVDPAAKTAEEALSLTTSIFSRVGKTLIIPPSLIDATTAVAGSTPAMFAVIVDSMIDASVAVGVPRSMAQAMIYQSMRGSAEMLQSGLQPGDLRDQGTSPEGCTIGGLMVMEERGVRGGVGRAVREAVSVARRMDGRLHLNDTR

SEQ ID NO: 47601 - protein, 435 aa, Burkholderia vietnamiensis G4
MDSNSQNDPLPTRDPVVGPSKPRLFGFLGAGLITGASDDDPSGIATYSQAGAAFGYGLSWTLLFSYPLMVAIQMISARIGRTTGHGIAGVLRRHYPDWLLQWVVVLLLIANIINLGADLGAMADAMALLLPGPKWLYVLLFSAICIAMQLLLQYTRYVAVLKWFTLSLFAYFAVLAIAHIEWARLASHLFVPHLSWTSSYLTLVVAIFGTTISPYLFFWQSEEEVEDMHAHPTRRDLFSAPAQAPTALHRIEMDTVTGMGLSNLVALAILATTAATLNAGGITDIQTSAQAALALRPIAGHFAALLFTVGIVGTGLLAVPVLAGSAAYAVGEARDWPVGFSRKVQEAKAFYATIAIATLIGMVINFTSINAIKALYWSAVLNGVIAVPVMIVMMLIASRTDIMGAFSVKGWLRALGWLATIVMFVIAVGMVVTSF

SEQ ID NO: 47602 - protein, 398 aa, Burkholderia vietnamiensis G4
MSSNRGVVYLGPGKVEVQKIDYPKMVDPTGRAIGHGVILKVVSTNICGSDQHMVRGRTTAPVGLVLGHEITGEVVEVGPDVETLKIGDLVSVPFNVACGRCAMCKDTHTGVCLNVNPSRAGGAYGYVDMGGWIGGQAEYVLVPYADFNLLKFPDRDQAMAKIRDLTCLSDILPTGYHGAVSAGVKPGSTVYIAGAGPVGMAAAASARLLGAAVTIVGDMNAERLAHARAMGFETVDLSKDASLGEQIAQILGVPEIDCAVDCVGFEAHGHGSSGSAEEAPATVLNSLMEITRPAGAIGIPGLYVTDDPGAKDKAAQHGSLSIRFGLGWAKSHSFFTGQTPVLKYNRNLMQAILFDRLPIAKIVNVEVISLDQAPEGYKKFDGGAPRKFVIDPHGLLAA

SEQ ID NO: 47603 - protein, 315 aa, Escherichia coli
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLIVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 47604 - protein, 489 aa, Burkholderia vietnamiensis G4
MSVYGLQRLYIGGAYVDATSGKTFDTFDPATGELLAQVQQASAADVDRAVASAQQGQREWAALTAMQRSRILRRAVDLLRERNDELAAIETRDTGKPIGETLAVDIVTGADVIEYYAGLATAIEGLQVPLRAESFVYTRREPLGVCAGIGAWNYPIQIACWKTAPALAAGNAMVFKPSEVTPLTALKLAEIYTEAGVPAGVFNVVQGDGSVGALLTGHPDIAKVSFTGGVETGKKVMSLAGASSLKEVTMELGGKSPLIVFDDADLDRAADIAVIANFFSSGQVCTNGTRVFVQRSIKDAFTAKVLERVKRIRVGKPTDADTNFGPLVSAAQLDKVLGFIASGKAEGAKLLAGGTRLTDGHFADGQYVAPTVFGDCRDDMKIVREEIFGPVMSILDFESEDEVIARANDTHYGLAAGVVTENLSRAHRTIHRLEAGICWINTWGESPAEMPVGGYKQSGVGRENGITTLEHYTRIKSVQVELGRYNPVF

SEQ ID NO: 47605 - protein, 451 aa, Vibrio angustum S14
MAKHFDYICIGGGSGGIASANRAAMYGAKVAIIEAKALGGTCVNVGCVPKKVMWHGAQIAEAMHLYAKDYGFDVDVKGFDWSKLVESREAYISRIHTSYDNVLGNNKVEVINGFAKFVDAKTIEVNGEHYTADHILIAVGGEPTIPAIPGAEHGIDSNGFFELNEQPKRTAIIGAGYIAVEIAGVLSALGTDTHLFVRKESPLRSFDPLIVETLVEVMATEGPTLHTHSVPKEVVKEADGSITLHFENGESHNTDVLIWAIGRHPTTDKINLEATGVATNDRGYIKVDEYQETNVKGIYCVGDIMEGGIELTPIAVKAGRQLSERLFNNKPDAKMDYSLVPTVVFSHPPIGTIGLTEPEAIAQYGEENVKVYKSGFTSMYTAVTSHRQPCKMKLVCAGDDEKVVGLHGIGFTVDEMIQGFGVAMKMGATKADFDSVVAIHPTGSEEFVTMR

SEQ ID NO: 47606 - protein, 229 aa, Lactobacillus johnsonii NCC 533
MKRKLAKLVLVRHGESVANRDNVYTGWNDVPLSKKGIAQAKNAGLKVEKIAEFAPTHIHTSVLSRAIMTANIIADVCSFLYLPITKTWRLNERHYGALRGINKDVSKKIFGTNQVLEWRRGFDSVPPLLTQPVQDRRYQKYDMRLMPQGESLHQTQERLMPYFWDHIAPELMAGHDQLVVAHGSSLRALIKKIEDISNEDIVKVEVPNAEPIVYTFDTDLHIVKKEILH

SEQ ID NO: 47607 - protein, 539 aa, Arabidopsis thaliana
MASRIINHSKKLKHVSALLRRDHAVAVRCFSNSTHPSLVGREDIFKARLNYSSVERISKCGTGNVTMLSGISTTSTKLSSPMAGPKLFKEFISSQMRSVRGFSSSSDLPPHQEIGMPSLSPTMTEGNIARWLKKEGDKVAPGEVLCEVETDKATVEMECMEEGFLAKIVKEEGAKEIQVGEVIAITVEDEDDIQKFKDYTPSSDTGPAAPEAKPAPSLPKEEKVEKPASAPEAKISKPSSAPSEDRIFASPLARKLAEDNNVPLSSIKGTGPEGRIVKADVEDFLASGSKETTAKPSKQVDSKVPALDYVDIPHTQIRKVTASRLAFSKQTIPHYYLTVDTCVDKMMGLRSQLNSFQEASGGKRISVNDLVIKAAALALRKVPQCNSSWTDEYIRQFKNVNINVAVQTENGLYVPVVKDADKKGLSTIGEEVRFLAQKAKENSLKPEDYEGGTFTVSNLGGPFGIKQFCAVINPPQAAILAIGSAEKRVVPGTGPDQYNVASYMSVTLSCDHRVIDGAIGAEWLKAFKGYIETPESMLL

SEQ ID NO: 47608 - protein, 559 aa, Geobacter sulfurreducens PCA
MSTDSTKIIYTMMRVSKYYDKKPVIKDISLSYFYGAKIGVLGLNGSGKSTLLRIMAGVDKDFNGQAVLSPGYTVGYLEQEPKLDESKTVREIVEEGCQETVNLLNEFNEITAAFADPDADMDKLLERQAEVQEKLDHLDAWDLDSRLEMAMDALRCPPGDTPVNVLSGGEKRRVALCRLLLQKPDILLLDEPTNHLDAETVAWLEHHLQSYPGTIIAVTHDRYFLDNVAGWILELDRGEGIPWKGNYSSWLDQKQNRLAQEEKAESERQKTLQRELEWIRMSPKGRHAKSKARISSYEQLLSQESERRAKDLEIYIPPGPRLGDIVIEADNVSKAYGDRLLVEGMSFRLPPGGIVGVIGPNGAGKTTLFRMITGQEEPDAGTIRTGETVKIAYVDQSRDALDPNKSIWEEISGGQETLQLGKVSVNSRAYVSRFNFSGSDQQKKVGMLSGGERNRVHIAKMLKEGGNVILLDEPTNDLDVNTMRALEEALENFAGCAVVISHDRWFLDRIATHILAFEGDSQAVWFDGNYSEYEEDRKKRLGAAADMPHRIKYRQLTRV

SEQ ID NO: 47609 - protein, 260 aa, Chromobacterium violaceum ATCC 12472
MSSTLVDPLWSAIRDETLAAVNDEPLLASFLHMTVLRHATLEDVLAFHLSTKLASPVMDPRALQELFREAFQADPAISAALRADIRACFERDPACDRYSTPLLYFKGFHAIQSQRVTHWLWQQGRTTLALFLQNRISEVTGADIHPAARVGQGVMLDHGTGLVVGETAVIGNNVSILHGVTLGGSGKDRGDRHPKIGDGVMLGAGAAVLGNIRVGECAKVGAGSVVLEDVPPHATVAGVPARVVAQACPGTPALDMDQRV

SEQ ID NO: 47610 - protein, 159 aa, Shewanella oneidensis MR-1
  misc_feature (54)..(54): Xaa can be any naturally occurring amino acid
  misc_feature (107)..(107): Xaa can be any naturally occurring amino acid
  misc_feature (114)..(114): Xaa can be any naturally occurring amino acid
MKIRIGHGFDVHKFGEPRPLILCGVEVPYETGLVAHSDGDVVLHAISDAILGAXALGDIGKHFPDTDAAYKGADSRVLLRHCYALAKAKGFELGNLDVTIIAQAPKXAPHIEDXRQVLAADLNADVADINVKATTTEKLGFTGRKEGIAVEAVVLLSRQ

SEQ ID NO: 47611 - protein, 416 aa, Ralstonia solanacearum GMI1000
MYQHIKVPAGEKITVNQDFSLNVPDNPIIPYIEGDGTGFDITPVMIKVVDAAVEKAYAGKRKISWMEIYAGEKSTKVYGPDVWLPEETLQVLKDYVVSIKGPLTTPVGGGIRSLNVALRQELDLYVCLRPVRYFKGVPSPVKEPEKTDMVIFRENSEDIYAGIEFEAQSDKAKKLIKILQDEFGVKKIRFPETSGIGVKPVSKEGTERLVRKAIQYAIDNDKPSVTIVHKGNIMKFTEGGFRDWAYALAQKEFGAELIDGGPWCKFKNPKTGKEIVVKDAIADAFLQQILLRPAEYSVVATLNLNGDYISDALAAQVGGIGIAPGANLSDSVAMFEATHGTAPKYAGKDYVNPGSEILSAEMMLRHMGWTEAADLIISSIEKSILSKKVTYDFARLLEGATQVSCSGFGQVMIDNM

SEQ ID NO: 47612 - protein, 231 aa, Oryza sativa Japonica Group
MAGGGDDLKMLGVYVSPFPLRVKLALSFKGLSFEYVEEDLHNKSDLLVSSNPVHKRTPVVIHNGKPISESMVIVQYLDEAFPGAGAALLPSDPLDRAVARFWASYVDDKLFSAWKMVFKGKTEEEKVEGRKQTFAVAETLEGALRECSKGKPFFGGDAVGYVDVALGGFVPWVHAMEELFGLKQFDAAKTPLLAAWLERVGELEAYKAVMPDAGMMIEFKKKQAQEAAAEA

SEQ ID NO: 47613 - protein, 351 aa, Clostridium beijerinckii
MKGFAMLGINKLGWIEKERPVAGSYDAIVRPLAVSPCTSDIHTVFEGALGDRKNMILGHEAVGEVVEVGSEVKDFKPGDRVIVPCTTPDWRSLEVQAGFPQHSNGMLAGWKFSNFKDGVFGEYFHVNDADMNLAILPKDMPLENAVMITDMMTTGFHGAELADIQMGSSVVVIGIGAVGLMGIAGAKLRGAGRIIGVGSRPICVEAAKFYGATDILNYKNGHIVDQVMKLTNGKGVDRVIMAGGGSETLSQAVSMVKPGGIISNINYHGSGDALLIPRVEWGCGMAHKTIKGGLCPGGRLRAEMLRDMVVYNRVDLSKLVTHVYHGFDHIEEALLLMKDKPKDLIKAVVIL

SEQ ID NO: 47614 - protein, 90 aa, Zea mays
QTVPDCHNLYKNSFTYHSLQRDRPLDFDEANQYLEKCERDKSRVLVHCMTGKNRSAAIVAAFLMKSRGWRLAQSFQWVKDRRPQVQLTDG

SEQ ID NO: 47615 - protein, 460 aa, Glycine max
  misc_feature (139)..(139): Xaa can be any naturally occurring amino acid
QLRRPPPPPGIEPHSVKISPNGEFLVLDSENSNIYKVSGSMSRYSRPKLLAGSAEGNIGHIDGRPREARMNHPKGLTVDDRGNIYIADTLNMAIRKISDEGVTTIAGGKRGYAGGHVDGPSEDAKFSNDFDVVYVGSSXSLLVVDRGNHAIREIQLHQDDCTSYDEDDNSFNLGIVVLVAAAFFGYMLALLQWRVRAMFSSPDDPRAPSRKKGAPFVAQQMQRPPPTTKSVRPPLIPNEDEFEKQDEGFFVSLGRLFLNSGTCMSEILGGLFSGSKRKSLQYHQYQQQYQYANRYPNAWPMQESFVIPDEDEPPPSLETKTPTPRETYPIMTKELEKPQHFKPSRGYLKRWEGGDYQEQHQQLQQHHQQHQQEHPKLQHQQHQQQVKLQHQHQVHTRYSSTPQGYYEQNCETNEIVFGAVQEHDGRREAMVIKAVDYGDPKYTHHNIRPRLNYVGYSHGY

SEQ ID NO: 47616 - protein, 389 aa, Methylococcus capsulatus str. Bath
MNIHEYQAKELLKTYGVPVPDGAVAYSDAQAASVAEEIGGSRWVVKAQIHAGGRGKAGGVKVAHSIEEVRQYADAMLGSHLVTHQTGPGGSLVQRLWVEQASHIKKEYYLGFVIDRGNQRITLIASSEGGMEIEEVAKETPEKIVKEVVDPAIGLLDFQCRKVATAIGLKGKLMPQAVRLMKAIYRCMRDKDALQAEINPLAIVGESDESLMVLDAKFNFDDNALYRQRTITEMRDLAEEDPKEVEASGHGLNYIALDGNIGCIVNGAGLAMASLDAITLHGGRPANFLDVGGGASPEKVTNACRIVLEDPNVRCILVNIFAGINRCDWIAKGLIQACDSLQIKVPLIVRLAGTNVDEGRKILAESGLSFITAENLDDAAAKAVAIVKG

SEQ ID NO: 47617 - protein, 1049 aa, Bacillus megaterium [sequence omitted]

SEQ ID NO: 47618 - protein, 404 aa, Arabidopsis thaliana
MAAALQTNIRTVKVPATFRAVSKQSLAPFRVRCAVASPGKKRYTITLLPGDGIGPEVVSIAKNVLQQAGSLEGVEFNFREMPIGGAALDLVGVPLPEETISAAKESDAVLLGAIGGYKWDNNEKHLRPEKGLLQIRAALKVFANLRPATVLPQLVDASTLKREVAEGVDLMVVRELTGGIYFGEPRGIKTNENGEEVGFNTEVYAHEIDRIARVAFETARKRRGKLCSVDKANVLEASILWRKRVTALASEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLVALNNGFRTGDIYSAGTKLVGCKEMGEEVLKSVDSQVPASV

SEQ ID NO: 47619 - protein, 214 aa, Zea mays
MSEEDKTAASAEQPKRAPKLNERILSSLSRRSVAAHPWHDLEIGPDAPAVFNVVVEITKGSKVKYELDKKTGLIKVDRVLYSSVVYPHNYGFVPRTLCEDNDPMDVLVLMQEPVVPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 47620 - protein, 631 aa, Fusobacterium nucleatum subsp. nucleatum ATCC 25586
MAILQVNDIYMGFSGETLFKEISFSVDEKDKIGIIGVNGAGKTTLIKLLLGLENSEINPATNERGTISKKSNLKVGYLAQNTQLNKENTVFNELMTVFNNLLEDYNRMQEINFLLTLDLDNFDKLMEELGEISERYERHEGYSIEYKIKQILNGLNIPENLWTMKIGNLSGGQNSRVALAKILLEEPDLLVLDEPTNHLDLTSIEWLEKILKDYNKSIILISHDVYFLDNVVNRVFEIEGKRLKDYKGNYTDFLIQKEAYLSGEVKAYEKEQEKIKKMEEFIRRYKAGVKSKQARGREKILNRMEKMENPVVTTQKIKLKFDIKAQSVDLVLDIKNLSKTFEDKLLFKDLNLKVYRGERIGLIGKNGTGKSTLLKIINNLEKASSGEFKIGERVSIGYYDQNHQGLGLNNNIIEELMYYFTLSEEEARNICGAFLFREDDIYKKISSLSGGEKARVAFMKLMLEKPNFLILDEPTNHLDIYSREILMDALEDYPGTILVVSHDRNFLDTVVNKIYELKTDGVETFDGDYEAYKQERDNIKVKNEEAVKSYEEQKKAKNRLTSLEKKLVRLEEEIQKIEEQKEEVNKKYLLAGEKNNVDELMSLQEELDNLDNKILEKYQEWEDVEKELKNL

SEQ ID NO: 47621 - protein, 493 aa, Nocardioides sp. JS614
MTTTTDASDLAVYDLFVDGRWQPSRTGRTSERTSPGDGRLVGRYARGDGADVDLAVAAARRAFDEGPWPTIDATKRAAIMRRAADLLRERADTIGRRIALELGKPISMARNEVVLTAEVFDYYAALALDQRGELISQHTASALGMIVKEPVGVVGMITPWNFPLLLLSWKVAPALAAGCTMVAKPASLTPGSTLDLASVLADAGVPDGVYNVVTGGGAEVGDALAQHPGIDKIAFTGSTEVGQTVMRAAVGTVKKVSMELGGKSPNIVFADADLKQAVRGAYWGIFLNSGQACQAGSRLLVQREVHEEFVSSLVEMARSSKVGDPLDEGTQIGPMVDQAQLDTVLDYIGKGREAGAALVAGGNRLGGELADGLYVEPTIFDNAAPDHAISREEIFGPVLAVTPFDTLDEAVRLANDSPYGLASAVWSTNIDTAIKTSKRLRAGTVWINAYHDAGLPFCMPMGGYKSSGIGRELGREGLAQYFETKAIHLRLGR

SEQ ID NO: 47622 - protein, 493 aa, Frankia sp. EAN1pec
MRDRLMYRDAFYINGTWAAPAGSGTLNVVSPSTEEIVGALPEATREDMDRAVRAARDAFENGPWPRMSAAERADILARAAEALRKHEAEIAQVTTDEMGCATSQAKAAQTGLVAPVFEYYSELARSYEFERTVVAGDRGALVTQEPVGVVAAIVPWNAPVTLAAWKAAPALAAGCTVVLKPAPEAPLSNFILADAMDEAGVPPGVVNVVPGGREVGEYLVTHPDVAKVAFTGSTAAGQRIMSLCGEAVRRVSLELGGKSASILVDDADFDTVVPTVVRGGMHLSGQVCGAHTRVLVPRSRYEKVLEIAAAAAAGVSVGDPHDPSVFVGPLVAERQRTRVEGYIEGAVRDGARVVAGGVRPEHLPRGWYVAPTIIGDVDNNMRIAREEIFGPVLCFLPYDDIDDAVRIANDSQYGLSGGVWSADPARGVEVARRIRTGSVAVNGAYPPFPLVPFGGFKQSGLGRELGPEGLAGFLETRSIGLPAALVAASQPTP

SEQ ID NO: 47623 - protein, 502 aa, Frankia sp. EAN1pec
MSTLTPPDAVALPFLDGGPRRLLIGGEWTDAASGRTFPSINPSTGETLTELAEGGAEDVNRAVAAARAAFEGPWRRMLPSERQDLIWAFADAVTAHQEELKLLEALDMGAPIGRRRPGTKPGSSWEAGVLRYFAGWVTKIHGETIPNSIPRQVLSYTLKEPIGVVAAIVPWNRPVSNAIWKIAPVLAAGCTMVLKPAEEASLAALRLGELLTEVGIPPGVVNIVTGPGETAGAALSEHPDVDKVAFTGSTTTGQHIVRAAAGNLKRVSLELGGKSPDVVFADADLDRAVPGAAMAVFTNSGQICCAGTRIFVERSIHDEFVERIATFTANLQVGNSLDPKTRIGPLVSAEQLERVVGYLDLSREEGARAAAGGARIETDDLARGYFVAPTVLTDVHDEMRVVREEIFGPVACVLPFDSVEEVTARSNDTQFGLAGGVWTRDVGKAHRLARDLRAGTVWVNNFNLMDPAVPFGGYKTSGWGREMGHQALDEYLNVKSVWIDMA

SEQ ID NO: 47624 - protein, 297 aa, Escherichia coli
MMNLKAVIPVAGLGMHMLPATKAIPKEMLPIVDKPMIQYIVDEIVAAGIKEILLVTHASKNAVENHFDTSYELESLLELRVKRQLLAEVQSICPPGVTIMNVRQGEPLGLGHSILCARPAIGDNPFVVVLPDVVIDDASADPLRYNLAAMIARFNETGRSQVLAKRMPGELSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSK

SEQ ID NO: 47625 - protein, 389 aa, Fusobacterium nucleatum subsp. nucleatum ATCC 25586
MLENLIKDFKEIFKYSGEVERFFSPGRVNLIGEHTDYNGGFVFPCALDFGTYAVVKKREDKTFKMYSKNFENLGIIEFNLDNLIYDKKDDWANYPKGVIKTFLDRNYKIDSGFDVLFFGNIPNGAGLSSSASIEVLTAVILKDLFKLDVDIIEMVKMCQVAENKFIGVNSGIMDQFAVGMGKKDNAILLDCNTLKYEYVPVKLVNMSIVIANTNKKRGLADSKYNERRTSCEEAVKVLNNNEVNIKYLGELTVTEFEKVKHYITDEEQLKRATHAVTENERAKIAVEFLKKDDIAEFGKLMNKSHTSLRDDYEVTGLELDSLVEAAWEEKGTVGSRMTGAGFGGCTVSIVENDYVDSFIKNVGKKYKEKTGLEASFYIANIGDGAGKVK

SEQ ID NO: 47626 - protein, 329 aa, Fusobacterium nucleatum subsp. nucleatum ATCC 25586
MSILVCGGAGYIGSHVVKYLLEKNEDVVVVDSLITGHIDAVDEKAHLELGDLKDEEFLNRVFEKYQIDGVIDFAAFSLVGESVGEPLKYFENNFYGTLCLLKVMKNNNVDKIVFSSTAATYGEAENMPILETDRTEPTNPYGESKLAVEKMFKWCANAYGLKYTALRYFNVAGAYPSGEIGEAHTCETHLIPLILQVALGQREKISIYGDDYPTPDGTCIRDYIHVMDLADAHYLALNRLRNGGDSQIFNLGNGEGFSVKEVIEVTRKVTGYPIPAEVSPRRAGDPARLIASSKKAIDELKWKPKYDKLEQIIETAWNWHKNHPNGYED

SEQ ID NO: 47627 - protein, 328 aa, Podospora anserina
MVCALFLNRIGVEDLLIAGIGLFLGSGRSLASAGPGGAVLCYILMGTVQNYHLFCVICPDLLTVTSHRVKMTALMSVNAPVMEFPRRFMSRGVGFAVGWVYWFAYAVLAGEQLVAVSNAINSRWVRGLIMPCGYPCFRPMLMLPFKVFGELEYIFGCFKLMFIILLIMVGHSIEGSLGTLLGVWTTFTSVMSSYIGMDIVAATAAESRALSDVESMKMAARKINLRVITLYSLAMLPASFVVPMDHPFINGHSTSVGARSIFIIAVVEAGMPKVAHFFNAVFVFSAFTCGINSMYIATRVLHTLALRGQTGPEFITRRLRQCRSGVPS

SEQ ID NO: 47628 - protein, 324 aa, Glycine max
MAFRKTLAQRLLNITKVSSQALTNCRISSSSVIGRLSPRADEPVDPGENGLFRAPQLAGNLLDRLRTMGIAHNRIRLDGLTPPPPMEMVDTVTVKDARKLLKVAQVEMVKAKLRETRKSCITFSEFIGICDEHCSDQDQAVEIAKMLDNSAAVIVLGDVVFLRPEQVAKAIQGLLPVPGAKAHESVRREFEVMEKKKSAIDKKADTMVRRELWGGLGFMMVQTMAFMRLTFWELSWDVMEPICFYLTSMYCMAGYTFFLRTSKEPSFEGFYQVRFSSKQKHLMKLHNFDIEKYNQLRAACSPTTMPPKFDPSIALPFDNSSIHQ

SEQ ID NO: 47629 - protein, 256 aa, Mycobacterium sp. JLS
MTEFVKRNPDAPPGFFACEAAGLRWLAAAGGAACVPVIDCDATSLTLEHLDSAAPSRSAAAAFGARLAVTHDAGASGFGAGPDGWGGPGFFGPLQKPLPMSLTAHPTWGEFYADERLGPMGEHAAPRLTAAGREALAAVRDLCRAGRFDDGDPPARLHGDLWSGNLMWTPDGVVLIDPAAHGGHRETDLAMLALFGCPHFDEVIAGYQSVRPLRGGWRERIALHQLYPLLAHVVLFGGGYIRQTESALRSVLSDFA

SEQ ID NO: 47630 - protein, 420 aa, Podospora anserina
MVYRGLRLAARAAPKFALYNNNTALRQLPLQFQHVRTYADKIVKVPQMAESISEGTLKQWNKSVGDFVEQDEEIATIETDKIDVAVNAPEAGVIKEFLANEEDTVVVGQDLVRIELGGAPSGDKPAAEPKESAPEKKAEPEKAPEPKQEESKPAASAPPPPKQETPEPKSKPAPAAAPEKPATLGNREEKRVKMNRMRLRIAERLKQSQNTAASLTTFNEVDMSALMEFRNKYKEEVLKKTGVKLGFMSAFSRAAVLAMRDIPAVNASIEGPNGGDTIVYRDYVDISVAVATEKGLVTPVVRNAEAMDLVGIERSIAELGKKARDGKLTIEDMAGGTFTISNGGVFGSLMGTPIINLPQSAVLGLHATKERPVVVNGKIEIRPMMYLALTYDHRLLDGREAVQFLVKVKEYIEDPRKMLL

SEQ ID NO: 47631 - protein, 862 aa, Vitis vinifera
MVLSTSETSPMKTHKKRPFENHAHHQYRSFPPNFNRPRVDAVRDWPRGYGKFIPLTDSKVIGDNIAVGTAGNFQAPVEHSIQSSFSSTIDAEVRMHEVPRSYPPKEVLKSYSIVRDFPEGLKSASSSANNISPSEKFSAEPRPVEVMATCTKSPGQEMQDESAYNGALARRSYEGSNEVWNNFRGEVGETSGFVGKWAGDAEEVCILLGQEIQDGDSFGSALKMSACKETGNEVRNDCSRDFETYGVEGKWGVDAKEICASLGQEIQGGEACNRTLERSPWEATVNEVQNSSRDGETSGFMVRRDDDTKEISIHPQSERKLSELDPWCQTVGNKDDRGKNVLRNTVKEIEICSKDHQAIGNNSRVQGALNLFQELLEKLRREAILTGKKNVLRKLPVTAAMTLKRQQKWVNTTKRLGHVSGIEVGDTFHYRVELAIIGLHSHFQNGIDYMEKDGKVLAISVVDSGRYANDKESSDVLIYLGQGGNPMVGYNKQPEDQKLERGNLALKNSMDAKTPVRVTRGFQAMKVTSNGYTYDGLYFVDKYWQERGQFGKLVFKFQLKRITGEPKFDQRELNQSKDSEVRWKTIFNDISLGRKLKKSKKSKVCRKNILNDISLGKEERSIHVVNTIDYEKPQPFTYIARMAYLEGSKWSIPSGCDCTDGCSDSVKCACVLKNGGEIPFNCHGAIIETKPWVYECGPLCKCPPSCNNRVSQNGIRFSLEVFKTKSTGWGVRSRNYISSGSFICEYAGELIQDKEAKRRTANDEYLFDLDNGAFAIDAAKFGNVGRYINHSCSPNLYAQKVLYDHDDKRLPHIMLFATKNIPPMRELTYHYNYMVGQVLDINGQIKTKRCYCGSQECKGRMC

SEQ ID NO: 47632 - protein, 350 aa, Glycine max
MVSSSQHILVTGGAGFIGTHTVVQLLKAGFSVSIIDNFDNSVMEAVDRVRQVVGPLLSQNLQFTQGDLRNRDDLEKLFSKTTFDAVIHFAGLKAVAESVAKPRRYFDFNLVGTINLYEFMAKYNCKKMVFSSSATVYGQPEKIPCEEDFKLQAMNPYGRTKLFLEEIARDIQKAEPEWKIILLRYFNPVGAHESGKLGEDPKGIPNNLMPYIQQVAVGRLTELNVYGHDYPTRDGSAIRDYIHVMDLADGHIAALRKLFTTENIGCTAYNLGTGRGTSVLEMVAAFEKASGKKIPVKLCPRRPGDATEVYASTERAEKELGWKANYGVEEMCRDQWNWAKNNPWGYAGKP

SEQ ID NO: 47633 - protein, 334 aa, Acidovorax sp. JS42
MNDVMQAVEIAAFGPPEGLRLAERPVPQPGDGELLIRVAASGVNRPDVLQRKGNYAPPAGVSDLPGLEVAGVVESGDAAAMAQAGLRVGDRVCALVAGGGYAQWCVAPVAQCLPVPQGLSDVEAASLPETFFTVWSNVFDRGRLQAGEVLLVQGGSSGIGVTAIQLARARGATVIVTAGSDEKCAACLALGAHHAINYKTQDFVAEARRLTDGRGVDVVLDMVAGSYVAREVECLAEDGRVVIIAVQGGLDAQFNAGLVLRRRLTITGSTLRPLPVAFKGAIAQALREHVWPLLASGAVKPVIHTTFPAAQAAQAHALMESNQHVGKIVLTWTT

SEQ ID NO: 47634 - protein, 434 aa, Streptococcus pneumoniae
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAVARAAADYLEIPLYSYLGGFNTKALPTPMMNIINGGSHSDAPIAFQEFMILPVGAPTFKEALRYGAEIFHALKKILKSRGLETAVGDEGGFAPRFEGTEDGVETILAAIEAAGYVPGKDVFLGFDCASSEFYDKERKVYDYTKFEGEGAAVRTSAEQIDYLEELVNKYPIITIEDGMDENDWDGWKALTERLGKKVQLVGDDFFVTNTDYLARGIQEGAANSILIKVNQIGTLTETFEAIEMAKEAGYTAVVSHRSGETEDSTIADIAVATNAGQIKTGSLSRTDRIAKYNQLLRIEDQLGEVAEYRGLKSFYNLKK

SEQ ID NO: 47635 - protein, 250 aa, Acidovorax sp. JS42
MTQKKKLIAGNWKMNGSLQANAALLQALRDGLGAPGCGVAVAVPAPYLAQVQALVAGSEIALAAQDVSQHERGAFTGEVSVGMLRDFDARYALVGHSERRQYHGETDAVVAAKAQRALSGGVTPIVCVGETLAEREAGQTETVVKRQLAAVIHAVGHCVSEIVVAYEPVWAIGTGRTATPEQAQQVHAVLRAQLAAATESADRVLILYGGSLNAANAAELLAQPDIDGGLVGGASLKAADFLKIIAAAHS

SEQ ID NO: 47636 - protein, 313 aa, Geobacter sulfurreducens PCA
MPFSEPGKTKFQVDLRRHLRNQDISDNLVHLICEIAEASKYVINAVRTGDLGVAGTSNLYGEEQLALDVLSDRIIRKRLIHSGVVCNIASEEMDEIFQAQADADGLYSVAYDPLDGSSLVDVNLAVGTIVSIYEGCNLLQKGRNQVAAMYILYGPRVSLVYSVGKGVHEFTMNHLMEYTLSRENVTMKPDGDIYSPGGLRKKYLPETEKFVQHLESKGSKLRYSGGFVPDINQVLMKGKGIFMYPALNGSPNGKLRVLFELNPMAYLIENAGGAATDGKTPILDIEPQSLDQRAPIFIGCSNDVATAMEFMGG

SEQ ID NO: 47637 - protein, 336 aa, Pseudoalteromonas tunicata D2
MTTAKYAVSVLGAGSYGTALAICLARNNHAIGLWGRDASHIETLAKDRANERYLPGAAFPESLSLESDLQTVVSQSNTILVVVPSHAFAQALISIKPFLQPGSKVAWATKGLEPNTGRLLQDVAREILGDEISLAVVSGPTFAKEMAMGLPTAISVSSTDPLFVKQLSDYLHCGRSFRVYSNDDFIGVQLGGAVKNVIAIGAGISDGFGFGANARTALITRGLAEMCRLGCAMGAKPDTFMGMAGLGDLILTCTDNQSRNRRFGLALGQGSDVEKAQTEIGQVVEGYRNTKEVYLLAKRVGVEMPITEQIYQVLYEGKNVKEAAMSLLGREKKAES

SEQ ID NO: 47638 - protein, 165 aa, Brassica napus
  misc_feature (155)..(155): Xaa can be any naturally occurring amino acid
  misc_feature (163)..(163): Xaa can be any naturally occurring amino acid
REIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERERRRXDNPEAMEXDE

SEQ ID NO: 47639 - protein, 409 aa, Chlamydomonas reinhardtii
VSEMRREPALLAMSLVYLVQGLSDMAWLAEKYFLKDDLGASPAQVSLFLSLASVPWMVKPVLGFISDSLPLWGYRRRSYLLLASVAAAGSWVYLAVGASSLAATLWAMVLGSGAVALSDVVVDSMVVEKAREEEQDSAGNLQSLCWAAYAVGQVATAALSGSLVEAQGPRFVFGLTAAFPLLIGAASLMVHEERISSASSSSSSSGGGLVFSMLSHGSALWTALSAPAIAWPVTFLMLLSATPAADDAVFFFEVRGNAQGEGRGRRGAGGVGAVGLLHSFGVPGLESRHLTPVLALRPLCPPCVPCPWFGLDDRLFVLGGSVVTSVITNVLSMPTLVLAARLCPKGLEATMFATIMSLLNMADGVRYAGGAGLMAALGVSGGSYDNLPLLVGLCNACLLLPLPVLALVP

SEQ ID NO: 47640 - protein, 245 aa, Triticum aestivum
  misc_feature (23)..(23): Xaa can be any naturally occurring amino acid
NVHHSVYKEEPVEILPCHAPLKXGGLCQRRDLKICPFHGPIIPRDARGNPIGKIGGSSDAGGDPLEQKVDIREAGGNPINTNGGIDSEYTQEEGQEPSTSMMTSINNDTSDIDGAHDLSKITMDQLAMQAIKNVRKRDMDDKARERAQRARIRQHNEDVLRQAAIASTPHSAAAYDQPSGTLGRCGRRRGKTKEPTLSSMLKKKVTAKDRISGRLLNGRARDATIREASNTEDMTYREAFPNQWQ

SEQ ID NO: 47641 - protein, 360 aa, Methylococcus capsulatus str. Bath
MTIKIAVLPGDGIGPEIVAEALKVLDCLRSDFGLAVETEHALIGGAAYDAHGTPFPKETLELCRAADSILLGAVGGPKWEPLDYSLRPERGLLGLRSELELFSNLRPAVLYPQLVSASTLKPEVVAGLDIMIVRELTGGIYFGKPRGRRINEDGEREGYNTLVYSESEIRRIAHSAFQIARKRNRRLCSIDKANVLECTELWREVVIEVGKDYPDVALSHMYVDNAAMQLVRNPKQFDVMLTDNMFGDILSDCAAMLTGSIGMLPSASLAESGKGMYEPIHGSAPDIAGRGIANPIATILSLAMMLRYSFDDAVSAERIGKAVQTALDQGFRTADIASEGTVEVGTAAMGDAIVAALRAV

SEQ ID NO: 47642 - protein, 458 aa, Geobacter sulfurreducens PCA
MERILVVEDDRFFRQMYVDLLKEEGYEVDTVASGTEGLKRLEKQEYHLVITDLVMPGMSGIEVLSRVKQKAPNVDVILVTGHANLESAVYALKNGARDYILKPFNHDEFKHTVALCFEQRRLINENYELKELLNLFQVGQNIANCIDLERLSAVVVDAFCKEVGVSRAIGLFPEKSEPHALKELRGLEPEVAAALAEKALTLCSDAAETAGGFRRLDGSHFSDGLLRTAGINGALVVSIRQRTLLQGVLLLVNDQGKPFPAVFKHKSIQFLLEQASLAFDNALRYSSARDMLYVDELTGLFNYRYLDISLDRELKRADRFGSVVSMIFIDMDHFKGVNDTHGHLFGSQVLHEVGQLLKKSVREVDVIIRYGGDEFTIILVETGEKGAATVAERIRRSIEDHHFLASEGLDVRLTASLGYACYPLDTQSKMELLELADKAMYRGKEEGKNRVFRATAIR

SEQ ID NO: 47643 - protein, 514 aa, Pseudoalteromonas tunicata D2
MTLKKKPLVLIILDGWGYREDPESNAILAANTPVMDKLWQTCPSTLISGSGLDVGLPPGQMGNSEVGHVNLGAGRIVYQDFTRITKSIADGDFFENPTFVNAIDQAVKNNKAVHLMGLLSPGGVHSHVDHILATIELAAKRGAKAVYLHAFLDGRDTAPRSAQESIDLVDKKFNELQCGRIASLIGRYYAMDRDNRWDRVEKAYNLMTQASAEYHFNDATSALKAAYNRNENDEFVAATSITPAKQDTAQINDGDAVLFLNFRADRARQMSRVFVDKNFDGFVKQKAPELAAFVTMTEYAKDIPAPSAFPSVALTNVLGEWLAKHNKTQLRISETEKYAHVTFFFSGGREALFEGEDRILIPSPQVATYDLQPEMNSEMLTDKLVEAIHAGQHDVIICNYPNGDMVGHSGVFSAAVKACEAVDHCIGRVIEALTQTGGEALITADHGNAEQMQNEETGQAHTAHTSEPVPFIYFGRQAQAYSDKKLSDVAPTMLHLLGMAQPEEMTGTTIMQVQ

SEQ ID NO: 47644 - protein, 474 aa, Bacillus thuringiensis serovar konkukian str. 97-27
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERMDDFLSKLRKAMETVVVGDPLIEETDVSALISKKDVERIDNWVQEAVKEGANVLYGGNKRDERVFEPTVLTNVPEHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 47645 - protein, 209 aa, Methanothermobacter marburgensis str. Marburg
MPLIGDKFPEMEVQTTHGLMKLPAEFKGRWFILFSHPADFTPVCTTEFVAFQEVYPELRELDCELVGLSVDQVFSHIKWIEWIEENLDTEIEFPVIADTGRVADTLGLIHPARPTNTVRAVFVVDPEGIIRAILYYPQELGRNIPEIVRMIRAFRVIDAEGVAAPANWPDNQLIGDHVIVPPASDIETARKRKEEYECYDLALPPQRKW

SEQ ID NO: 47646 - protein, 364 aa, Pseudomonas syringae pv. tomato str. DC3000
MSAVNRAAVETILRQYTDPYLNQDPVSAGCVRSIDIDGAHVSVQLELGYAADLFRNGWAHVLKTAIENLDGVGSATVAIKSVISAHKAQSQIPGLANVKNIVAVASGKGGVGKSTTAANLALALSREGARVGILDADIYGPSQGVMFGIPEGTRPKIKEQKWFVPIEAHGIEVMSMAFLTDDNTPMVWRGPMVSGALLQLVTQTAWNDLDYLVIDMPPGTGDIQLTLAQKVPVAGAVIVTTPQDLALLDAKKGVEMFRKVNIPVLGVVENMAVHICSNCGHAEPLFGEGGGEKLASQYDVELLASLPLSMLIREQADGGKPTAIAEPDSQIAMVYQELARYVGARIVLQEAASPAMPTISVSDD

SEQ ID NO: 47647 - protein, 297 aa, Methanopyrus kandleri AV19
MLDVVGLGALNVDELLYIPRMPERDDSVPVERRVRRGGGSAANTICWLAHLGREVGFVGKVGSDDAGDLLLREFEEYGVDTSRVVRGDGHSGTAFCLVSGDDRRILVDPGVNDELRPDEVDLDYIRKARVLHTSSFIGLRSETSLETLKRTMKAVADELMVTFSPATMVLRGWSYLEPYFEAADVVFLNETEAVHLTGDIEETLNRLAELVEVTIVTRGSDPAIVQEGTEISEVAPEPVPEEDIVDPTGAGDAFAAGFIEGILRGEPADRCCERGHAVAAECLRIEGCRPPTEGRSE

SEQ ID NO: 47648 - protein, 400 aa, Campylobacter jejuni RM1221
MLIVQKYGGTSVGTLERIEAVANRVIQSVQQGDQLVVVVSAMSGVTNTLIEQAEYFSKTPNGKDMDMLLSSGERVSCALLSIALNEKGYPAISFSGRKAGIITDSVFTKARIHHIDTKAIKSELQNGKIVVIAGFQGVDEEGNVTTLGRGGSDLSAVAVAGALNADLCEIYTDVDGVYTTDPRIEPKAKKLDKISYEEMLELASLGAKVLQNRSVELAKKLNVNLVTRSSFNNNEGTMITKEDGMEQALVSGIALDKNQARVTLRNVEDKPGIAAEIFSVLANENINVDMIIQNVGVDGATNLGFTVPQNELELAKNAMQKILSSKTTIESDSAVVKVSIVGVGMKSHSGVASKAFKALADEGINIGMISTSEIKISMIVHEKYGELAVRALHECYGLDK

SEQ ID NO: 47649 - protein, 71 aa, Glycine max
  misc_feature (50)..(50): Xaa can be any naturally occurring amino acid
LCGAAVTTVNRAGACMVSPFTGGKSMAGFPTMNTNTDITFIVSNWGRVAXMQAWPPVGQKMFETLAYLPDL

SEQ ID NO: 47650 - protein, 145 aa, Oryza sativa
  misc_feature (9)..(9): Xaa can be any naturally occurring amino acid
  misc_feature (19)..(19): Xaa can be any naturally occurring amino acid
  misc_feature (27)..(27): Xaa can be any naturally occurring amino acid
  misc_feature (38)..(38): Xaa can be any naturally occurring amino acid
  misc_feature (51)..(51): Xaa can be any naturally occurring amino acid
  misc_feature (56)..(56): Xaa can be any naturally occurring amino acid
  misc_feature (64)..(64): Xaa can be any naturally occurring amino acid
  misc_feature (88)..(88): Xaa can be any naturally occurring amino acid
  misc_feature (96)..(96): Xaa can be any naturally occurring amino acid
  misc_feature (112)..(112): Xaa can be any naturally occurring amino acid
  misc_feature (120)..(120): Xaa can be any naturally occurring amino acid
  misc_feature (124)..(124): Xaa can be any naturally occurring amino acid
  misc_feature (135)..(135): Xaa can be any naturally occurring amino acid
MAPSVMASXTTVAPFQGLXSTAGMPVXRRSGNSSFGNXSNGGRIRCMHIWXIEGIXKFETLSYXPPLTVEDLLKQIEYLLRSKWVPCXEFSKVGFXYRENHSPRLLRRQYWXMWKLPMFXCSDXTQVLKELEEAXAYPDAFVRII

SEQ ID NO: 47651 - protein, 490 aa, Leptospira interrogans serovar Copenhageni str. Fiocruz L1-130
MRKFDKTLFHEFRRIYKFMPESYDLTVIGAGPGGYVAAIRAAQLGMNVCIIEKDKPGGICLNWGCIPTKALLESAHLLEKLHSAKEYGINLSDPKPDFAAIIRRSRNVAEGMASGVEFLLNKNKITRKKGTAVFKDPNTIWLPDSSKEEITSKYFILATGARARELPDLPFDSHTVLSSKTAMIQDKIPESLLIVGAGAIGVEFADFYSTMGTKVTLVEMMDQILPVEDKEISTFLEKSFVKRGIRVLTGVGVSDPKIVNGKVKVLLKGKNLPEAVESFEAEKILVSIGLVPNTDSMHLEEIGIFLQKGFVKTDTKYKTSVPHIYAIGDCNGAPLLAHVASMEGIKAVEAISIHAGNPHHLSYIPIDYNAIPGCTYCHPEVASIGFTEKKATDMGYTISVGKFPFVASGRAKAMGDTGGFTKVIVDKTSGEILGAHLIGPGVTELLPAVSLGITQELTAKEIASTIFAHPTLSETVMESFGAALGEAINL

SEQ ID NO: 47652 - protein, 499 aa, Coccidioides immitis RS
MADRLLKKIPYTFKDPSLLDTRSLIGGKWVEARSGKTFPVFDPEDNKEVCQVTDLDVDDVCAAIDAASEAFKTFKNAPHRERRWLMRRWADLIKENKDDLAAICTLELGKPFTESLVTVKYGTDFLDWFEGEIERVYGETIPAARGNNRIFTIKQPQGVVAAITPWNSPIAMVTRKVGAAIAAGNTVICKPAPETPLCAIAVAKLFERAGGPPGVLNIITSSPETTPAVGAELCSNKLIRHLSFTGSTAVGRYLHTECSKTFKKTSMELGGNAPFIIFEDANIDKAVDGLISSKFRSSGQTCVCANRIFVHSSIISQFASRLHTRLGETFTYGSVWDRNVNFGPLYSPKAFDKLTRQTKDALERGGELIGEDPAKLQAQYGPNFYPPTIVTNANKDMLFMKEETFGPLAFLVPFETEEEAVAMANNVDAGLASYFYTEDISRMYRVSEALESGMVGCRVGLISACEQPFGGIKDSGMGREGGKGALDEYLNIKSVTVGI

SEQ ID NO: 47653 - protein, 533 aa, Podospora anserina
MGADQSTPRGASQAATTVTQQKTCYYEVLGVDRQVPDEEIRRAYKKKALELHPDRNYHDTENATRKFAELQTAYEILSDPQERAWYDSHRDAILRGDDEVAGGVPGGQDPGNHTSANAVFALMSRFNSSVPMDDSPRGFFGILNVFFEQLAAEEAAACEWDGTTPTHYPPFGKAEDDYNTVGKSFYNVWSSFSTRKSFQWKDVHHLAHAPDRRIRRLMEKENKKLRDEGIREFNDAVLSLVAFVKKRDPRYVPNTQSEAERQQVLRNSAAAQAARSRAAHQEKMAEYVVPDWAQPKERQDYEGEFSMSEEESEVEEIECVVCNKTFRSEKQFEAHEKSKKHIKAVQQLKRQMRKENMHFDLNPQDSPGASTPQSPQPEQDAQVIQRERDMTNTAPLASEDGRIGEEKQGPVEQDDDQEQSTQSSSSPEDDEYAPRSTVEERIVNGAGATKKVSQPQADDSGDLADSTAASVANLTLSEPAPGKKVGKAKLKREKKAARQAESQIQDSVGFCVLQSSIMIFDADCWASATMCGM

SEQ ID NO: 47654 - protein, 678 aa, Oryza sativa Indica Group
MEEMILAKFLFSSHNSQWTARFPYLVKYKLEEGDEASQVAQLDWRIIEGDIEKPFISSGLEFVPLPVMHGEGYVCLGFLFGRKARIAYLSDILRFLPKTEHAISKSGAGQLDLLILEANSLHGEALDAVKRISPKRALLTGMAHEIEYYKENQKLAEWSSRLWKLVVNVNDSNHAFCKKEKRMMDAKICTDTEARDIDECALRRQGGQYEDVYPCKHGICINTPGSYRCKCKTGTKPDGTNFGCQQVLPMAAKVIIGLSACSIFVMALSCLLVIQLQRRRHIIEKQEYFRRNGGLRLYDEMVSRQVDTVRVLTVDELKKATDNFSDARVLGRGGHGTVYRGTLDDLREVAIKRSKAAVDDGGGDGGGGGGCKEEFVNEIIVLSQINHRHVVRLLGCCLEVHVPMLVYEFVPNGTLFELLHGGGGGAARRRRPVSLGLRLKIAAQSAEALAYLHSSASRAILHGDVKSLNILLDGALDAKVADFGASALRSMGEGEFIEFVQGTLGYLDPESFVSRELTDKSDVYSFGIVLAELITRKKAVYDDGGGGGSGEKRSLSSTFLAASSRGELWRVVDRDIMDGDGDADAAVVRELARVAEECMGARGEERPAMKEVAERLQVLRRVEMQAAAAGVEVVDGFNGGGLVGRHGHLDTTMTTTTTSYYQSMETDKLQLDVDDLVR

SEQ ID NO: 47655 - protein, 573 aa, Kluyveromyces lactis NRRL Y-1140
MSDSVSSLSDKNNFVITSQEVKNRVDVVTSLRTITSRRVGDVNYINAKTAHDDTELLAEIGYKQELQRHFSKTQVFGVAFSIMGLLPSIASILGVALPGGSVSLVWGWAISGAFVLANGLAMSELASAIPTSGGLYYYTHYYAPPKVKNFLSFIVGNCNSLALISCLCSINYGLAGEILSIVVVGSNGNFNITNANTYGVYAACIIATAVVTSVATTAVSRLQTFSIVSNLLLICIFFVVLPVGVARSKDMEFNDAAYIFGDFENLSDWNNGWQFMLAGFQPLIWVIGGFDSCLHMSEEAKNATASVPFGIIGSISVCWFLGFFICIVIAACSSQDVAALVNTKFHQPLAQVLFDALGKKWTIAIMTLIAFCQFLMAASSLTAISRQIWAFARDDGLPFSSWIKVVNVKLSSPLRATWVGAGVALAIGCLCLIGPVASSALFSLYISANYFSWMLPNLLRMTYGKDVFTPGAFFMGKYLSPVVNWISIIFELFMILLVFFPTEQHGITPDTMNYSVVFIGAVWFLATIYYFIYKHKFYKGPKSNLTDEEYEENVGQDVLDAILSKSQDWDKTE

SEQ ID NO: 47656 - protein, 432 aa, Actinobacillus pleuropneumoniae serovar 1 str. 4074
MRTTELIELDQKHIWHPYSSITHPIPTYPVERADGVIITLKDGKKLIDGMSSWWAALHGYNHPRLNQAATEQLSKMSHIMFGGLTHEPAAKLSQKLLEILPPELNKIFFADSGSVAVEVAMKMALQYAQASGQKNAKKRTKFATIRSGYHGDTWHAMSVCDPVTGMHGLFNSSLPVQYFLPQPSVKFGEAWRDEAILPLQDLFEQHGDEIAALILEPVVQGAGGMYFYSPVYLQKARELCDRFGILLIFDEIATGFGRTGKLFALQHAEVVPDIICLGKALTGGYLTLSATVTTEKVATVICEGEAKCFMHGPTFMANPLACAIAYESINLLLESDWQANIQRIERQLLEELAPAKHFKSVAEVRVLGAIGVLEMQQPVDLVPLQKLFVEHGIWVRPFGKLVYIMPPFIISQAELTQLTSALLQVLKIAYNE

SEQ ID NO: 47657 - protein, 323 aa, Sorghum bicolor
MDTTSRAAKIPSLHQTEINWDNLDKTKLYVVGAGMFSGVTVALYPVSVVKTRMQVASGDAMRRNALATFKNILKMDGVPGLYRGFATVIIGAVPTRIIFLTALETTKAASLKLVEPFKLSEPVRAAFANGLAGLSASTCSQAIFVPIDVISQKLMVQGYSGNARYKGGLDVARKVIKADGIRGLYRGFGLSVMTYAPSSAVWWASYGSSQRIIWSALGHLHDKEEAPSQLKLVGVQASGGVFAGAVTSFVTTPIDTIKTRLQVMDNENKPKAREVVKRLIAEDGWKGLYRGLGPRFFSSSAWGTSMIVCYEYLKRLCAKVEEV

SEQ ID NO: 47658 - protein, 553 aa, Aspergillus nidulans FGSC A4
MPSFSQAVELPAWKELQDHHGSVGRNIVLKECFEKDPQRFEKFSRTFQNTVDNNEILFDFSKNFLTEETLALLVKLAKQAGVEELRDQMFAGEPINFTENRAVYHAALRNVSNQPMQVNGKSVVEDVNSVLEHMKEFSEQVRSGEWKGYTGKKINTIINIGIGGSDLGPVMVTEALKPYGHPDLKLHFVSNIDGTHIAEALKDSDPETTLFLIASKTFTTAETTTNANTAKSWFLEHAKDGAHIAKHFVALSTNAEEVAKFGIDTKNMFGFESWVGGRYSVWSAIGLSVALYIGYDNFHQFLAGAHAMDKHFRETPLEQNIPVLGGLLSVWYSDFFGAQTHLVAPFDQYLHRFPAYLQQLSMESNGKAITRTGEYVKYTTGPVLFGEPATNAQHSFFQLLHQGTKLIPADFIMAAESHNPVEGGKHQRMLASNFLAQSEALMVGKTPEQVKAEGAADNLVPHKTFLGNRPTTSILAQKITPAALGALITYYEHLTFTEGAIWNINSFDQWGVELGKVLAKKIQKELETEGEGSGHDSSTSGLLLAFKKKAKLA

SEQ ID NO: 47659 - protein, 552 aa, Ralstonia solanacearum GMI1000
MSRLPFLARMSHHRFAWQNPYPTVRIPLFARNVVSTSHPLAAQAGLRMLLAGGSAVDAAIAAAAMLTIVEPVSCGLGSDAFAILWDGARLYGLNASGAAPRDWSLGYFRRKYGEDAHGHPRRPTRGWDTVTVPGAVSAWATLHERFGKLPFADVLEPAAEIAERGHAIAPIVAHKWAAAIPELHGQPGYAQAFMPHGRAPGVGEKFLLRDAAATLRRIGETRGRDFYEGELAKRIAAHAHACGGALTAQDLRDHRPEWVTPIQQRYRGYDVHELPPNGQGIAALAALGILERFDLGALPVDSADTLHLQIEAMKLAFADLYRYVADPRAMDVTPEQMLDDSYLDARARRIDMGRAGHPGFGMPRAGGTVYLSAADERGMMVSFIQSNYMGFGSGVVVPGTGISLQNRGVGFSMDARSANVVEGGKRPFHTIIPAFLTRDGAPVMSFGVMGGDMQPQGHLQTLVRMLDYHQQPQAACDAPRWKVNRDFTLDVEAALNADTVAALQARGHRLKAVADPYMDFGAGQFIWRLSDDADHGYVAASDSRRDGHAVGY

SEQ ID NO: 47660 - protein, 370 aa, Rhodococcus sp. RHA1
MAPRPLRRHPPLHHSFHESRRDPVADKHRINFEPVDIEMEVGEDEYILDAAFRQGIHLMHGCREGRCSACKSFVLEGDIQMEDYSTFACNDAEVDEGHVLLCRSTAYSDCTIELLNFDEDELLGGVPIQDVRTRVTRIEPMTKDIVSLRLAPVEPAGYEFKPGQYSDLHIPGTEEHRSFSMATTRSTPGHVEFLIKKYPGGKFAGLLEDGISVGDEIALTGPYGSFTIKEGHVLPMVFIGGGAGMAPLLSLLRHMSETGNTRQVHFYYGARTPQDLFYVDEILELGRGLTDFTFVACLSESMDPPPVGAIAVEDGNVTDVVGRREPDIGRAEVYLCGPPPMVDAALELLEANGTPKDQIFYDKFTSPAFE

SEQ ID NO: 47661 - protein, 855 aa, Sorghum bicolor
MAFSPRSPWSRPKRNDVYSTFVVHGDDDEDDARGSRRGRGPSTRAEEDEEEDPSSLPPLLQRLPKDFGGPSFDEDEDAYSSDPDDASLSATVVFKSGAPASARSPFLDLRRSSPRATDDDPYSTFVVHSTARSGGTSSSPRGSASGTFIRRSGGSSSPHESVSGTFIRRTSTPSSPRDSVSGTFIRRPGSPSSPRGSFSGTFIRHTSGGSSSYESASGGGGGFGSSFWSPAVEQTEELRQPSPLMQQQQQQHSRRKPSVSSAPDSVTREDPSTKYELLHELGKGSYGAVYKARDLRTQELVAVKIISLTEGEEGYEDIRGEIEMLQQCSHPNVVRYFGSYQGEDYLWIVMEYCGGGSVADLIGITEEPLDESQIAYICREALKGLAYLHSIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDPRLRPAASEMVKHKFIEKCNSGASKMLAKIKEAKKIRATLAVQNELSDPDNTMQDVPVRINEDYGETVPTNSQQHMNHGTYNDCQAGDFGTMIVHTEDGDEVAESPIFPRTEFIPGLGSINSFTHDPKRAELISSFWAENTGDSDANKDRDLDDRPDIQESKAIPPLTGTVKKHIGAEGTIRRHDNQVNLSPGFANTTKLNSSPSRKAFSVQDKLWSIYAAGNTVPIPFLKAIDISPLALVSENEAGNGLAGSSTNDALEAVRELFSGDGQAKKGRKGQNEVPLPPGVHHRLMTSPTLMNLAQALAYHKTCYEDMPLQDSQATQEQQTIQNLCDTLRTILRL

SEQ ID NO: 47662 - protein, 287 aa, Triticum aestivum
  misc_feature (217)..(217): Xaa can be any naturally occurring amino acid
  misc_feature (238)..(238): Xaa can be any naturally occurring amino acid
  misc_feature (248)..(248): Xaa can be any naturally occurring amino acid
  misc_feature (259)..(259): Xaa can be any naturally occurring amino acid
  misc_feature (267)..(267): Xaa can be any naturally occurring amino acid
  misc_feature (272)..(272): Xaa can be any naturally occurring amino acid
  misc_feature (278)..(278): Xaa can be any naturally occurring amino acid
LRPAIYGDTIEYSSYASNALGALPYGRPAGGRTSDFERPPGQVCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKXATYNQIKAAIREESEGDTSGXFGVYVDEDLXSTDFQGGHRSXIFDARRAXIALNXHFVQLXSWYDHSGDQ

SEQ ID NO: 47663 - protein, 255 aa, Triticum aestivum
RLVPEEAIPEVSTYLCESFGNKARIDYGTGHEANFMAWLLCLEKLNVLEQKDDTVVVLRIFVKYIRVMRHLQFEYWLEPAGSHGVWGLDDYHFLPFLFGSSQLLDHKYIKPKSIHDKDVVDQFHQSYMYLACIHFINSVKTTASLRWHSPMLDDISACKTWAKVNQGMIKMYKAEVLAKLPIMQHFMFGSLISFDGGQVMSAELDSHCGHVHNTDNQETENEQEYPECCGIPVPSAIAAAAVSKNTSIFRPLPFD

SEQ ID NO: 47664 - protein, 484 aa, Klebsiella pneumoniae subsp. pneumoniae MGH 78578
MNTKHENAAEHHAAKRHWLNSHEAGYHKAMGNRQVQMIAIGGAIGTGLFLGAGARLQMAGPALALVYLVCGIFSFFILRALGELVLHRPSSGSFVSYAREFLGEKAAYVAGWMYFVNWAMTGIVDITAVALYMHYWGAFGDVPQWVFALGALAIVGTMNMIGVKWFAEMEFWFALVKVLAIVAFLVVGTIFLGSGKPLDGNATGFHLITDNGGFFPHGLLPALVLVQGVVFAFASIELVGTAAGECKDPETMVPKAINSVIWRIGLFYVGSVVLLVLLLPWNAYQAGQSPFVTFFSKLGVPYIGSVMNIVVLTAALSSLNSGLYSTGRILRSMSMGGSAPKFMSKMSRHHVPYAGILATLGVYVVGVFLNYLVPSQVFEIVLNVASLGIIASWGFIVVCQMRLRKAIKEGKAAKVSFRMPGAPFTSWLTLLFLFSVLVLMAFDYPNGTYTIGSIPLLAVLLVAGWFGVRKRVHEIHSTAPTLRK

SEQ ID NO: 47665 - protein, 341 aa, Rhodococcus sp. RHA1
MKAVQVVGYHTKLQLTDIPEPTIDGPLDVIVRIGGAGVCRTDLHILEGQWEAKSGVALPYTIGHENSGWVHAVGDAVTNVTVGDKVILHPLITCGLCRACRSGDDVHCQNSTFPGIDVNGGYAEYLRTTARSVVRIDDSLEPADVAALADAGLTAYHAVAKVAKTTRPGDVCVVIGAGGLGHIGIQVLKAISGVTVVVLDRNPAAVELAVKIGADHGIVADGTHIQQVLDLTGGHGAEAVVDFVGEGGATAEGIAMLRRAGNYYVVGYGENIDVPTIDVISTEINFIGNLVGSYNDLQELMTLAAQGKVTLHTTRYRLEDFQQALDDLDAGRVRGRAILVP

SEQ ID NO: 47666 - protein, 475 aa, Rickettsia montanensis
MNLLKNITGKNYINGEFIEFGKQISVINPATLKEIATVPNLGLSEINSAINNTVTSFSSWSQSSFEARIAILRRWYNLVIENIEELSHILTLEQGKVLAESKKEILYGVSFIDWYTYAIHNIHSTIKPGNSKAHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGSTNVGKILYQNAANTLKRLSLELGGNAPFIITADNNLEKVVSDLITAKTRNSGQSCISPNRIFIEESIYEKFIEILKAKFTKLKAGDGFDKESDVGPLINSAAIEKIQKLLADAQSKGAKLICGGKAVDNFIEPTIIIDCLDNMDIFRTEIFGPVVACYKFKDLDEVIERANNTEYGLQGYVYSNNISVVQMIASKLDFGMVSINDPLPANAKAPFAGRKASGFGVEGSFEGIFEYLNTKYINLQH

SEQ ID NO: 47667 - protein, 157 aa, Sorghum bicolor
MADAARLFLLVAVTAALAGRSDAAWCVCRTDLADTALQKTLDYACGGGADCKPILQNGACFAPDTVKAHCSYAVNSFYQRNNQNPQACVFSGTATLSNNDPSGNGCTYPATPSPPTMGPSALNDNSGAAGVLPTAAGLATRLVILACCSLVALYLGA

SEQ ID NO: 47668 - protein, 586 aa, Lactobacillus johnsonii NCC 533
MNKHPEFLLNKIKSPKDLKKLDLKELEQLASEIRTLILEKDAAKGGHLGPDLGIVEATIAYHYVFDAPKDKIVWDVSHQTYPHKMLTGRAYGWLDPDKYEDVTPYSNPEESPYDYFAVGHTSTSIALATGMARARDMLGEHENITALIGDGSLTGGLAFEGFNNAADEKHNLIIVVNDNQMSIDDNVGGVVTALKKLRESNGQTADNPFTAMGLDYKYVDQGNDLKAMIDAFKSIKDIDHPIVLHINTLKGKGYEPAIENEASHHWVLPFDLKTDKTTVPAPKTPNPTTVVLDFLKKHIENQENILAINAAIPGVFGLGEIKNKYPKNYKDVGIAEQESVAFAAGAVKEGITPVLFENSTFLQRAYDQLSHDVAANDLPVVMVVAGGGITGTSKTHLGIFDNAMVANWPNWEYLAPTTLNELKSMLEWAVKQRKHPIAIKSPVNPIPEGEPVDEDYSTIKYDVKPGSKVAIIGLGDFYQLGEKVVDLLKTENINATLINPKSAAHLDYDALDKLQNDHELVVTLEDNSIDGGFGQKIASYYGPTKMMVKNYGAKKEYTDNEPKESIYKRDHLMPDQIVSDILGILK

SEQ ID NO: 47669 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQFEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 47670 - protein, 151 aa, Triticum aestivum
MAKCSKIRNIVWLRQTLRRWRSRAAARTAAGGGAGAVSVPAGHVAVCVGGSSRRFVVRAAHLNHPVFRELLRQAEEEYGFPSGASGACGPIALPCDEGLFEHVLRHLSSSSSAARFFTLEDIKSGAYSCCCAAAGDALPLLRGISSDKFVW

SEQ ID NO: 47671 - protein, 456 aa, Arabidopsis thaliana
MWCLPSVRPNVSEMFFKSPMLKPTARFSSTSSPYLPPSFSVAPMMDWTDNHYRTLARLITKHAWLYTEMIAAETLVHQQTNLDRFLAFSPQQHPIVLQLGGSNVENLAKAAKLSDAYGYDEINLNCGCPSPKVAGHGCFGVSLMLKPKVRYFTPPHDFKRYLLFLNFTLSFKLVGEAMSAIAANTNVPVTVKCRIGVDNHDSYDELCELFLLSVFLKSRMDLPLRSNTAFPLLLGDFIYKVSTLSPTRHFIVHSRKALLGGISPADNRRIPPLKYEYYYALVRDFPDLRFTINGGITSVSKVNAALKEGAHGVMVGRAAYNNPWQTLGQVDTAVYGVPSSGLTRRQVLEQYQVYGDSVLGTHGNGRPNVRDLVKPLLNLFHSENGNSLWKRRADAAFKECRSVGSLLEESLRAIPDCVLDSPISGSPESGDEDVFADVHNVLPPPYEAGEEIILCA

SEQ ID NO: 47672 - protein, 332 aa, Corynebacterium glutamicum ATCC 13032
MVSVSVMGAGSWGTTLAKVFSDAGNAVTLWARREELASTIRDSHENRDYLPGITLPESLQVTSSATEALEGAAIVVLAIPSQALRGNLAEWKETIPQDATLVSLAKGIEKGTHLRMSEVIAEVTEADPSRIAVLSGPNLAREIAEGQPAATVIACPDENRAKLVQAAVAAPYFRPYTNTDVVGTEIGGACKNVIALACGISHGYGLGENTNASLITRGLAEIARLGATLGADAKTFSGLAGMGDLVATCSSPLSRNRSFGERLGQGESLEKAREATNGQVAEGVISSQSIFDLATKLGVEMPITQAVYGVCHRDMKVTDMIVALMGRSKKAE

SEQ ID NO: 47673 - protein, 448 aa, Corynebacterium diphtheriae NCTC 13129
MSPIDEKVQGYYELLLKRNPAEPEFHQAVNEVLDSLKIVLEKDPHYADYGLIQRLCEPERQLMFRVPWVDDNGVVQVNRGFRVQFNSAIGPYKGGLRFHPSVNLGIIKFLGFEQIFKNSLTGLPIGGGKGGSDFDPKGKSDVEIMRFCQSFMTELYRHIGEYRDVPAGDIGVGGREIGYLFGQYRRLANQHESGVLTGKGLTWGGSLVRTEATGYGLVYFTAEMLAHHGQSFEGKKVIVSGSGNVAIYAIEKAQELGATVIGFSDSSAWVETPNGVDVAKLKEIKEVRRERVSSYVDEVEGAILHTEGSIWDLTCDVALPCATQNELDGEHAKKLADNGCAFVAEGANMPSTADAIEVYRERGIHFGPGKAANAGGVATSALEMQQNASRDSWSFEYADQRLREIMKGIFKNCESTAREYGHEGDYVVGANIAGFKKVADAMLAQGVI

SEQ ID NO: 47674 - protein, 73 aa, Escherichia coli
MSKQQIGVVGMAVMGRNLALNIESRGYTVSIFNRSREKTEEVIAENPGKKLVPYYTVKEFVESLETPRRILLM

SEQ ID NO: 47675 - protein, 262 aa, Pleurotus pulmonarius
IHWHGFFQKGSSWADGPAFVTQCPIVPGDSFLYSFSAPDQAGTFWYHSHLSTQYCDGLRGAFVVYDPEDPHRSLYDVDDENTVITLADWYHTPAPSAGPAPVSEATLINGLGLYQDGPSSPLAVIHVKLGSRYRFRLVSISCDPNHIFSVDGHNMTIIEVDGVNTRPLAVDSIQIFPGQRYSFVLHANQKVDNYWIRASPNLGPQGRHLNLTSTKNIVLHICRFRWRPQFCHPPIRRGSRNDPSSPESQARIGCSKQPCTLE

SEQ ID NO: 47676 - protein, 457 aa, Prochlorococcus marinus str. MIT 9211
MMMSSLLSVLSTHDIEVAETLIGVIRFLLIFVAARTLAEILVRLSLPTIVGELLAGVLIGASGLHLLLPPSAHASLNEGFINVISSLASIPAEAVPDLYFETFPSLQAVATLGLYALLFLTGLESELEELVAVGAQAFTVAMAGVILPFAFGTFGLMFLFQVDLIPAIFAGASMTATSIGITASVFGELGYLKTREGQIVIGAAVLDDILGIVILAVVVALATGGALEIAPIVKLVLAATVFVIAAIALSRTAAPGFDWLLDRLKAPGAVVVASFVILVLSCFVATAIGLEAALGAFAAGLILSSSKNNHAIQQSVLPLVSLFATIFFVLVGAGMDLSVINPLDPSSRSALIVAGFLLVVAILGKIASGWSFVIDKPTNRLVVGLGMMPRGEVGLIFLGLGTSAGLLTPSLEAAILLMVIGTTFLAPVLLRLVLKDKKPGGGNSIPDEVAADPVGLI

SEQ ID NO: 47677 - protein, 573 aa, Thermococcus kodakarensis KOD1
MEEIRELVLKYALINAYTHRGKANPKAVIGKVLGENPELRKRAKEIIPLVNEVVNEVNSLSLEEQEAKLREIYPEFFEEKNEKKEEKKGLPPLPKAERGKVVTRFAPNPDGAFHLGNARAAILSHEYARMYDGKFILRFDDTDPKVKRPEPIFYEWIKEDLEWLGFRIDEIHIASDRLEIYYDYAEKLIKMGKAYVCTCPPEKFRELRDKGIACPHREEPVEVQLERWRKMLNGEYREGEAVVRIKTDLNHPNPAVRDWPALRIIDNPNHPRTGNKYRVWPLYNFASAIDDHELGVTHIFRGQEHAENETRQRYVYEYFGWEYPVTVHHGRLSIEGVILSKSKTRKGIEEGKYLGWDDPRLGTIRALRRRGIKPEAIRELIIEVGLKRSDTTISWDNLAAINRKIIEPIANRYFFVADPIPMYVEGAQEFTAEIPLHPDYPERGVRRLKFEPDKPVYVSKDDMELFKPGNFVRLKDLFNVEIMEVNENGIRARFHSFEYEVARENRWRMVHWVTEGKACEVWVPEGDELIIREGLLESDADVKVDDIVQFERFGFVRIDDVRPEKVVAIFAHK

SEQ ID NO: 47678 - protein, 473 aa, Corynebacterium diphtheriae NCTC 13129
MERRTKIVCTLGPAVASREGILGLVKAGMNVARMNMSHGDHADHEKNYQWVREATDETGRAVGILADLQGPKIRLGRFIDGATVWENGEIVRITVDDIEGTHDRVSTTYKNLAKDAKPGDRLLVDDGKVALRCVEVDGNDVVCEVVEGGPVSNNKGVSLPGMDISVPALSEKDIADLRFALNLGVDIIALSFVRSPADVELVHAIMDEEGRRCPVIAKLEKPEAMDALESIVLAFDGIMIARGDLGVECPLEQVPLFQKRAIQIARENAKPVIVATQMLDSMIENLRPTRAEASDVANAVLDGADAVMLSGETSVGIDPANVVRTMSRIVSYAEIDGRVPNLAHIPRTKRGVISYSARDIAERLNAKALVAFTSSGDTAKRVARLHSQLPLLVFTPHQEVRSQLALTWGVETFLTDEVKDTDEMMRTIDEQLLALDTYSEDDMIVLVAGTPPGVQGNTNMIHVHHLGEDLNGL

SEQ ID NO: 47679 - protein, 311 aa, Klebsiella pneumoniae subsp. pneumoniae MGH 78578
MALPIMIDCDPGHDDAIALVLALASPELEVKAVTASAGNQTPEKTLRNVLRMLTLLNRPDIPVAGGAWKPLMRDLIIADNVHGESGLDGPSLPEPAFAPQNCTAVELMASVLRESQESVTLVATGPQTNVALLLASHPELHAKIARIVIMGGAMGLGNWQPAAEFNIYVDPQAAEMVFQSGIPVVMAGLDVTHRAQILPADIERFRQIGNPVSTIVAELLDFFMAYHKDEKWGFDGAPLHDPCTIAWLLKPEIFTTIERWVGVETEGKYTQGMTVVDYYHLTGNRPNTTLMLDVDREAFVDLLAQRLAFYA

SEQ ID NO: 47680 - protein, 153 aa, Sorghum bicolor
MKEGSSSGGGAFAGGSDPRQPSTAKPYAPPKLSPQDLPIDYAGFLAVVFGVVGVMLRYKVCSWIAIIFCAQSLANMKNFENDLKQLSMAFMVCCYGSGDELFWPPSSRQHKALICGRTPCASSFIGYLANLFGASIALPSVLTFMYVQFEQTL

SEQ ID NO: 47681 - protein, 127 aa, Actinobacillus pleuropneumoniae serovar 1 str. 4074
MAYSEKVIDHYENPRNVGTFDKEAADIGTGMVGAPACGDILRLQIKVNDQGIIEDARFKAYGCGSAIASSSLITEWVKGKSLEEAGAIKNSDIAEELELPPVKVHCSILAEDAIKAAIADYKEKQAK

SEQ ID NO: 47682 - protein, 213 aa, Brassica napus
PTQYWFRLSLSPSLSPGNPGCFLRKRVRLFAMAKVFEAADASNLMTELRMSFDAGVTRGYEWRVSQLKKLLVICDNHEPEIVSALHDDLGKPELESSVYEVALLRNSIKLALKQLKNWMAPDKAKTSLTTFPASAEIVSEPLGVVLVISAWNYPFLWSMDPVIGAISAGNAVVLKPSELAPASSSLLAKLLEQYLDPSAVRVIEGAVTETTLL

SEQ ID NO: 47683 - protein, 299 aa, Geobacillus tepidamans
MKGIVLAGGSGTRLYPLTKAISKQLLPIYDKPMIYYPLSVLMLAGIRDILVISTPEDTPRFEQLLGDGSDLGISLSYAVQPSPDGLAQAFIIGEEFIGNDHVALILGDNIFYGHGFTEMLERAASRKRGATIFGYNVKDPERFGVVEFDKNGKVISIEEKPENPKSTYAVTGLYFYDNRVIDIAKSLKPSARGELEITDVNKAYLEMGDLHVELLGRGFAWLDTGTHESLLEASLFIETIEKRQSLKVACLEEIAYRKGYISREQLLKLAEPLKKNGYGQYLLDIANRVSKEGELVENY

SEQ ID NO: 47684 - protein, 447 aa, Acidovorax sp. JS42
MKHQSVGHFLEQVAQRNPGQPEYLQAVTEVMESLWPFIEKNPRYAEQGLLERLVEPERVVMFRVSWFDDHGNVHINRGYRIQHSMAIGPYKGGLRFHPSVNLSVLKFLAFEQTFKNALTTLPMGGGKGGSDFDPKGKSPAEVMRFCQAFVTELFRHVGPDTDVPAGDIGVGGREVGFMAGMYKKLANNAASVFTGKGLAFGGSLIRPEATGYGTVYFADEMLKTRGRSFDGLRVSVSGSGNVAQYAVEKAMQLGAKVITVSDSSGTIIDEDGFTPEKLAILMDVKNHHYGRVSDYAARTGVKFEAGVRPWHVKVDVALPCATQNELDENDARTLIKNGVLCVAEGANMPSTNEAAKLFEQAGVLYAPGKASNAGGVATSGLEMSQNAMRLSWTRDEVDARLLQIMQGIHAACLQYGKRADGSVSYINGANVAGFVKVAEAMLAQGVV

SEQ ID NO: 47685 - protein, 336 aa, Aspergillus nidulans FGSC A4
MSTSKSRWADEDPETEALIAQRKREKEEKRRAKAEKQRLEEQAKAQAAAERQAGDSRLNGDPSEAPPKKRRRLSNEQQPGSSGEQAAKQGKPTTLLQFPALEWGPCRHVDNFERLNHIEEGSYGWVSRAKELTTGEVVALKKLKLDNSPDGFPVTGLREIQTLLEARHQNVVYLREVVMGNKMDEVYLVMDFLEHDLKTLLDDMREPFLPSETKTLLLQFISGLDFLHSQWIMHRDLKTSNLLLNNRGELKIADFGMARYYGDPPPKLTQLVVTLWYRSPELLLGAESYGPEVDMWSVGCIFGELLTKEPLLQGKNEVDQVSKVCTVLFFFFSFKI

SEQ ID NO: 47686 - protein, 258 aa, Brassica napus
PTRPKDQCCSSCCGDCLSPAMACSCATAIGGFAYTKDGLLQKDFLEECISEARNPQKQVVQYCKECPLEIAKNEETLEPCKGHLKRKAIRECWISCGCTKKCGNQVVQHGLHTKLQVFFTSNGRGWGLRTLEKLPKGAFVCELAGEILTISELVQRSSSEKLTSPVILDAHWDSEEVSGVKRALCLDGTHYGNISRFINHRCVDANLIEIPVHVENMDLHYYHLGLFTTRDIEAMEELTWDYGVKFNDQVYPTRPFHC

SEQ ID NO: 47687 - protein, 240 aa, Oryza sativa Japonica Group
MAAEGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMEWSYKGKPFFGGDAVGFLDVALGGLLSWLHGTEELCGAKILDAAKTPLLSAWARRFGEMDAAKVALPDVCKLVEFAKMKRVQLEAAMAATTVSRN

SEQ ID NO: 47688 - protein, 217 aa, Sorghum bicolor
MVKICCIGAGYVGGPTMAVIALKCPDIEVVVVDISKPRIEAWNSDTLPIYEPGLDDVVKQCRGKNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKL

SEQ ID NO: 47689 - protein, 970 aa, Bifidobacterium longum NCC2705
MALALYRRYRPDTFEGVIGQDQVTVPLMRALDEGKLTHAYLFSGPRGCGKTSSARILARCVNCAKGPTSHPCGECESCKDLATGGPGSIDVVEIDAASHNGVDDARELRERAGFAPARDRYKIFILDEAHMVTQQGFNALLKIVEEPPEHVMFIFATTEPDKVIGTIRSRTHHYPFRLVPQEVMGPYLETICDKEGIKPEPGVLKLAMRAGGGSMRDTLSVLDQLMVGSVEGVITHDAAVALLGFTPEALIGEAVDAVIDHNGEALYGVIQKVVVGGFDPRRFVEDLLARVRDLLVLTLAGDRAESVLSDTAEAEDMDDLHRQAKALGLGALTAMADIINTTLGAMTGAISPRMRLELLAARLLAGSESGFATAAPAPASSGMPPAAASSTSTTSAASGTGASGFAGASRGGFAGASHGGFSGAARNQQAAAPQSTASHESVGGNGPVNGPVSDRPAGSLSVQPAVATAAAGAAPAANAGWGAPAASPAVPAQPVTSPAASDNRSIDEKWDAAVAALPETIREYVSRDKVPTVKFGPNRKGLPCLSMTFDKSLSQHAFALAVDNSGKKAAAVVMDAVRNEFGANAVIAPSAVAANGERVESVKRMSPEQLAKVKQQIAMAKAGLAASSLGASLGIHMGSETKAPKPTATGQAEDADDSHRAGQSSASTAAKNWSDDDPWAKPAVSNASPQSADGFAPNEPAATPAPEEHHKKHVAVPDISDGVDPWAAPAAPVAPTASVASAGPTGQSTGQPATASSVTAVAGASDDPWNQTQSQAAVSPASQPAEADPWNQPYQQSPHDDPWNQPQGNHAQAAPQPGDDPWNQPQSQTPASSVPQTVSGNMSGDDPWNQPQSVPQPAAGDDPWNQPQAVPQSAPQATPHGDPWNQPQPAQPTPNADPWNSQPQPQPKPQPQVAAEDDEYSMSDQSLGEATAMNLDDLKKLFEVKKVEQFAADDPKNPKNIQPAKKHSDE

SEQ ID NO: 47690 - protein, 159 aa, Glycine max
  misc_feature (99)..(99): Xaa can be any naturally occurring amino acid
GNVEADRVSCFVRILGDSADHFCQQLDNSSSGILATLSRLSDLLKVNDEQLWRHFELRTKVKPQFYAFRWITLLLTQEFKFEYILRIWDTLLSNPFGVXDMLLRICCAMLLCVKSKLLSGDFVTNLKLLQHYPDDINIEYLLQVAKDIRPDTSYYCLSL

SEQ ID NO: 47691 - protein, 244 aa, Physcomitrella patens subsp. patens
MVLWPRVGTDVLSCLGVVADEFEFLSKRSVRGEFRLLCHDAEACEVRAGSGRTLSGSVLQHVRVGGSALGFGIQTRRESGQIETRESLVEHRFESTTIADVLKDKGQKADGSWLWCSVEDTVYDAVKSMTANNVEALLVVKSGTEKMLAGIITERGLVKLMEMIVLYYDDPYLLFMQNKLITVSPDTKVLRAMELMTDNRIRHIPVVEDKKMKGMVSIGDVVRAVLDEHREELQSLNSYIQGGY

SEQ ID NO: 47692 - protein, 259 aa, Leifsonia xyli subsp. xyli
MRRVPLIAGNWKMNLDHLQSIAVVQKLAWTLKDAGHDFGAVEVAVFPPFTDLRSVQTLVAADKLPIAFGGQDVSEHDSGAYTGEIAASFLAALEARYVIIGHSERRTLHNETDEQVAAKTAQAVKNGISPIVCVGETAEDLEKHGASAVPVAQLRAALAGIDSAADFVVAYEPVWAIGSGQAATPEQAEQVAAALRAVIAEALGDEVAAKTRILYGGSVKSGNIAGFMRETNVDGALVGGASLDVAEFAAIIRYQKHVI

SEQ ID NO: 47693 - protein, 162 aa, Vitis vinifera
  misc_feature (40)..(40): Xaa can be any naturally occurring amino acid
MAPIAVGDVIPDGTLAYFDEQDQLQQASVHSLAAGKKVIXFGVPGAFTPTCSVKHVPGFIEKAGELKSKGIDEILLVSVNDPFVMKAWAKTYPDNKDVKFLADGSATYTHALGLELDLSEKGLGTRSRRFALLVDDLKVKVANVEAGGEFTVSSADDILKAI

SEQ ID NO: 47694 - protein, 118 aa, Triticum aestivum
  misc_feature (28)..(28): Xaa can be any naturally occurring amino acid
  misc_feature (92)..(92): Xaa can be any naturally occurring amino acid
  misc_feature (104)..(104): Xaa can be any naturally occurring amino acid
MGATIQSAKGRQIFDSRGNPTEEVDVCXSNGTFDRGDGSSGASTGVHEALKLRDRGADYLGKGVSNARDNVNLIIEPALIGKDLISYTDLRXFMVHQLDGTINXWGWFKHNSRFNVIL

SEQ ID NO: 47695 - protein, 185 aa, Methanopyrus kandleri AV19
MEIQNIVASVDLKGEVNLDECSVILQGEYEPEQFPGLVYRLEDIGTVVLIFRSGKMVCTGAKNREQIYKSVERVREDLEKKCGVKFHGEPEVEIQNIVASIDFHVPLDLDTIAEVLVGDEDVEGIEYEPEQFPGLVLRLREPKVAMLLFYSGKAVCTGAKTEEEPEKAVKKIAEKIEKYGLKLTG

SEQ ID NO: 47696 - protein, 258 aa, Aquifex aeolicus VF5
MAIELYSQREIEKIRKASQIVAEVLHIVAENVKPGVSTWDLEMIARKETEKRGAKPAFLGYKPPFSDVRYPAALCISINDEVVHGLPKKEKVIKEGDVVSIDFGAIYDGYAGDSAITVIAGKGSPEAQKLLEATKEALYNAIEKALPGKKVGDITKAIHETAEKYGFKTILRYGGHGVGRKVHQEPFVPNNVKDIGKKNPRLRQGMVIAIEPMLSIGTEETVEDGDGWTVKTKDGSLAAHFEHTVAITKKGPVILTEL

SEQ ID NO: 47697 - protein, 456 aa, Micrococcus luteus
MRHPIPDYLASLVTELGAVNPGETAQYIPVLAEADPDRFGIALATPTGRLHCAGDADVEFTIQSASKPFTYAAALVDRGFAAVDRQVGLNPSGEAFNELSLEAESHRPDNAMINAGALAVHQLLVGPEASRKERLDRAVEIMSLLAGRRLSVDWETYESEMAVSDRNLSLAHMLRSYGVLQDSAEEIVAGYVAQCAVLVTVKDLAVMGACLATGGIHPMTGERMLPSIVARRVVSVMTSSGMYDAAGQWLADVGIPAKSGVAGGVLGALPGRVGIGVFSPRLDEVGNSARGVLACRRLSEDFRLHLMDGDSLGGTAVRFVEREGDRVFLHLQGVIRFGGAEAVLDALTDLRTGAEKPGTGWDAAVYPRWQEAAADRAALSAATGGGAVHEAAAAAARDENDGPIRTVVLNLARVDRIDDVGRRLIAEGVRRLQADGVRVEVEDPERILPLEEAGAH

SEQ ID NO: 47698 - protein, 261 aa, Corynebacterium diphtheriae NCTC 13129
MTDVRDLYHIAEAILDDAERLFIQGIGSAPTTFKNGGDFATDMDLKIEQYLRTQLVMMTGIPVFGEEYGGKLGTPMWVVDPIDGTANYAAGNPMSSILISLIADGEPVIGLTSVPMVGQRFGAYADSPLLLNGQVQPQMNARDQRHVSHVGFTSIASPRESSFPTVVRQGLLGALAQTYLRPRITGSVGIDLAYAAAGIFDAALSLSPNLWDNAAGIMLVRAAGGVVTDLDGNQWTPTSQGVIVGSAQSHEVLMATIDTMR

SEQ ID NO: 47699 - protein, 482 aa, Prochlorococcus marinus str. MIT 9211
MTDRPLIPVILCGGSGTRLWPLSRASYPKQYWSLCGNENESLLQQTHKRLEGLPELEQPLLICHEEHRFIVAEQMREINIEPKEIILEPVGRNTAAAIAVAAIKATESGEDPQLLVLSADHEIRNVEEFQKSIAAGRIEAQKGKLITFGIIPTCAETGYGYIQAKEPIDHSNPKAVKINKFFEKPTQEKAEEFIANPCFSWNSGMFLFQASTILKELEKLAPKILKSCKSALQGELSDLDFLRLEKKAFSECPNLSIDIAVMEKTNLGTVLPLNAGWNDVGNWHSLWETASKDSNGNFSKGKVIIKRSKNCYFRSEHRLIVGLGVEDLILIETDDAVLVTNQKDAQSVKDIVNELEHKKLSESKAHRKIYRPWGHYTSIVEGKRWQVKRIEVKPGEFLSLQMHHHRAEHWVIVKGTALIERDGKEELLGENQSTYIPLGCKHRLGNPGKMPLELIEIQSGAYIGEDDILRLEDRYGRVNKNK

SEQ ID NO: 47700 - protein, 377 aa, Arabidopsis thaliana
MTTTMSTLPVVLVDEILARVPITSLRSLRSTCKKWEASSKTNLVGGKATARKSSHVGFILIGDKICSMKLDLNGGDDFVDTSVNQVSAFDGFAISQLFHCDGLLFCISNNHYSNYTLMVCNMYLGETRLIQNRSLFESYQNFCSYAFGYDSSKNRNHKILRNNSVSGGYEIYSLKSDSWKDLNVDLEKSIHLWRLGSVSLKGNAYFRVIKVIEEGVWEYNLLCFDFTRESFGKLLSLPFESLGDEGEGIMVISCVRDDHLAVLYQRDTLGIWISTEIEPNKVSWREFLQVDLATLDGFPDVFIAGRFIVDEEKQVVVVFGQETELDLNHGNAFIFGRDGYFTSFTVGDAPPEDFTSYVPSLVSLQIDKTGKRKARDD

SEQ ID NO: 47701 - protein, 80 aa, Prochlorococcus marinus str. MIT 9211
MSQDATLEKVRSIVSEQLSVDAGEVKLESNFQNDLGADSLDTVELVMALEEAFDIEIPDEAAEGIATVGDAVKYIEDKQG

SEQ ID NO: 47702 - protein, 191 aa, Triticum aestivum
  misc_feature (143)..(143): Xaa can be any naturally occurring amino acid
MENGGSKGDVPEDANAHCPGTQSEEAGKADSCAGCPNQQICATSPFSSSRRVPPTSPPSASAMAQHGFLSSLRSHLRSPPPPSHVQPRRGYHVELGAREKALLEEDVALKRFKSYKNSVKRVSKIGNVLTLVVFAACSYEVVXTGNKHPMKESAIGVSPLDLPESDSSHKLDYISTRFERPVIYYHVNKTN

SEQ ID NO: 47703 - protein, 465 aa, Vitis vinifera
MKKVIISKLHVEAAMTLKRQQKWVNTTKRLGHVPGIEVGDTFRYRVELCIIGLHSHFQNGIDYMEKDGKILAISIVDSGRYANDKESSDILIYSGQGGNPMVGHKQAEDQKLERGNLALKNSMDAKTPVRVTRGFQATKVTSQGYTYDGLYFVDKYWQEIGQFGTLIFKYQLKRIRGQPKCNLREFNESKKSKVRWKITFNDISLRMKTILNDISQGKEERPIRVVNTIDDEKPQPFSYIARMVYLESSNWSIPSGCDCTDGCSDSVKCACVLKNGGEIPFNCSGAIIEAKPWIYECGPLCKCPPSCNNRVSQNGIRFPLEVFKTKSTGWGVRSRNYIPSGSFICEYAGELIQDKEAEQRVGNDEYLFDLAKDYGAFAIDAAKFANVGRFFNHSCSPNLYAQNVLYDHDDKRMPHIMLFATKNIPPMRELTYDYNYMVGQVRDINGKIKKKRCYCGSRECTGRMY

SEQ ID NO: 47704 - protein, 129 aa, Thermosynechococcus elongatus BP-1
MKKWQCMQGCGACCYLDLSDRPEVPTILNDEEFALYQSLIGADGWCIHFDPLSRRCRIYENRPRFCRVTPEVFEDLYGILPEELDEFAVQCCCEHISDRYGERSFELLRYEYLVGQSVDSPQGDPPPFH

SEQ ID NO: 47705 - protein, 477 aa, Klebsiella pneumoniae subsp. pneumoniae MGH 78578
MTITCNLYINGQWHDAEGRRTFTRRHPAHDEAASVAAAASLADGKRCVEAAACAFPLWRDTAPAERRRLLLEAAEQMLLREAKFIAAMAAETGATAHWAGFNVHLAADILREAAALTTQIEGQIIPSNVPGNLAMGVRQGAGVVLGMAPWNAPLILATRALATPLACGNTVILKGAELSPATQGLIIDALDAAGFPPGVVNYLTCAPEDAPALVESLIAHPAVRRVNFTGSTPVGRIIARTCGQYLKPAVLELGGKAPLLVLDDADIEQAAAGAVFGAFANAGQICMSTERIIVDNAVAEAFIPLLAKRAAALPAALTGPVVDMNTIARCNALIDDALAKGARLLTGGKANDTHMSPTLLDGVTREMRLWREESFGPVKAIIRVHSEEEALAVANDSEYGLSAAVYSRDSARAWNVAQRLHTGICHINGPTVHDEAQMPFGGCKASGYGRFGGRAGIAEFTELRWITIQTQSRELPF

SEQ ID NO: 47706 - protein, 750 aa, Cyanidioschyzon merolae
MFTAGFILAVLAVIAFGTLIFTYRLYEYLIGCPEGPQSMRDVARPIQEGASGFFKVQYSTIASIAGIFALVIYFFGTGGAGGTTQASPFFNAAAFLLGGTLSALSGVLTMYLAVRVNVRVAAAASRSYAEAMKVCFRGGLFGGLLILSNCLVGFILLYWFALVTGMAAGDITQVPVLFVGYAFGASFVALFAQLGGGIYTKAADVGADMVGKVDTGIPEDDPRNPATIADLVGDNVGDASGRSCDLFESISAELVGASILGGTLARTANLSGASQAAYVLFPLCVHAVGLVCSALGGVTVRVSSGVARDEERSLLRTDDAFETRLEDPMSIMKRGFRVTMVLAAISIWVLCWLLLRVGNVAPSAWWHYALCGMIGLAVSYLYVLITEYYTDTKFRPVRSIAEASEYGHGTNVIRMLAVGLESSALPAIVVSAAILGAYWLGATSGMPDRNAAGIFGTAVATMGMLSSAGIVLAMDVFGPVADNAGGIAEMSGADPSVRRITDRLDAAGNSTKAFTKGFAVGSAALAGYLLFSSFMEEMSAQLPEKMVFNSVDLAKPEVFVAGLLGAAVVFLFSSLAMTAVGRAAQGVVAEVRRQFRDHPGIMAGTEKPEYERCVALVAASALRQMVLPGLLPVLAPIMIGMLFRFIGNMTGRPLLGLECAAGLLMVATIAGILMALFMNNAGGAADNAKKYIEDGHYGGKGSQAHKASVTGDTVGDPLKDTAGPSLHVLIKMLSTLTMVFGPAFVGSIGA

SEQ ID NO: 47707 - protein, 545 aa, Vitis vinifera
MAVSSSLAASFTGAKLETPPFLNSVSSSRSSSQYRIFCKPARTRRSLIQRGASLNSRCEVASDALVDTDSTRSSSVSALEQLKTSAADRYTKERSSIVVIGLSIHTTPVEMREKLAIPEAEWPRAIGELCNLNHIEEAAVLSTCNRMEIYVVALSQHRGVKEVTEWMSKTSGVPVSELCHHRFLLYNKDATQHLFEVSAGLDSLVLGEGQILAQVKQVVKVGQGVVGFGRNISGLFKHAITVGKRVRTETNIAAGAVSVSSAAVELALMKLPESSHATARMLVIGAGKMGKLVIKHLVAKGCTKMVIVNRGEERVAAIREEMKDVEIIYRPLTEMLACAAEADVVFTSTASETPLFLKEHVKDLPAVGQDVGGLRLFVDISVPRNVGACVSDLETARVYNVDDLKEVVAANKEDRLRKAMEAQAIITEESKQFEAWRDSLETVPTIKKLRAYAERIRVAELEKCLSKMGDDISKKTRRAVDDLSRGIVNKLLHGPMQHLRCDGSDSRTLSETLENMHALNRMFSLETEISLLEQKIRAKVEQTQK

SEQ ID NO: 47708 - protein, 445 aa, Aspergillus nidulans FGSC A4
MSTPSSVSSSSYSAAKSRLASLASHIMGSSSASPVFSTAVVPSAPEDPLFGLAQAYRQDPSDKKVDLVIGAYRDDNAKPWVLPVVKKADELIRNDPNLNHEYLPIKGLAEYTTAAQKLIIGADSPAIAENRVCTFQTISGTGAVHLGALFLARFHPATPKPTLYLSSPTWANHHQIFTNVGFTLANYPYFSPQTKGLDFDGMINALRSAPAGSIILLHACAHNPTGVDLTQEQWKEVAVVMRDRSHFPFFDCAYQGFASGDLARDAWAIRYFVEQGFELCIAQSFAKNFGLYGERTGAFHFVSAPGPEAAQSSAHVASQLAILQRSEISNPPAYGARIASKVLNDPELFAQWEDDLRTMSGRIVEMRKGLRQRLEEKKTPGSWNHITDQIGMFSFTGLSEAQVKVLREKWHVYMTKNGRISMAGLNSHNLDYFAEAVDSVVRETS

SEQ ID NO: 47709 - protein, 341 aa, Pseudoalteromonas tunicata D2
MKALSKLKAEPGIWMTEAAKPEVGHNDLLIKIRKTAICGTDVHIYKWDEWAQNTIPVPMVVGHEYVGEVVDMGQEVRGFKIGDRVSGEGHITCGHCRNCRAGRVHLCRNTIGVGVNREGSFAEYLVIPAYNAFKIPDNISDELASIFDPFGNAVHTALSFDLVGEDVLITGAGPIGIMAAAVAKHVGARYVVVTDVNEYRLDLARKMGATRAVNIANEKLEDVMKELGMTEGFDVGLEMSGVPSAFKNMLSNMNHGGKIAMLGIPPSDMAVDWNQVIFKGLVIKGIYGREMFETWYKMASLIQSGLDLSPIITHQFPIDQFQQGFDTMLSGQSGKVILDWC

SEQ ID NO: 47710 - protein, 328 aa, Cryptococcus neoformans var. neoformans B-3501A
MASAAYSTIKLFSGSSHPELAALIAKRLRIPLARANISQPPSGETKVTIVESVRDCDVYILNTGAGAVNTNLMELCIMIHACKIASARRITAIIPHFPYARQDKKDKSRAPITAKLVANMLREAGCDHVITMDLHASQIQGFFDVPVDNLYAEPSMIQYMRNNIDVHDCVIVSPDAGGAKRATSIADRLNVEFALFHKERKKANEVSRMVLVGSVTGKIAILVDDMADTCGTLGLAAKNLLEAGATKVYAFATHGILSGNALKVISESGMEKLIITNTIPQSENCEKCEKIEVIDVSRVLAEVIRRSHFGESVSYLFHEVPYSNGVGA

SEQ ID NO: 47711 - protein, 448 aa, Debaryomyces hansenii CBS767
MDLRVGKKYRIGRKIGSGSFGDIYLGTNIISGEEVAIKLENTKAKHPQLEYEAKVYKALSGGVGIPFVRWYGTECDYNAMVIDLLGPSLEDLFNYCNRKFTYKTVLLLADQLICRIEYIHARCFIHRDIKPDNFLMGIGRRGSQVNVIDFGLAKKYRDPRTHLHIPYRENKNLTGTARYASVNTHLGIEQLRRDDLESLGYVLIYFCRGSLPWQGLKAATKRQKYDRIMEKKMTTPNDILTKGLPKEFLDYMNYIKTLRFDDKPDYPYLRKIFRDLFKRENYRYDYVFDWTLYKFQQEKQREQSQITDDQQNNNDQQQQQQQQQQQQQQQQQQQQQIQQQPQLPPQDINQQNAIPQNMHRTPPSQNQPVQQPGSVPYNSQSPQQQLNPMYQQKPKVRRMPENYSNVNSNQRFNSPSQDDSKPKVVRRINDNQNPQAQQASSNNLSTWL

SEQ ID NO: 47712 - protein, 568 aa, Zymomonas mobilis
  misc_feature (208)..(208): Xaa can be any naturally occurring amino acid
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIAXRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 47713 - protein, 490 aa, Triticum aestivum
  misc_feature (382)..(382): Xaa can be any naturally occurring amino acid
MSTNGSSPRVRDTESSLEKVKRQLSTGSGRYLLQGPLLKRSETLRKWNERWIILDPTSGKMEYKLRRNETAVKGTILFDASSTITLSPVNFQGMPKYDGCCFYIGTPQKKDYFLCAETPGAAKAWVSTLHATQLVLQAHKEAVNSLAGNGSPSTLGTVATAVANANATALEAMKEIDAALKVSMRAALGLGTNNSNVGQLDDLTIMKETLRVKDEELQHLAKDIRARDATIQEIAEKLTETAEAAEAAASAAHTIDEQRRLLCSEIERLKKAMETQMEQSMLKLRQSEEKVISLSKENDQLLKERDAAFQEAYMWRTELGKAREQAVIQEAAIARAEEKVRVSEADAAVRIKEAAENLHAAEKEKEELLALIGVLQSQVQRXTKQHEASMRGEIRVMLRRRQLPSADEARRRIGRRRGQGVRERFEIGLGLEREHGGPAGRGWGGHPPHRRPRVGQLPAAGSADCRRAGGLPGGGRQQPGYPGGQPGTGQ

SEQ ID NO: 47714 - protein, 229 aa, Thermococcus kodakarensis KOD1
MNVEEMKKAVAKEALKFIEDEMVVGLGTGSTTAYFINYLGKLLMEGELEDVYGVPTSHQARLLALEAGIPVVSLDEVDAIDIAVDGADEVDPHMNLIKGRGAALTMEKIIEYRAGMFIVLVDESKLVEYLGQKMPVPIEVIPAAWRAIAEELEVFNATAELRMAVKKDGPVVTDNGNFILDAKFARIEDPLDLEIELNTIPGVVENGIFADIADIILVGTPEGVKRMER

SEQ ID NO: 47715 - protein, 339 aa, Zea mays
MAAAPAASSSTSGSPAAGGPRSRFGDTTLTKVFVGGLAWETPSEGLRQHFERYGDILEAVVITDRLTGRSKGYGFVTFREPEAARRAVQDPNPTIAGRRANCNIASLGPPRPAQPGVAGRGGPYTVGPHHLQVPQFVPRAPASPLQMMVPQQQQQQQHGGAPAAAIYPSPQFGYCWYPPDFQYQQALASPQALQNYYAQLYGLTTSPSAAAAPYHHQYLGYMAPSPPTPRMILTPPPPPAAQQVTAVQPLVQHPPPAAQQVTVQPLPLLQHPPPQIHAPFFPAPSLPQHNFRLHPPPPPPPQAMAVLPPNTTGGSLPPADQAAAPAARATNASSTRPGA

SEQ ID NO: 47716 - protein, 432 aa, Campylobacter jejuni RM1221
MYYCISFTHKNTDIALREKLSFSNEAKKSEFLKIISTHENIEECLVISTCNRVEIVAFVKMACAEFIVKSLALLCDVDKDILLEKADIFEDSGAIHHLFSVASSLDSLVVGETQIAGQLKDAFAFAVKNNFCGVHLSRAVHSAFKCAAKVRNETQISKNSISVASVAVAKAKELADLTQKKAVVIGAGEMGELVAKHLIAAGAKVIILNRDLQKAKDLCERLGVLSEYDSLENLKKYLNQYEFFFSATNAPNAIITNSLIEELSYKRYFFDIAVPRDIDINENENISVFAVDDLEIVVQKNLALREQEARMAYGIIGRETSEFFRYLNDLALMPIIKAIRLQAKEYADKQLEIALKKGYLKKSDKEEARKLIHQVFKAFLHTPTVNLKHLQGKMQSDTVINAMRYVFDLQNNLEGLNQYKCEFDMENNDEIY

SEQ ID NO: 47717 - protein, 271 aa, Kluyveromyces lactis NRRL Y-1140
MSKVTPRCIIVRHGQTEWSKSGQYTGLTDIPLTPYGVEQMRRTGKCVFGNKFIDPNHITYIFTSPRQRARKTVDLILESLTEEQRSKIRIVVDNDLREWEYGDYEGLLTHEIVKLRKSRGLDQERPWNIWRDGCENGESTKQIGCRLSRVISRIQNLHRQQQKDGVPSDILVFAHGHALRYFASLWIKHGLEEKYEPSFDPPKPTYNDETVPNVTMEKYRYLVDNPNFLLDAGGMGVLSYAHHNIDEPALALAGTFIAPPEEESQHEPVVE

SEQ ID NO: 47718 - protein, 127 aa, Vitis vinifera
MKPIPGVSRVTVKKSKNILFVISKPDVFKSPTSDTYVIFGEAKIEDLSSQLQTQAAEQFKAPDLSNVIAKPEASSMAQDDEDVDETGVEPKDIELVMTQAGVSRSKAVKALKAADGDIVSAIMELTN

SEQ ID NO: 47719 - protein, 421 aa, Thermococcus kodakarensis KOD1
MVEIDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPWTDIPAPDVYTNPKIMAWMMDEYETIMRRKGPAFGVITGKPPGVGGIVARMDATARGAAFTIREAAKALGWDDLKGKTIAIQGYGNAGYYLHKIMSEEFGMKVVAVSDSKGGIYNPDGLPPADEVLKWKKEHGSVKDMPGTQNITNEELLELEVDILAPSAIEGVITKENADNVKAKIVAEVANGPVTPEADEILHEKGILQIPDFLCNAGGVTVSYFEWVQNINGFYWTVEETRKRLDDKMTKAFWDVFNTHKEKNIHMRDAAYVVAVSRVYEAMKHRGWVKK

SEQ ID NO: 47720 - protein, 159 aa, Glycine max
MADNKQPNHEEASPLLHQSQPKSEPPTPPETPEFLLGWTADGLPLGHGSVVGQPMGRAPWNSSICACLGQTDHFCSSDLEVCLLGSVAPCVLYGSNVERLESAPGTFANHCLPYSGMYIIGNSCFGWNCLAPWFSYPSRTAIRRRFNLEVCYFFILCSL

SEQ ID NO: 47721 - protein, 245 aa, Arabidopsis thaliana
MVMLGVLQLPCRLHHSLFYSSSQIASSRPQGVAKVVLKKGKTQLFKDGSPMVYSGAVDRIIGKPPPQTGDVVIVADGTENPIGWGLYNSVSMFCVRLMQLQHESTRDPSCALNIEKLLQTRIAEAVQLRKSLALPSANTNAYRLVNSEGDRLSGLIVDVFGDIAVVASSAAWLEKYRIEVESCLRSIDGINHINWRPSLDVLKEDGFDISSLKQTQSSTLPQRSMVRCVVPLIRLWKMGSHTQFR

SEQ ID NO: 47722 - protein, 384 aa, Rhodospirillum rubrum ATCC 11170
MAKVAALIVAAGRGKRFGGDLPKQYQTLGGRPILRHTLARFAAHPDVALVRAIIHPEDRDLYGAAAHGLATLLDAVEGGAERQDSVRLGLESLTDVAPDYVLIHDGARPLVDGALIDRVIAALADHPGAIPALAVADTLKRGAGGMIGQTVDRAGLWRAQTPQGFRYDAILAAHRAQAGTMLTDDAAVLEAAGGAVALVDGAEDNAKITTFADLERAERLFRGEGEQRIGSGFDVHRLGPGDFVTLNGIRIPHSHGLVGHSDADAPMHALTDALLGCLNAGDIGRHFPPSDMRWKGADSAIFLRHAAALITALGGRILNVDITILCEQPKIGPHRARMSARLAEILEISATRVAVKATTTEELGFTGRGEGIAAQATALITLPF

SEQ ID NO: 47723 - protein, 441 aa, Salmonella enterica subsp. enterica serovar Paratyphi A str.
MTQYQTLIIGFGKAGKTLAATLAKTGWRVAIIEQSASMFGGTCINIGCIPTKTLVHDAEREGDFSVAMQRKAAVVNFLRDKNFHNLADLDNVDVIEGRAEFIDNHTLRVFQADGERVLRGEKIFINTGAESVIPAITGLTTTAGVFDSTGLLSLSQRPARLGILGGGYIGLEFASMFANFGTKVTIFEAAPQFLPREDRDIAQAITRILQEKGVELILNANVQAVSSKEGAVQVETPEGAHLVDALLVASGRKPATAGLQLQNAGVAVNERGGIIVDDYLRTTADNIWAMGDVTGGLQFTYISLDDFRIVRDSLLGDGKRSTRDRQNVPYSVFMTPPLSRVGLTEEQARASGATVQVVTLPVAAIPRARVMNDTRGVLKAVVDVNTQRIVGVSLLCVDSHEMINIVKNVMDADLPYTVLRDQIFTHPTMSESLNDLFSLIK

SEQ ID NO: 47724 - protein, 400 aa, Geobacter sulfurreducens PCA
MPVARIEEAIEDIRQGKMVILVDDEDRENEGDLTMAAEMVTPEAINFMARFGRGLICLTMTTERCDHLQLPLMVSANTSSFGTAFTVSIEAKRGVTTGISAADRAHTILTAVADDAKADDLARPGHVFPLRAKPGGVLVRAGQTEGSVDLARLAGLKPAGVICEIMNDDGTMARMPQLKVFAKEHGIRICTIADLVAYRLKHESLVRRAADVLLPTDFGEFRAIAFENDVDRLEHLALVKGEIRGDEPVLVRVHSECMTGDVFGSLRCDCGSQLHRAMEMIEAEGRGVILYMRQEGRGIGLFNKLKAYALQDEGKDTVEANLALGFKPDLRDYGIGAQILVNLGVRNIRLLTNNPRKLIGLQGYGINIVERVPIEIPPTTTNLDYLKAKREKLGHLLENI

SEQ ID NO: 47725 - protein, 155 aa, Geobacter sulfurreducens PCA
MPRFIEGKLDATGLRFGIIVSRFNSFIGERLLEGALDALVRHGGDDGDIDVVRVPGAFEIPLTAQKLVQKGNYDAVICLGAVIRGSTPHFDYVAAEVSKGIAHVSLATGVPVVFGVLTTDTIEQAIERAGTKAGNKGFDAAVTAIETARLYRELR

SEQ ID NO: 47726 - protein, 504 aa, Ralstonia solanacearum GMI1000
MHPAFTSDADVGHYINGARLPGRSGRFQDVFNPAAGKAARRVALAEADEVNQAVAAAKAAFPAWADTPPIRRARVLHRFLQLMNEHRDALAAIITAEHGKVFSDAQGEVARGIDIIEFACGIPQLLKGDYTDQVSTGIDNWTMRQPLGVVAGITPFNFPCMVPCWMFPVAIAAGNTFVLKPSERDPSASLLIADLLMRAGLPAGVFNVVQGGKPVVDTLLDHPDVQAVSFVGSTPIAAYVQQRGVQAGKRVQALGGAKNHLVVMPDANLDQAVDALIGAAYGSAGERCMATSIAVLVGDVADRIVPALAERARTLVVGDGMMPDVEMGPIVTREALQRIEGYVEQGVAEGAKLVVDGRGLRVPGREQGFFTGGTLFDHVTPSMRIYQEEIFGPVLGCVRVKDFAEAVSLINAHEYGNGVACYTSDGGIAREFARRIQVGMVGINVPIPVPMAWHGFGGWKKSLFGDMHAYGEEGVRFYTRQKSVMQRWSSSIGKGAEFAMPTAK

SEQ ID NO: 47727 - protein, 153 aa, Glycine max
  misc_feature (111)..(111): Xaa can be any naturally occurring amino acid
MSSDSRSRSRSRSRSPMDRKIRSDRFSYRDAPYRRDSRRGFSRDNLCKNCKRPGHYARECPNVAICHNCGLPGHIASECTTKSLCWNCKEPGHMASSCPVELICQTCGKSXGPGARECSAPSMPSGDLRLCNNCYKQGHIAAACTNETFATSI

SEQ ID NO: 47728 - protein, 289 aa, Methylococcus capsulatus str. Bath
MGFDETLTQSQELAGALGCPWRAIEVHRFPDGESRVRVPPDVRGTGVVHRSLDRPNDKLVELVLAAETLRGQGCDRLVLVAPYLCYMRQDIAFQAGEAVSQKVVGNLLARYFDALITVDPHLHRIDRLEQAVPLKRVLSVSSATLVSRYLATDRKEWLLLGPDQESRQWVEAIAAQAGLPCAVASKRRLGDREVGISLPQEAGAFKGVVLVDDIASTGTTLAETARLLARAGVARIDVIVTHALFTGDAWSRLKQAGVGAIASTDSISHPTNRMCLAPLLADAVRKCAF

SEQ ID NO: 47729 - protein, 444 aa, Oryza sativa
  misc_feature (426)..(426): Xaa can be any naturally occurring amino acid
MRTGRRLSMILLLLLLGLASGDKILFQGFNWESWRQSGGWYNLLMGKVDDIVAAGVTHVWLPPPSHSVSTQGYMPGRLYDLDASRYGTSMELKSLISALHGKGIQAIADVVINHRCADYKDSRGIYCIFEGGTPDGRLDWGPHMICRDDTQFSDGTGNLDTGADFAAAPDIDHLNGVVQRELTDWLLWLKSDEVGFDAWRLDFARGYSPEVAKVYIEGTTPVGLAVAELWDSMAYGGDGKPEYNQDAHRQALVDWVDRVGGTASAGMVFDFTTKGIMNTAVEGELWRLIDQQGKAPGVIGWWPAKAVTFVDNHDTGSTQQMWPFPSDKVMQGYAYILTHPGNPCIFYDHFFDWGLKEQIAALVAVRQRNGVTATSSLKIMLHDADAYVAEIDGKVVMKIGSRYDVSSLIPPGFHLRPWPYAVWEKXAAAAAAAADHRTSSSASL

SEQ ID NO: 47730 - protein, 271 aa, Yersinia pestis CO92
MNDHKKRPDLEKRPDLEKQSYPEKQSLSGKRALVTGAGQGIGAAIAEGLAATGAEVICTDISRERAAATAQALNAKGYNVRAEGLDVTDSAAIDALAAALPPLDVLVCNAGIVTHTPAEEMTDADWDKVIAVNLTGVFRTCRGFGRRMLEAGRGSIINIGSISGQIVNVPQPQCHYNASKAGVHHLTKSLAVEWATRGVRVNAVAPTYIETPLIQGLTSQPGRVSRWLDMTPMGRLGSPHEIASVVQFLASEASSLLTGSIITADAGYTSI

SEQ ID NO: 47731 - protein, 365 aa, Pseudomonas putida
MPAHSFRIAAIPGDGIGLEVLPEGIRVLEAAALKHGLALEFDTFEWASCDYYLQHGKMMPDDWAEQLKQYDAIYFGAVDWPDKVPDHISLWGSLLKFRREFDQYVNIRPVRLFPGVPCALANRKVGDIDFVVVRENTEGEYSSLGGIMFENTENEIVIQESIFTRRGVDRILKYAFDLAEKRERKHVTSATKSNGMAISMPYWDKRTEAMAAHYPHVSWDKQHIDILCARFVLQPERFDVVVVASNLFGDILSDLGPACAGTIGIAPSANLNPERNFPSLFEPVHGSAPDIFGKNIANPIAMIWSGALMLEFLGQGDERYQRAHDDMLNAIERVIADGSVTPDMGGTLSTQQVGAAISDTLARLD

SEQ ID NO: 47732 - protein, 369 aa, Pseudomonas syringae pv. phaseolicola 1448A
MAFDRIEDIIEDYRQGKMVLLVDDEDRENEGDLLLAADCCSAQAISFMAREARGLICLTLTDEHCQRLGLEQMVPSNGSVFATAFTVSIEATMGVTTGISAADRARTVQAAVNPHAVREDLVQPGHIFPLRARDGGVLTRAGHTEAGCDLARMAGFSPASVIVEVMNDDGTMARRPDLELFAEKHGIRIGTIADLIHYRLSTEHTIVRIGERDLPTVHGTFHLFSYEDRIEGGVHMAMVMGDIRRDDPTLVRVHVVDPLRDLVGAEYTGPSNWTLWAALQRVAQEGRGVVVVLANHESSQALLERIPQLTQPPRQYTRSQSRIYSEVGTGAQILQDLGVGKLRHLGPPLKYAGLTGYDLEVIENIPFPG

SEQ ID NO: 47733 - protein, 498 aa, Yersinia pestis CO92
MSEYHEKNNALFKSITALDGALFINGEFRKGAGGRLPVENPATGKVIGHLAAATPEEIEEAVAAARRAFPAWAAERPKARANALHRLGDLIAGDALNMARNMTIEQGKPVNEAQGEILKLAEICHFYGEEATRVQGDVVPNDPPGFQSLVVREPVGVVGAITPWNYPAELVGWKLCASLAAGCTLIIKPAELTPYTALAIAEKCLEAGIPAGVVNVLTGKGEQVGQALVEHPQVDKIAFTGSSAVGLHIQQSCPQVKRLSLELGGNGPMVVTACADVAAAVKGAVRRSFRNCGQVCIAINRIYVHRSCYRAFVSKMGVATNGLRLGNGLDDPAADLGAMASVEPLNKTRAHLEDALAKGARLVAGGKAPEGVEYAKGHFFRPTVLADCTHQMRVMTEETFGPLVGLAPFDDIDEVISRANDTPYGLAAYVYARDLAAIHRLSAALDYGNVAINNVDASMMNAPYGGRKQSGVGYEHGREGLLEYFNFKHIRLYHGIGD

SEQ ID NO: 47734 - protein, 236 aa, Yersinia pestis CO92
MSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 47735 - protein, 328 aa, Campylobacter jejuni
MKILISGGAGYIGSHTLRQFLKTDHEICVLDNLSKGSKIAIEDLQKIRTFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAEKRNKLFIFGDDYDTKDGTCIRDFIHVDDISSAHLSALDYLKENESNVFNVGYGHGFSVKEVIEAMKKVSGVDFKVELAPRRAGDPSVLISDASKIRNLTSWQPKYDDLGLICKSAFDWEKQC

SEQ ID NO: 47736 - protein, 528 aa, Zea mays
MATAARSLHLPGPTPPKSSTPSSHRLPVPCHLRPQRRRLAASSSDLTSFPEPPPAPNGVYVPWAAASSVAAAAASIVVDAATEAELRENGFRSTRRTKLVCTVGPATCGAAELEALAVGGMNVARVNMCHGDREWHREVIRAVRRLNDEKGFAVAVMMDTEGSEIHMGDLGGAPSAKAEDGEVWTFSVRSSDTSLPDRIIHVNYDGFAEDVKCRCTDPGLLLPRANLTIWRDGSVVRERNAMLPTISSKDWIDIDFGIAEGVDFIAVSFVKSAEVINHLKSYIAARSRGSDIGVIAKIESIDALKNLEEIIRASDGVMVARGDLGAQIPLEQVPSIQQRIVRMCRQLNKPVIVASQLLESMIEYPTPTRAEVADVSEAVRQRADALMLSGESAMGRYPEKALSVLRSVSLRIERWWREEKRQEALELQANNLGVDAVFVYTKDGYMGSLLSRCRPDCPIFAFTSSTSVRRRLNLQWGLIPFRLSESDDMESNLNRTFSLLKARGMVQSGDLVIALSDMLQSIQVVNVP

SEQ ID NO: 47737 - protein, 446 aa, Corynebacterium diphtheriae NCTC 13129
MLGSSSTPWLKLLPMSKEAENQQVTFGAIHAADIQMAQSRISASIAPTPLQHCPRLSQMTGCEVYLKREDLQDVRSYKIRGAVNAISQLTEEQRVAGIVAASAGNHAQGVAFACRTMGIKGRIYVPAATPKQKRDRIMVHGGDAVELVVTGANFDEAAAAAREYARVEGATMVEPFDNRDTVIGQGTVAAEILAQLTTLGKTLDTVVVPVGGGGLLSGVVSYLADMAPRTAIVGVEPEGAASMRAALDAHGPVTLDNVDPFVDGAAVKRIGDLNYHIIEHNQGRIHPISVNEGAVCTEMLDLYQNEGIITEPAGALSVTGLKELSLGSRDVVVCIISGGNNDVLRYGEIMERSLVHRGLKHYFLVNFPQEPGQLRTFLNDILGPDDDITLFEYLKRNNRETGTALVGLQLGVASELDGLLERMNASRIDCRRLEPGTPEYSYLVNL

SEQ ID NO: 47738 - protein, 641 aa, unidentified eubacterium SCB49
MLELAGIIILGIFAQWIAWKFKIPAILPLILIGLAVGPLSTFYSDDGSQWIQPIYNGEKGFFPGDGLFYFVSLAIGIILFEGGLTLKMDEIKKVGGVIGKLISLGSVVTFFGAGVSAHYFFGLDWQISFLFAGLIIVTGPTVITPILRNIPLKKDISAVLKWEGILIDPIGALVAVLVFGFISVNVPIDVIDAGAEAVANAEANGVGGSYTKHALSEFGKIIVIGFAFGLAGGFAMYHAVKRNVIPHYLLNVASLSMVLLIFVLSDFFAHESGLLAVVVMGMYLGNSDLPNLKELLYFKESLSVLLISILFILLSANISIDDLLLIYNWKTAILFAIVIFVVRPLGVFLSTTGSGLKVNEKLFISWVGPRGIVAAGIASLFGTKLVELGVSGAEYITPLVFGLVLVTVLLNATTARLVASLLGVFLKKSNGIMIVGGSRASRLIGSYLQKNGRHVVLIDRNRTNIEKANEIGLDAISANIYSDDLSDNIELNDVGYLLAMTGNDDINRHAMTRFGKRFGENGIFRLLTSDELLKKVPHNADEVFSNTHDYLRFTEIARDYPSIQEVEVHDNSKYLKVLEMIRESKDAIPLFKKDEKGDITFIDTLKEIDIKEGTQIAYLGKPLDFEEVITANLELEPTLEG

SEQ ID NO: 47739 - protein, 128 aa, Brassica rapa
MTVEAVNPKAYPLADSQLAITILDLVQQATNYKQLKKGANEATKTLNRGISEFVVMAADAEPLEILLHLPLLAEDKNVPYVFVPSKQALGRACGVTRPVIACSVTSNEASQLKSQIQQLKDAIEKLLI

SEQ ID NO: 47740 - protein, 368 aa, Desulfitobacterium hafniense DCB-2
MKIKVSRIFLSVTMLIFLSIVGTGCSEAAVPAESAKRFPYNPNMGVSYEGKELQEIWIAGGCFWDVDAYLSRIYGVADVTVGYANGNTENPTYEDVCYRDSGHAETAYVRYDPERVDLETILEYFFKIIDPTSLNRQGNDVGTQYRTGIYYQNELDREIILKVITEEQNKYKKPIVTEVLPLAHFYEAEEYHQDYLVKNPHGYSHIDFSPLEEQKLVNIDPGLYNKPSDDVLRKTLTDLQYAVTQKDATERSFANDYWDHHEQGLYVDVVTGEPLFASKDKFDSGTGWPSFTRPIAPEVIIEKEDSTLGMKRIEVRSRAGDSHLGHLFNDGPPEDGGLRYCINSAALRFIPLSELKEEGYGQYLSRIE

SEQ ID NO: 47741 - protein, 218 aa, Triticum aestivum
MEWAYSGGGHSSSGTKSPAAGGREEGSYMTVSSAPPKRRAGRTKVRETRHPVYKGVRSRNPGRWVCEVREPHGKQRLWLGTFDTAEMAARAHDVAALALRGRAACLNFADSPRTLRVPPQGAGHEEIRRAAVEAAELFRPEPGQRNAATTEAPAASPADAGNAELVANSPYHLMDGLEFEMQGYLDMAHGMLIEPPPMAGPSTWIEEDYDCEVSLWNY

SEQ ID NO: 47742 - protein, 417 aa, Kluyveromyces lactis NRRL Y-1140
MSNPIKTSRSSKIDNAPTPHNTPASVLKDSYLRKKQQQQSDQDQDQDDDSEYNESPSLSRINEKLEFLNIDEEDEGEEEEEEEEEEGDEEAFERLPKAVNNRILALKAIQSDLFELEKNFQLEMLELEQKYLQKYKPLHEHRYELITGDKEATEEEIKRGGSLDGEDEHEEEEHDQEPEEGEEEIVGVPCFWLTAMENLPMVSQNVTEADCDVLTYLTNITLEYLTEGKPGFQLIFTFDKENEFFTNETLTKTYYYQSELGYSGDFIYDHAEGETINWVDNDHNVTVEVKRRKQKNKTTKQIRTIEKLTPVESFFNFFDPPKSLDPEEEDDLDEEEIAELESRLAVDYAIGEEIKDKLIPRAVDWFTGAALELEYGDEQEEDDDEFDDQDGEEEEEEDDFANKDALKKVQPPECEQS

SEQ ID NO: 47743 - protein, 338 aa, Prochlorococcus marinus str. MIT 9211
MNSPKVICVGEALVDRLGPCGGDPAVDKPVQDCLGGAPANVACGLARLGIDAAFIGCLGDDSIGAEFRRLFMSRDVNIAGLQIHPELPSRVVLVRRDLSGERTFEGFEGDHRKGYADQHLGLTQLKETLPALFQEASWLLLGTILLASKSSKEAVLWMVDQAKKYSLSIAIDINWRPTFWDPNSSPDSPPSREIKLAIHDLLKHADLLKLAKEEAVWFFNSHTPTEISNSLPKKPSVIITDGSRPINWVLGESVGHMKTSVPRKVVDTTGAGDSFTAGIISQLLQTPLSQGDLLNPKEIVRFAAACGALVCEGAGAIEPQPIYGQVKEFLSLDVGEKS

SEQ ID NO: 47744 - protein, 237 aa, Kluyveromyces lactis NRRL Y-1140
MVRAIIAPSILASDFTKLGCECHNVINSGADWLHIDIMDGHFVPNMSLGQPVVESLRKVIGKYNDPDTKLPRAFFDCHMMVSEPERWVEDFARIGCDQFTFHYEATKDPVALVKLIKKHGMKAACSVKPGTPVDVLYELAPSLDMALVMTVEPGFGGQKFMADMMSKVKDLRTRFPNLNIQVDGGLGKQNVELAAEAGANVIVAGTSVFRAHDPADVIGFMKTKVNDALVTKGLYEK

SEQ ID NO: 47745 - protein, 463 aa, Listeria monocytogenes EGD-e
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIVSLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPLYPVLPIVSFLLCAFLISRLSVHTWILCGIWFVIGLIVYFAYGRKHSELLKK

SEQ ID NO: 47746 - protein, 247 aa, Mycobacterium sp. JLS
MLGHMTDSKIILVTGASSGIGAAVATHLARAGHHVIAGARREDRLRELADGAADLERGSLSVRRLDVTDRAEMAAFVDDAVSTHGRIDVLVNNAGIMPLSRLDALLVDQWDAMIDVNVRGLLNGIAAALPHFHRLGGGHFVTVASIGAHEVVPTSAVYSATKYAAWAITEGLRQESDPSIRVTTVSPGVVESELASTITDPGAAAAMQEYRAAAITPDAIARAIAYAISEPEEVDVNEVIVRPARQR

SEQ ID NO: 47747 - protein, 143 aa, Brassica napus
  misc_feature (142)..(142): Xaa can be any naturally occurring amino acid
MATTITSNAPPKSFSFSVSNPLKTLTSRSSSLCFPPRKNHQRLCLSINAAVSPPPSNATRNAPSPDYRVEILSESLPFIQKFRGKTIVVKYGGAAMTSPELKASVVSDLVLLACVGLRPILVHGGGPDINHYLKQLNIPAEXR

SEQ ID NO: 47748 - protein, 244 aa, Sinorhizobium meliloti
MCPVPMRCRRRKLLAGAGVLATSAAMAGLAQAQYRGNAGRTVRELTDGPRVALVTGSSRGIGAATARQLGRDGYRVVVNCVVNRDLAAQVARDIEASGSPAIWRQADVRDPTAVRALFDAGEEAFGGIDVVVANAGVMHLAPFADMSDEDVNHMFDVNILGSFHTLREAARRVRDGGRIFPLSSTITRFRTETYGPYAASKMAQELYATVLAKELAGRNISVNAIAPGVVNTTLFTDGKTEAEL

SEQ ID NO: 47749 - protein, 517 aa, Aspergillus nidulans FGSC A4
MLFLSVLLAFAAYLLIYQYAMTNWNHARRARLWGCSPLPRYPTDILGLATLRESLKADKEKKIPLLLQNRLKRMSAREKRPVTTFVIRQMGLDNIFTCDHGNVQAILATKFKNFELGVGRRHTLYPMFGVGIFTSDGETWSRSRALLRPQFTRDQISDLDLEESHVQQAMRAMNVDPATGWTSSIDIQAIMFRLTIDSATEFLFGESAGSQAEALRNGGTLPLNHFSGDFDLGQWYVAQRSRFEKFYWLVDNRESRAVVKRVHEYVDRFVHAVLTTAEDRIEKSQSSSYVFLEALAASTKDPIELRSQLLNILLAGRDTTASLLSWSILMLARYPEVFTKLRSVILADFGSYTSSRDKITFASLKSCRYLQYFLNEVLRLYPAVPINRRVATTATTLPKGGGPAGDKPIYLRAGQVVTYSPFVTHRRTDLWGEDAEVFNPERWVNKKVGWEYLPFNGGPRVCIGQQFALTEAGYVIVRLLQRFDAIMDCFPEREIRYGLTLTLAPADGVFVRLHAAE

SEQ ID NO: 47750 - protein, 149 aa, Arachis hypogaea
MAEQTFIMIKPDGVQRGLVGEIISRFEKKGFYLKGLKLITVDRPFAERHYSDLSAKPFFNGLVEYIISGPVVAMVWEGKGVVATGRKLIGATNPLASEPGTIRGDFAIDIGRNVIHGSDSVESATKEIALWFPEGPANWQSSLHSWIYE

SEQ ID NO: 47751 - protein, 362 aa, Klebsiella pneumoniae subsp. pneumoniae MGH 78578
MQVKAAVTLGYQQPFVIKDVEVAPPGKDEILVKIVATGVCHTDAVMRDNPGVVPMPAILGHEGAGIVASVGEAVSGIRVGDHVVLSYAACHHCENCLSNHPSACEDFNTLNFGGRREDGTTPYRLEDQDLSLFFGQSSFSQYVVTRASNAVVVDPEVDLTLLGPLGCGIQTGSGTVLNRLKPVVGESLVVFGCGAVGLSAIMAAKLTGCSQIIAVDIHASRLALAGELGATHQINGKEQDAVAVIKQITGKGAHYAVETTGVSAIVLQAVHAVKPLGTVAIVGFTGDITLNVQNDLMAEGKSLVGVIEGDAVPALFIPLLVQLYKQGKFPIDKLIARYPLADINQAFADSASGKVIKPVVVM

SEQ ID NO: 47752 - protein, 306 aa, Pseudoalteromonas tunicata D2
MLKHYLHGLEFDKKQLLDILSLAQKIKAHPSDFNQALAGLSVVTLFEKPSLRTRLSFDIGIHKLGGHAVYLDQQNGGMGTRESIKDFALNISTWADCIVARVNQHNTLRDLAEHASVPVVNSLCDLYHPCQALADFMTMQEVHGDVSELKLAYFGEGNNVAHSLMLLAATFGTDFVVVCPKGHSPDAQIVKQAELIAASNGASIQISDRIEAAVGANVLYADTWVSMGDKTPLSQVKEQYMPYQLNQQLVDLTGASTVLHCQPAHREFEITSQVMDGPASRIIQQAENRMHAQNALLVTLLNPNFV

SEQ ID NO: 47753 - protein, 511 aa, Arabidopsis thaliana [sequence omitted]

SEQ ID NO: 47754 - protein, 351 aa, Ralstonia solanacearum GMI1000
MATFPNVPRRAFLNLVSLFAGGALLPASSQAVGLSAPAPASVIIDADPGQDDAIAILFALGARGRLDVRALTVVAGNVPLGLTERNARIIRDWAGRTHALPVYAGCAGPLTRELVTAAHVHGKTGLEGVDLPAPLAPLASQHAVSYLVDTLTQAAPNSVTLCALGPLTNIASALSEAPQIRPALREIVLMGGAHFERGNITPAAEFNIYVDPQAAEIVFGSGVPIVVLPRDVAMKAQITLARVAPFRGLGNRCGAIVADIMAAEIAYQKTRRGVERAPMYDPTAVGYLFDPSMFNGRKVNVVVETAGQWTLGETVVDWEGRSGRAPNAMWIHDVDADRFYAALLDSVAKLP

SEQ ID NO: 47755 - protein, 275 aa, Oryza sativa Japonica Group
MEPSDLAQKHTRFRIAVCKLAVSSSLVRTEKISMAISQEEQHAGGGRDYAEPAPQPFLGSSELRRWSLYRAAIAEFVATLLFLYVTVATVIGHKRRQDEGGDGEACGGVGLLGVAWAFGGTIFLLCLGAGLVRALNSAHFARHGGGANVVGDGYSKGAGLAAEVAGTFVLVYTVFSATDAKRSARDSHIPVLAPLPIGFAVFVVHLATIPITGTGINPARSFGAAVVYNQPNAWHDQWIFWVGPLVGSAIATLYHEHVLRASTLKALGSFKGARQ

SEQ ID NO: 47756 - protein, 133 aa, Pseudoalteromonas tunicata D2
MEYLSTVIYVDDVEETLDFYYQAFGISATKLHESGQYGELNTGSVKLAFAAHPLAQSHFKQNYIRAQPKQPALGFEISFHSDNVVAAYTKAIQAGAEPLSPPVEKPWGHTVAYVRSIEGTLIALSSDIEPELE

SEQ ID NO: 47757 - protein, 291 aa, Corynebacterium glutamicum ATCC 13032
MTFTLNNGLAIPDIGFGVFQTPPDETRNSVNAALEAGYRHIDTAAAYGNEREVGEAIAASGIGRDEITIETKIWVTDYGFEETLHAFDKATGKLGVDTLDILILHQAVPSSFDRTIAAYKALEKLLFDGAVRAIGVSNFMPEHLDKLLLETSIVPALNQIECHPYFQQRDVLARNEQLGILTQAWSPIGGITFYRDGQLPSTLENEVIAGIAAEVGKTPAQVMLRWHLQRRRHAIPKSVTPSRIVENFEIFDFELSDEQLQQIDALNTDLRGGPEPENITMENYYREIPEA

SEQ ID NO: 47758 - protein, 122 aa, Arabidopsis thaliana
  misc_feature (114)..(114): Xaa can be any naturally occurring amino acid
VSKGAKEEEKKKEVVRVSSMLSSAAGVTSRAQATRVVPLTGWKSSVAFRVTGKTNKDIISMASKGGRVSCMKVWPPMGKKKLETLSYLPDLSDVEWVKEVDYLLRQPRWISLGXIELEHGLV

SEQ ID NO: 47759 - protein, 431 aa, Pasteurella multocida subsp. multocida
AVIDVEFPQDAVPKVYDALNVETGLVLEVQQQLGGGVVRCIAMGSSDGLKRGLSVTNTNNPISVPVGTKTLGRIMNVLGEPIDEQGEIGAEENWSIHRAPPSYEEQSNSTELLETGIKVIDLVCPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLESTSRQLDPLVVGEEHYNVARGVQTTLQRYKELKDIIAILGMDELSEEDKLVVARARKIERFLSQPFFVAEVFNGTPGKYVPLKETIRGFKGILDGEYDHIPEQAFY

SEQ ID NO: 47760 - protein, 312 aa, Corynebacterium glutamicum ATCC 13032
MTTKIILDCDPGHDDAVAMLLAAGSPEIELLGITTVGGNQTLDKVTHNTQVVATIADINAPIYRGVTRPLVRPVEVAEDIHGDTGMEIHKYELPEPTKQVEDTHAVDFIIDTIMNNEPGSVALVPTGPLTNIALAVRKEPRIAERVKEVVLMGGGYHVGNWTAVAEFNIKIDPEAAHIVFNEKWPLTMVGLDLTHQALATPEIEAKFNELGTDVADFVVALFDAFRKNYQDAQGFDNPPVHDPCAVAYLVDPTVFTTRKAPLDVELYGALTTGMTVADFRAPAPADCTTQVAVDLDFDKFWNMVIDAVKRIG

SEQ ID NO: 47761 - protein, 573 aa, Pseudomonas syringae pv. phaseolicola 1448A
MSRRKRRLEKMTKTSRPLYISYAGPSLLEMPLLNKGSAFTPQERVEFNLIGLLPQNVETIEEQVTRVYSQYKQCASDLDKHIYLRSIQDNNETLFFRLLDSHLDEMLPIIYTPTVGQACQEFSKIYRTHRGLFISYPERDRIDDILRSATKDRIKIIVVTDSERILGLGDQGIGGMGIPIGKLSLYTACGGISPAYTLPIVLDVGTNNRELLDDPMYMGWRHERVSGKEYEDFIALFIDAVQRRWPDVLLQFEDFAQSNAMPLLEKYRDELCCFNDDIQGTASVAVGTLLAACKAKNETLGQQKVVFVGAGSAGCGIAEHIIAAMRIEGLSESEARKRIFMVDRFGLLTEGMDNLLDFQKRLAQKTADVSGWTAGTEAFPQLLDVVTNAGATVLIGVSGQRGLFTEQVIRELHKHCAKPLVMPLSNPTSKVEATPEEILRWTDGNALVATGSPFAPVEINGRTVHIAQCNNSYIFPGIGLGVVACKASRITDRMLMAASNALAECSPMVTGQGDAVLPPLKEIQQVSRKIALAVAKEAQAEGLALETSEEALLEAIERNFWLPGYRAYRRRSV

SEQ ID NO: 47762 - protein, 306 aa, Corynebacterium diphtheriae NCTC 13129
MPKVIVLTTGGTLSCTADPNGALIPTVSGDELVAPIRQRFAGALDIEVCELHRLDSSSMTLRDIDDIVTATHNALEDDSVVGVVVTHGTDSLEETAIAVDTFHSDPRPVVFTGAQKPFNHPESDGPGNLFEAIMIASDTSARGIGALIVFGHAVIPARGCIKWHTSDDLAFATNGPEEPRRADPIAPIALCDVVVDIIPAYPGAPRRLIDAALAAGAQGLVIEAMGSGNVGTDIGVALGEALDAGIPVVISTRVPRGEVFGAYGGAGGGKTLASKGAVNSTYFRSGQARVLLAIAIASGVHPATLL

SEQ ID NO: 47763 - protein, 202 aa, Methylococcus capsulatus str. Bath
MGEQPPKGEPKRLSEPRKTACAGLGPTQTGTWPLRWTLFQRPVRDFDGDTAMGWDRKNFRRPTEEEIKERLSEEQYAICRGNGTERPFANPYWDNHREGIYVDIVSGEPLFSSADKFDSGTGWPSFTRPLEPDHIVTLTDHSHLMVRTEVRSRYGDSHLGHVFDDGPAPTGKRYCINSGALRFIPKEELAEAGYEEYLKLFD

SEQ ID NO: 47764 - protein, 366 aa, Thermococcus kodakarensis KOD1
MLYSGGRLVVKFGGTSVRDDFREAVTFVSRLWDENEVALVVSAIKGVTDALLKFSRTGEGFEWIEKVHRDFAKKYGIPFETLAAPLRELKKLSREDFPSFEAYRDHVLSYGEWLSGLAFAEALRREGIQVELFEPWEILETDGNFGNARVDIAKTSRNLKVVEEALERGRVAVVPGFVGSYNGLRTTLGREGSDYTAAVLGKGLKARAVLIMSGVDGIYTADPRRVVSARLIPFVSYDELYVASKAGMKAIHHGAIDVVRGIPIIFGRTRDWSIGTIAGYESSSLPILVHRVAGEEAVITAVGVAEVPGFDGENGSELGIPLVRLTVPSARLGSTLNLIHLRLIADRISPPRALSIIRGGVSAGNV

SEQ ID NO: 47765 - protein, 521 aa, Neisseria gonorrhoeae
MKHRTFFSLCAKFGCLLALGACSPKIVDAGTATVPHTLSTLKTADNRPASVYLKKDKPTLIKFWASWCPLCLSELGQAEKWAQDAKFSSANLITVASPGFLHEKKDGEFQKWYAGLNYPKLPVVTDNGGTIAQNLNISVYPSWALIGKDGDVQRIVKGSINEAQALALIRNPNADLGSLKHSFYKPDTQKKDSAIMNTRTIYLAAAASGAWKPISNASTAWLTRYRYANGNTENPSYEDVSYRHTGHAETVKVTYDADKLSLDDILQYYFRVVDPTSLNKQGNDTGTQYRSGVYYTDPAEKAVIAAALKREQQKYQLPLVVENEPLKNFYDAEEYHQDYLIKNPNGYCHIDIRKADEPLPGKTKAAPQGQRLRRGQRIKNRVTPNSNAPDRRAIPSDQNSATEYAFSHEYDHLFKPGIYVDVVSGEPLFSSADKYDSGCGWPSFTRPIDAKSVTEHDDFSFNMRRTEVRSRAADSHLGHVFPDGPRDKGGLRYCINGASLKFIPLEQMDAAGYGALKGEVK

SEQ ID NO: 47766 - protein, 2126 aa, Magnaporthe grisea 70-15
MGLTADFDDRQTHIEAESNEYHPYEYQTENNSSWAGALPVKQGLYDPDLEKDACGVGFACHIKGKPSHKIVSDARNLLCNMTHRGAVGSDARDGDGAGVMTSIPHKFFIKNFEREVDIKLPPLGQYAVGNLFFKPDQETLHESKRQLEDIAESLGLRVLGWREPPVDSTLLGPAAKSREPIIMQPFVVLTSAYGAGNAPETTDPEKFDERLFERQLYVLRKRATHTIGLQNWFYLCSLSNKNIVYKGQLAPVQVYEYYHDLVNADYEAHFALVHSRFSTNTFPSWDRAQPLRWAAHNGEINTLRGNKNWMRAREGVMQSDIFGDELELLYPIVEDGGSDSAAFDNVLELLTINGVLSLPEAVMLMVPEAWQGNDHMDPKKAAFYEWAACQMEAWDGPALFTFADGRFCGANLDRNGLRPCRFYVMDDDRIICASEVGTIPVDPERVIQKGRLQPGKMLLVDTVAGRIIDDSELKAAVSSRQDFRSWLDKELISLPTLVESVAQDKTVQLEAKPDATALQEDPLLHAFGYTFEQVSLLLAPMAQDEKEALGSMGNDSPLACLSQAPHLLYEYFRQLFAQVTNPPIDPIRESVVMSLECYVGPQGNLLEMDASQCGRLLLPSPILSIPEFNAIKNMPKLHPEWTVKVIDITFPKKEGVEGYMRHLDYICNETTDAIEKRNRVIVLSDRNTSADRVAVSALLASGMVHHHLVSNKWRSMAALVVETAEAREVHHMCVLLGYGADAVNPYLAMECILKLNREKLIKKQLTDDMLIYNYKHSCDGGILKVMSKMGISTLASYKGAQIFEALGVDDSVVERCFRGTASRIKGVTFETIAEDAFRFHERGFPSRHTVAVPGLPESGEYHWRDGGEPHINDPTSIANIQDAVRTKNDKSYEAYSRSEYEQIKACTLRGMLDFSFEEATPVPIDQVEPWTEIVRRFCTGAMSYGSISMESHSTLAVAMNRLGGKSNTGEGGEDPERSQRMPNGDTMRSAIKQVASGRFGVTSAYLADSDELQIKMAQGAKPGEGGELPGHKVSKSIARTRHSTPGVGLISPPPHHDIYSIEDLKQLIYDLKCSSPRSRVSVKLVSETGVGIVASGVAKAKADHILISGHDGGTGASRWTGIKYAGLPWELGLAETHQTLVLNDLRGRVVVQTDGQLRTGRDVAIACLLGAEEWGFATTPLIAMGCIMMRKCHLNTCPVGIATQDPELRKKFKGTPEHVINFFYYIANELRAIMAKLGFRTINEMVGHAEMLKVRDDLRTNKTENIDLSLILTPAHKLRPGVATFNVRKQDHRLYVRMDNKLISEAELTLDKGLPSRIECDVVNTDRALGTSLSYQISKKYGEAGLPMDTVHVNIKGSAGQSFGAFLAPGVTLELEGDANDYVGKGLSGGRLVIYPPRSAVFKAEENVLIGNTCLYGATSGSCFFRGVAAERFAVRNSGATAVVEGVGDHGCEYMTGGRVVVLGSTGRNFAAGMSGGIAYILDIHHDFMSKLNMEMVEASGLEDPEEIAYVRGLIEDHHHYTGSELAARILVDFNRALPRFIKVLPVDYKRVLQEEAAKAAEAKRAEYSLPVLPSHQHKKEEKAAKLQDIEETIGDAAADKKKALKLDKTKGFMKYHRQNEKYRSSKTRTKDWAEISNRLDEDQLKYQTARCMDCGVPFCQSDSGCPISNIIPKWNELVFSGQWRDALNRLLMTNNFPEFTGRVCPAPCEGACVLGINEDAVGIKSIECAIIDRGFEKGWMVPQPPKVRTGKTVAIIGSGPAGLAAADQLNKAGHLVTVYERSDRLGGLLMYGIPNMKLDKRIVERRTNFMAAEGIQFKTGVDVGNGDVTLSSLKATHDAVVICTGATVARDLPIKGRNLEGVHFAMEFLHKNTKSLLDSELADGSYISAKDKNVVVIGGGDTGNDCIGTSVRHGAKSVINFELLPQPPPERANDNPWPQWPRIYRVDYGHSEVRQHMGKDPREYCIMSEEFVDDGSGKVKGINTVRVEWTKSASGGWDMKKVEGSQQFFPADLVLLSMGFLGPEARVLGDDIEKDARKNVKTAPGKYATNMEGVFAAGDCRRGQSLIVWGINEGRQAAREIDLYLEKYTSLPVTGGIVKRTAQEIFSAVKPVAPVAALNVYLEKI

SEQ ID NO: 47767 - protein, 231 aa, Brassica napus
  misc_feature (129)..(129): Xaa can be any naturally occurring amino acid
MAKKGVPEWLNSSLWSSSPSPIPDDRPLRPPPAAAATVPPSPPIVERPSPSPSPSAISTAPAPIRPPSKSETNDLQNGSGVDGPGSVTPAAEDVSRKTQVVAELSKKVIDLKELRKIASQGLPDDAGIXRSLVWKLLLGYLSPDRSLWSSELAKKRSQYKQFKEELLMNPSEVTRKMEKSKGGDSNDPKVEGPGALSRSEITHEDHPLSLGTTSLWNNFFKDTEVLEQIDR

SEQ ID NO: 47768 - protein, 105 aa, Oryza sativa
  misc_feature (85)..(85): Xaa can be any naturally occurring amino acid
  misc_feature (94)..(94): Xaa can be any naturally occurring amino acid
VKSGLEERGCAHLMRSREDHAKSVDVADLGVGLQLQSPDIPKDKHADSTLADTLKNYFASCELSMACSYIAMSDDDELPEAMLSXGLAENCNNXLGDYHISYTGT

SEQ ID NO: 47769 - protein, 219 aa, Cichorium intybus x Cichorium endivia
MAGSEVVLLDTWVSLFGMRVRIALAEKDVHYERREEDLTNKSSLLLQMNPVHKKVPVLIHDGKPICESNIIVQYIDEAWQNNSPPLLPSDPYLKAQARFWADFIDKKIYDAGTRIWRRKGEEQEIAKKEFIDWMKVLEGQLGENSYLMGKSFGYVDIAMVPFYCWFYALEKIGNISIEKECPKLVAWAKRCMERESVSKTLPDPHKVYEYALELMKKLG

SEQ ID NO: 47770 - protein, 308 aa, Ralstonia solanacearum GMI1000
MNPPSKIKHYLQFKDFSLEEYAYLLDRSRILKAKFKNYETWHPLHDRTLAMIFEKNSTRTRLSFEAGIHQLGGHAVFLNTRDSQLGRGEPIEDAAQVISRMTDIIMIRTFGQEIIERFATHSRVPVINGLTNEYHPCQVLADIFTFIEHRGPIQGKTVTWVGDANNMAYTWIQAAEILGFRFHFSAPKGYQLDPVMVADSSRPFVHVFENPLEACEGAHLVTTDVWTSMGYEAENEARKKAFGDWMVTEAMMQRAQPDALFMHCLPAHRGEEVEAAVIDGKQSVVWDEAENRLHVQKALMEYLLCGRY

SEQ ID NO: 47771 - protein, 358 aa, Pseudomonas fluorescens Pf-5
MSQFHRLTIKDLRNETRDAVSIAFEVPPHLQQQFHFTQGQHLVLRTELEGEEVRRSYSICTGVNDGELRIAVKRVAGGRFSAFANERLQPGHSLDVMPPAGRFHVELDPARRGHYLAVAAGSGITPILSIIRTTLQTEPHSRVTLLYGNRSSNSALFREQLEDLKNRYLQRLNLMFVFSRERQDIDLYNGRIDQDKCQQLFSRWLDVQQLEAAFICGPQAMTETVRDSLKAAGMPAERIHFELFHAGSDGHKRQARETASALDARHSRVTVISDGRALAFDLPRNSQSILDAGNAQGAELPYSCKAGVCSTCKCKVIEGEVEMDSNHALEDYEVAAGYVLSCQSFPLSDKVVLDFDQL

SEQ ID NO: 47772 - protein, 143 aa, Pseudoalteromonas tunicata D2
MALERTFSIIKPDAVAKNHIGAIYNRFESAGLKIVASKMVHLSKEKAEGFYAEHSARPFFGALVSFMTSGPVMVQVLEGENAVLKNREIMGATNPADALAGTLRADYADSIDENAVHGSDALESAAREIAYFFSDEEICPRTR

SEQ ID NO: 47773 - protein, 283 aa, Zea mays
  misc_feature (133)..(133): Xaa can be any naturally occurring amino acid
  misc_feature (144)..(144): Xaa can be any naturally occurring amino acid
MAATGSGSGGGRQNEEARQRWSLAGKTALVTGGTKGIGLAIVEELASLGARVHTCSRTAGDLDACRRRWADKGLVQAGDVITTSVCDVSSERDRESLVATVRDIFHGSLHILVNNAGGSLYRPAAATTPDDYXHLMATNLDSCXHLSRLAHPLLRRAGGAVVVHMSSVAAFVAYPALSAYSVSKGALQPLTRSLAAEWAPHGVRVNCVAPGVIDSTGISGTTLGDASRARRLAEMEMSRVPMRRFGTPQEVAALVAFLCMPAASYITGQVICIDGGRTVAAKL

SEQ ID NO: 47774 - protein, 607 aa, Zea mays
MKIVPYSRPRQQRPESEGGQGHRSPSLGDLPLHTHPPGGRWPELTPDRTRLAPEGMAATVRRAASSVLSRFLLTKPSPSPAASAAGNKSALLGSGAAALRHRFSTAPASAAAAAEEPIQPAVEVKHTQLLINGNFVDAASGKTFPTLDPRTGEVIARVAEGDSEDIDRAVAAARRAFDEGPWPRMTAYERCRVLLRFADLIERHAEEVAALETWDNGKTLAQAAGAEVPMVARCVRYYAGWADKIHGLVVPADGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTAIKNPAWL

SEQ ID NO: 47775 - protein, 330 aa, Bacillus cereus ATCC 10987
MNSILICGGAGYIGSHAVKRLVDEGLSVVVVDNLQTGHEDAITEGAKFYNGDLRDKAFLRDVFTQENIEAVMHFAADSLVGVSMEKPLQYYNNNVYGALCLLEVMDEFKVDKFIFSSTAATYGEVDVDLITEETMTNPTNTYGETKLAIEKMLHWYSQASNLRYKIFRYFNVAGATPNGIIGEDHRPETHLIPLVLQVALGQREKIMMFGDDYNTPDGTCIRDYIHVEDLVAAHFLGLKDLQNGGESDFYNLGNGNGFSVKEIVDAVREVTNHEIPAEVAPRRAGDPARLVASSQKAKEKLGWDPQYVNVKTIIEHAWNWHQKKPNGYDK

SEQ ID NO: 47776 - protein, 307 aa, Corynebacterium glutamicum ATCC 13032
MSNSTGTDIVVVGSINADLTAKVQRHPEPGETLLGSGGTVSAGGKGANQAVAAAQLGAKVTMIGAVGTDQMAGEALTHLRQSGADMSAIATVDGPTGLAIITVSDDGENTIIVIPGANASVTAEFVDKHSQLIENAGIVLLQGEIPADGFERAVDLSQGRVVINLAPVVPVGHDQLRRADPLLVNEHEGALVLDMLGTPATTSDPQSLVTELLEQGFTSVVMTLGAEGALVGTPGQLTAIPTPKIQAVDTTGSGDAFAGALVAKLSEGAGLIEAATFAARVGAYAATRPGAQASYPTLTTDLPSTTH

SEQ ID NO: 47777 - protein, 338 aa, Bacillus cereus ATCC 10987
MAILVTGGVGYIGSHTCVELLNNDYEIIVVDNLSNSSIESINRVKELTGKQFKFYKEDLVNYEALNKIFEENTIEAVIHFAGLKAVGESVAKPLMYYHNNIISTLVLCEVMQKHNVKKMIFSSSATVYGIPETSPITEEFPLSATNPYGQTKLMIEQMMRDVAFADAEWSIALLRYFNPFGAHESGRIGEDPNGIPNNLMPYVTQVAVGKLKELSVFGNDYPTKDGTGVRDYIHVVDLANGHVKALAKVMNTTGVDAYNLGTGTGYSVLEMVEAFEKVSGKKVPYKITERRPGDVAVCFADASKAKRELGWEAKHGLEEMCADSWRWQLNNKNGYITK

SEQ ID NO: 47778 - protein, 381 aa, Methylococcus capsulatus str. Bath
MRIEISVPPLPESVSDAKLLDWHKNVGETVGKGENLVDLETDKVVLEVPAPEDGVVVEVRGGKGDVVVSGQPIAVIDTSVRPAAPAASAATEKPAPVLSPAVRRLVAEHALDPAVIPASGREGRLTKQDVLDFLETRPAAEKARLPAGGRSERRVPMSRLRARIAERMLEAQHRTATLTTFNEVNLQKVFDIRNAHKARFEQQHGIKLGFMSFFVKASVEALRRFPIVNASLEGEEIVYHDYYDIGIAVSTDRGLVVPILRDADRTDFAGIEKAIAEFGQKARSGKLSLDELSGGTFTITNGGIFGSMLSTPILNPPQSAILGMHAIKERPVVEDGQIVIRPMIYLALSYDHRLIDGRDAVSFLFTIKELLEDPVRLMLAV

SEQ ID NO: 47779 - protein, 505 aa, Pseudomonas fluorescens Pf-5
MTTTRKKSKALPAPPTTLFLFGARGDLVKRLLMPALYNLSRDGLLDEGLRIVGVDHNAVSDAEFATLLEDFLRDEVLNKQGQGAAVDAAVWARLTRGINYVQGDFLDDSTYAELAARIAASGTGNAVFYLATAPRFFSEVVRRLGSAGLLEEGPQAFRRVVIEKPFGSDLQTAEALNGCLLKVMSEKQIYRIDHYLGKETVQNILVSRFSNSLFEAFWNNHYIDHVQITAAETVGVETRGSFYEHTGALRDMVPNHLFQLLAMVAMEPPAAFGADAVRGEKAKVVGAIRPWSVEEARANSVRGQYSAGEVAGKALAGYREEANVAPDSSTETYVALKVMIDNWRWVGVPFYLRTGKRMSVRDTEIVICFKPAPYAQFRDTEVERLLPTYLRIQIQPNEGMWFDLLAKKPGPSLDMANIELGFAYRDFFEMQPSTGYETLIYDCLIGDQTLFQRADNIENGWRAVQPFLDAWQQDASLQNYPAGVDGPAAGDELLARDGRVWRPLG

SEQ ID NO: 47780 - protein, 503 aa, Yersinia pestis CO92
MTQQNTKIPAQQGAQRLRRELKSRHLAMIAIGGSIGTGLFVASGATVSQAGPGGALLSYALIGLMVYFLMTSLGELAAFMPVSGSFSTYGSKYVEEGFGFALGWNYWYNWAVTIAVDLVAAQLVMNYWFPDAPGWIWSALFLGLMFLLNYISVKGFGEAEYWFSLIKVTTVVIFIIVGVMMITGIMKGGETAGWHNWTIGDAPFAGGFSAMIGVAMIVGFSFQGTELIGIAAGESKDPGKNIPKAIRKVFWRILLFYIFAILIISLIIPYTDPSLLRNDVKDISVSPFTLVFQNAGLLSAAAVMNAVILTAVLSAGNSGMYASTRMLFTLASEGKAPRIFAKLSKGGVPRNALYATTVVAGLCFLSSMFGNQTVYLWLLNTSGMTGFIAWLGIAISHYRFRRGYMMQGRDLNDLPYQSGFFPLGPIFAFVLCLIITLGQNYQAFLQDRIDWYGVTATYIGIPLFLVIWFGYKLSRGTRVVKYQEMEFPKWRDESEEHQKPTSR

SEQ ID NO: 47781 - protein, 341 aa, Bacillus cereus ATCC 10987
MNYRPLDNSKTYLITGAAGFVGYFLSKKLLDQGCKVIGIDNINDYYDVNLKYARLEQLKPYEKFIFIKGDISDKDMITKLFEEYKPNIVVNLAAQAGVRYSIENPDVYIQSNIIGFYNILEACRHFPVEHLVYASSSSVYGANKKVPFEETDFVDNPVSLYASTKKSNELMAHTYSHLYKIPATGLRFFTVYGPLGRPDMAYFGFTDKYFAGDSIKIFNNGDFENDLYRDFTYIDDIVEGIQRLLSNPPKGDVEHKVFNIGNNNPEKLMVFIETLEKVLGKALGREVAFEKVFEPIKPGDVPATYASTDLLQKAVDFKPETSIEKGLQEFANWYIEYYKVK

SEQ ID NO: 47782 - protein, 505 aa, Methylococcus capsulatus str. Bath
MKNGNADVGLIGLAVMGQNLALNVADHGYTIAVYNRNYQRTQEFMAHCERAEPSRVRIRPCAELAEFVQAIARPRRIILLVKAGAGTDAVIGQLLPLLDPGDLVVDGGNAHWLDTIRRERELDAAGIRFIGSGVSGGEIGARFGPSLMPGGSAESWRLLEPVWQAIAAKVDPATGKPLEGAAPGRPVTGGEPCTALIGPNGAGHYVKMVHNGIEYIDMQLISEGYWLLKHLGGLESGAIASIFRDWNEGELSSYLIEITSDILQQQDPSGDGFLVDKVLDAAGQKGTGQWTAASALEQGVPANAIAEAVFARALSALKEERVAASVILQGPEVRLEADTVHLVEAVRDALYCAKICAYAQGFQLMAQAQKTYGWQLDFATIARIWRGGCIIRARFLQKITDAYGRDAALSNLMLDPYFRDALHRGQGHWREIVALAVRNGLPVPAFGSALAYFDGYRSASLPANLLQAQRDYFGAHTYERTDRPRGRFFHLDWPAPDRPEAEAGG

SEQ ID NO: 47783 - protein, 418 aa, Zea mays
SRRLFAAERAAAMNGASAGAGGEAPLVYKAWKGNNVFLLKGRFIFGPDARSLFITMFLIVAPVSIFCAFVAKELMDKFSYGLGLPVMIAAVLFTAYDLSLLLLTSGRDPGIIPRNAHPPEPEGFDGNAEVGANQTPPVRLPRVKDVVVNGITVKTKYCDTCMLYRPPRCSHCSICNNCVERFDHHCPWVGQCIGLRNYRFFYMFVFSTTLLCLYVFGFCWVFIIKIRNAEQITIWKAMTKTPASIALIIYTFIAVWFVGGLSVFHLYLMSTNQTTYENFRYRYDQRDNPYNKGVMENIKEIFFTTIPPSKNNFCGRVEQEHGLRPRPTNGFMSPNMGRAVGDIEMGRKPVAWDEPRMAAEIGDLGAGLSNLLEDKDGRFRTTSPDLSRDALAVGGGLEEHGSSAMNPGRSSWGVEAGR

SEQ ID NO: 47784 - protein, 327 aa, Physcomitrella patens subsp. patens
MGRTRSVRKCSLLSADHKSTLCEYNRTRALILVEYASAVYIVDETSILSWTCSRCNGLTKGFKMHSLIVDVQHCLQAFVGIAEDLKAIVIAFRGTQESSMQNWAEDLYFRELDLNYPGGTDALVHRGFYAAYHNTTLRERVVDAAHAIQQSRSDLGIMVTGHSMGGAMATFCALDLSANFGLKNIEVFTFGQPRVGNYGFSVYYNKYVPLTIRVTHANDIVPHLPPYYPLIGEKTYHHFATEVWIFRVTLGRLQLEFERVCNGSGEDPSCSRSVAGNSIADHLNYYGVYLRTEDELSALRSSSSTNFSTPYSGQTLGFCKTSKISAQ

SEQ ID NO: 47785 - protein, 73 aa, Zea mays
MTTSRRLADRKTAKFQKNITRRGSVPETTVKKGNDYPVGPLVLGFFIFVVIGSCMCLCLLTLKMFSYYIVLCW

SEQ ID NO: 47786 - protein, 262 aa, Neisseria gonorrhoeae
KTSTRTRCAFEVAARDQGAAATYLEPSASQIGHKESIKDTARVLGRMYDAIEYRGFAQETVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKGVGFIHTDVWVSMGEPKEVWQERIDLLKDYRVTPELMAASGNPQVKFMHCLPAFHNRETKVGEWIYETFGLNGVEVTEEVFESPAGIVFDQA

SEQ ID NO: 47787 - protein, 802 aa, Bacillus licheniformis ATCC 14580
MRKSIVRYFVMAFILLFALSTFLTGVQATSVPDKKSPELEKAEIYGDIDVTSDKQTTVIVELKEKSLAEAKADGEKQTKASLKTARSKALKTLKKAKVNREYDRVFSGFSMKLPASEIPKLLAVKEVKAVYPNATYKPDSVKGKDVTLAADAIYPQMDKSAPFIGADQAWKSGYTGKGIKVAVIDTGVDYTHPDLKNNFGPYKGYDFVDNDYDPQETPTGDPRGGATDHGTHVAGTIAANGQIKGVAPEATLLAYRVLGPGGSGTTENVIAGIEKAVADGAKVMNLSLGNSLNSPDYATSIALDWAMAEGVVAVTSNGNSGPENWTVGSPGTSRVAISVGASQLPYNEYSVTLPSYSSAKVMGYQEEKDLEALNGQEVELVEAGLGQADDFSGKDVKGKVAVIQRGVIPFVDKAENAKNAGAIGAVIYNNATGEIEANVMGMAVPTVKLSKEEGEKLVQQIKEGKHSVVFSFKLDKKLGETIASFSSRGPVMDTWMIKPDVSAPGVNIVSTIPTHDPKNPYGYGSKQGTSMASPHVAGTAAILKQAKPDWTPEQIKGVLMNTAEKLTDENGKPLPHNTQGAGSIRIMEALKASSIVTPGSHSYGTFLKDKGKQTKKQAFTIENLSSHRKAYQLEYSFKGTGITVSGTERVVVPANQTGKAAAKVTVNSAKTKAGTYEGTVYIREDGRKVAEIPLLLIVKEPDYPRVTSVTVEPGAKQGAYTIEAYLPGGAEELAFLVYDENLNLLGQAGVYKNQGKGYQSYQWNGKINDAASLKSGKYYMLAYASAKGKSSYVLTEDPFIVE

SEQ ID NO: 47788 - protein, 199 aa, Coccidioides immitis RS
MSFATSTWEGICARYPPGWIEGVGSAAVQFFGFILPGLGFLAFDILKPASFASRKIQQPCKQPSKQQMLSCLGLVFGNQLFLIASHFFLLRISNYELTPFRMDSQLPSILEVVINCAVGAILRDVVFYYVHRLMHTKILYRRIHRIHHEFRAPIALAAIYSHTIDHVLVNAMPIYISMAVQRRVFLVPSAKRRKPRYSS

SEQ ID NO: 47789 - protein, 724 aa, Kluyveromyces lactis NRRL Y-1140
MSNSLRRSSASSSSSQGKPGRNGSGNGSYSQINSSLHARVKAFQEQRQLKRSGSIHSNQSQNSVQIEQIVNKPLPPLPPKTMVEEAENSQQLEQQQQQQHNIQIQQTQQQQQRQPILKQQDQHLQHLQHTELLAQSVTENDQHDQQQQQQGGLLLSPKTELPDIEEKKGQFEKQTQEALANLSIQSDGMSSASESSGSASNKQQQDHELNPIRKAPKRPQGVPSCTGSGNAGAPSPIGGVGGSQAAAGTFRPPAAAGGVVMPNQPRLSQGQPHLQKAKQSLSARRGLKLPTGGMSLKMKPTHQQQQLAPQHTHQEFAGAPSNSALPLQGKRSNPGSLINGIQSTSTSLANSSHDTLGTDPKSNPTSNSNSGIGGLFANFSKYVNIKSGSLNFAGKLSLSSKGVDFSNGSSFRIKLDELEFLEELGHGNYGNVSKVLHKPTHIIMAMKEVRLELDESKFRQILMELEVLHNCQSPYIVDFYGAFFIEGAVYMCMEYMDGGSLDKTYDDEQIGGIDEPQLARITSSVIQGLKELKDVHNIIHRDVKPTNILCSASQGTIKLCDFGVSGNLVASLAKTNIGCQSYMAPERIKSLNPDKSTYSVQSDIWSLGLSILEMALGAYPYPPETFDNIFSQLSAIVDGPPPKLPEGKFSADAQNFVSMCLQKIPERRPTYAALLEHPWLKKYENVDVRMSEYITNRLNKKRELLEQTGEGPPKHVPALHMGGL

SEQ ID NO: 47790 - protein, 513 aa, Solanum tuberosum
MIMTAATVVIAAIVVILVAYFVGKVLYTVWWWPKMIEIKLKKEGIHGEPYKLLFGNFKEMMKMSKEAKKQPLLNHDIIPWVNPFLLRLSNTYKKIFVVWYGPTPRVTVTDPKLIREVLNRYNEFHKPEANAFIHLFVSGLGSYNGEKWDTHRKILNPAFHVERLKRMFPAISVCCDEMINRWDKLVSKEGSCELDVTDEFLNLSGDVISRAAFGSNIEEGRSIFLLQKEQCELIFASPFTLFFPSLRFLPTASNRKAKYIHKKVISLIRGIIEKREDAVRRGVSENDDILGLLLKARNEENAAGRGSVSLSTDDVIEECKQFYFAGQDTATALLSWTLVVLSMHPEWQDKARNEVFQVIGKNKPQFDDLNQLKLMNMIFQEVLRLYPAIFLIRGTSKDTQLGDMTIPPGVQVCVPTHLVHRDPQVWGDDALMFNPERFSEGVTKAAKEQLYFPFGWGARMCIGLNFGMLEAKLIFAQILQHFWFELSPSYTHSPQLILVMKPQYGAQIILHKL

SEQ ID NO: 47791 - protein, 411 aa, Xanthomonas campestris pv. campestris str. ATCC 33913
MAIAFGDASMQRSFWRSGHTPTLFASFLYFDLSFMVWYLLGPLQVPIAQALGLDTQQRALMVAVPILCGAVLRLVLGMLADRIGAKRAGVVAQLAVIASLFGAWQLGVHSMGQVLLLGVLLGIAGASFAVALPLASRWYPPEHQGTAMGIAGAGNSGTVLAALFAPMLALAFGYQNVFGLACIPLVLTLLVFVLIAREAPIPVARKRWADYGRVLVGNRDAWRFMFFYSVTFGGFSGFASALPGYFHDQFGFDARTAGWATAACVLAGSVMRPLGGVIADRVGGTRALLAVYLLVATLVGIAGFGAGGATITLGLFVLTLLCLGAGNGAVFQLVPQRFGQDIGVMTGLIGMAGGVGGFALAAGLGVLKQHTGSYAIGMWLFAAFALGGWALLAGVKTQWRSEWSTAGAARV

SEQ ID NO: 47792 - protein, 491 aa, Triticum aestivum
  misc_feature (4)..(4): Xaa can be any naturally occurring amino acid
  misc_feature (403)..(403): Xaa can be any naturally occurring amino acid
QTWXVEDSCPDYMLKAEECLKREKERVAHYFHASGEPKLLEKVQHELLTQYASQLLEKEHSGCHALLRDDKVEDLSRMYRLFSRITRGLEPVSQIFKQHVTNEGTALVKQAEDAASNKKPEKKDIVGLQEQVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQTKFEEFISTHPELNPGIDLAVTVLTTGFWPTYKSFDINLPAEMVRCVEVFKEFYQTRTKHRKLTWIYSLGICHITAKFEAKTIELIVTTYQAALLLLFNGADKLSYSEIVTQLNLSDDDVVRXPLPPVDEKKKVVEDVDKDRRYAIDASIVRIMKSRKVLGHQTLVMECVEQLGRMFKPDFKAIKKRIEDLITRDYLERDKENQNVYRYLA

SEQ ID NO: 47793 - protein, 412 aa, Streptococcus pneumoniae
MKIAVTGTGYVGLSIAVLLAQHHQVIAVDIIPEKVELINQRKSPIQDDYIEKYLAEKDLNLVATLDAKEAYKDADFVVIAAPTNYDPKKNFFDTSAVESVIETVLKYNPDAIMVIKSTVPVGYTESARKKFQTENILFSPEFLRESKALYDNLYPSRIILGTDKNNERLVSVAETFAGLLQEGALKEDIDTLYMGFTEAEAVKLFANTYLALRVSYFNELDTYSEMKGLDTQAIIDGVGLDPRIGSHYNNPSFGYGGYCLPKDTKQLLANYEDVPEELIGAIVRSNSTRKDFIADQVLKMVDSYDYSAHNVFNERVEKDIIIGIYRLTMKSNSDNFRQSSIQGIMKRIKAKGVRVVIYEPTLESGSTFFGSSIINDLEEFKRLSNAIVANRYDNSLEDVKEKVYTRDIFERD

SEQ ID NO: 47794 - protein, 272 aa, Bradyrhizobium sp. ORS278
MLMIEANGARIPALGLGTWELRGRTCTRIVEQALTLGYRHIDTAQVYENEHEVGEGLRASRVRRNEIFLTTKVWTTHFAPNDLERSTKESLVRLRVSEVDLLLLHWPNSHVPLAETLGALAHAKKLGLARHIGVSNFTVALLDEAVAVSPEPLACNQVEYHPYLDQTKVREACARHGIALVAYSPIAKGKIKNDPTLTRIGRAHGKTTAQICLRWLVQQNVVAIPRTSKIERLSENLDVFDFELSGQDMADIFAMGSPEGRMTNFAFAPNWD

SEQ ID NO: 47795 - protein, 352 aa, Zea mays
  misc_feature (161)..(161): Xaa can be any naturally occurring amino acid
NTNGVLAFHRTMARCLWVGKNAAASGAGAAIPKPPAPHPPAPRSLPAVDDCPTLAFLRPKPTAVGYATATVPLPAHCFPALPVGDHLFHRLQLDGLIPPVSTATRPPEHAGVTVEQARKVARAAEMEVARARLRSNAQSVVSGSEFAALCVDIAGGVEGGXRLVRALDESGVVIVLGDAVFLRPDMKSGSCDDKSERTAILEQTERERAKERKKETAAAARLEAMEAQKAAIDADAAAQVRRELWCGLGLLATQTLGFMRLTFWELSWDVMEPVCFYATSLYFMSGYAFFMRTATEPSFEGFYRSRFASKQRRLMRARGFDVDRYNALRKGQGQGLVPLADPDACRHVSHVQ

SEQ ID NO: 47796 - protein, 488 aa, Pseudoalteromonas tunicata D2
MFSPLSQPLVFTDSVIANQPFVTKTFITVDNPATEKLLTSVSCVDDAGIEHAVQSAELGFGTLKSMHSQARSDLLMRWYQLVIDYIDALAEIMTLEQGKPLAEAKGEVIYGAEFIRWFAEECKRSYGQQIPSNNNHQQLSTIRQPIGVVLAITPWNFPIAMITRKVAPAIAAGCSVILKPSELTPLSALALAHLAIRAGFPKGAFNVLLTDDAPSLVSKLLADHRVKKVTFTGSTQVGRILLAQAANTVKRTSMELGGNAPFIVFDSANLDQAVDGLIKSKFRNAGQACVATNRVLLDASIAGDFTAKLLTKVATLKTGNGLSNDTDLGPLINQAAKLRLVATIEQAICEGASWVFGETAFAEAKCSKDNFLPVVVLGNINQDMAIFQQELFGPVVLLSQFESEQQAIELANSTEYGLAAYFYSQNINQVHRVAESLTFGMVGINEGLISNAIAPFGGIKQSGLGREGGQAGLDEYLQQKYLCLNIKD

SEQ ID NO: 47797 - protein, 327 aa, Oryza sativa Japonica Group
MASPSPSSSPLHPQHQHQHPLPPHPQPQYQSPPPPMPPPPPAAPLKAIDLEVTVVSGKHLKNVNWRRGDLRAYVVAYLDPSRRAATRPDDVGGCKPAWNERVVLPLPPHLSPHDPSLLLSLDVFHSKPSDSPKPLVGSARSPLRDLLFSTNPNPSPDSPASALITLPLLRPSGRPQGKLRIRLALRERSPPPPEPQYPPPSSSPYYFPPPPPPAYSAPPPPQYGSEQYYRSGGYYSAPPPPPQYEYTAGPSAPVEYNRQYDPRAGSGSGNGRYGVGTGIAVGTVTGALGGLAIDEGVKYKEEKSADRVEDKVVPAGRDDDSRGYREY

SEQ ID NO: 47798 - protein, 513 aa, Oryza sativa Japonica Group
MPLATLLGHLAAGRFGLVQALTGAATAAAAHRLLHLLLRTAPPPPLPDLVSLARWSRAHFRAPLPLRLHGLLLARLASKGLYPLLRSELQVLAAARLNSPASILRALPSRSASASASKPLIADMLVLALARASQPLRAIGQLRKAGDVAKDIKAWGLAPSVATYNSLIDGYCKKGGAGNMYHVDMLLKEMVEAGISPTAVTFGVLINGYCKNSNTAAAVRVFEEMKQQGIAASVVTYNSLISGLCSEGKVEEGVKLMEEMEDLGLSPNEITFGCVLKGFCKKGMMADANDWIDGMTERNVEPDVVIYNILIDVYRRLGKMEDAMAVKEAMAKKGISPNVTTYNCLITGFSRSGDWRSASGLLDEMKEKGIEADVVTYNVLIGALCCKGEVRKAVKLLDEMSEVGLEPNHLTYNTIIQGFCDKGNIKSAYEIRTRMEKCRKRANVVTYNVFIKYFCQIGKMDEANDLLNEMLDKCLVPNGITYETIKEGMMEKGYTPDIRGCTVSQASENPASS

SEQ ID NO: 47799 - protein, 260 aa, Vitis vinifera
MNTNIEKYESGKFEAGGYKWRLCLYPNGNIKSNGKGYISLYLAIADTKMLPLGWEVNVNFKLFVFNHKHDQYLTVQDAGGKLTRFNVMKTQCGFPQFLSLDVLNDPCNGYLMEDSCIFGAEVFVIKYSGKGECLSMIKEPVDGTFTWVIENFSTLKEKVMYSDVFTVEDFKWHLILYPKGSSKTKNKSLSLFLELADCETLDNQSKLYAEFELLISKPLFYCFIQLYFYFLIFQLFLAGHGRFPDSKCSLDFVRCLLILN

SEQ ID NO: 47800 - protein, 457 aa, Bacillus cereus ATCC 10987
MYKIAVAGTGYVGLVAGVCFAEVGHQVTCVDIDEEKVKLMESGVSPIYEADLEELMQKNYTAGRINYTTDYQSAYKDADAIFIGVGTPEQADGSANLSYIATVAKQIAESVEKDCLVVVKSTVPIGTNDKVEQFIQDFLVNDVKVEVASNPEFLAQGSAVHDTLYAERIVIGTESKWAEEVLMNLYKPFHLPIVSVNRRSAEMIKYASNDFLALKISYMNDIANLCELVGADIQDVARGMSFDERIGSKFLNAGIGFGGSCFPKDTKALEYLARQNGYELRTIKAAIDVNKDQKTLLYKKASQRLITFNGLKVAVLGLTFKPGTDDLREAASLENIPLLLEQGADIYAFDPVGANNFAKVYPEGRNKNGNITYVTDIEQALEGANVCFIFTEWGEVKALTPEMYKKLMRTPLIYDGRNIYDVQAMQEAGIEYHSIGRKSTNRDRMKELNNIELQASR

SEQ ID NO: 47801 - protein, 331 aa, Vitis vinifera
MADEKPPVVAEKTLHPTSICNSTTSISRTLRSIKPAHYLFRVESVSVLLNTDIEKYESGSFKVGGYRWRLCLYPNGNKKSGGEDHISLYLEISDAQKLPVGWEVTVNFKLFVFNHIHEKYLTVQDADGKVRDFNVMKSRCGFAQFLSLDVLKDPCNGYLMDDSCIFGAEVFVIKYSGKGECLSMIKDPDDGTFTWVIENFSTLNEEVLYSETFTIKEIKWHLSLYPKGNGKVKNKSLCLFLELADCETLHHQRKLYMEFELLIKDQCNDENVEPSHVKSNAKVWFCDSNKEWGFADMVSLSDLNDKSKDFLLNDSLIVEAKILLMMHSKNI

SEQ ID NO: 47802 - protein, 127 aa, Pseudoalteromonas tunicata D2
MAYSDKVLDHVANPRNVGAFDKNDPSVATGMVGAPACGDVMKLQIKVSPEGIIEDAKFKTYGCGSAIASSSLVTEWVKGKTLDQAAEIKNTDISAELELPPVKIHCSILAEDAIQAAIADYKSKHGK

SEQ ID NO: 47803 - protein, 227 aa, Vitis vinifera
MLLKLNIEAISRTLRSIQPAHYLFKVESLSVLLNTDIEKYESGSFEVGGYKWSLCIYPNGNKKSDGEGHISLYLEISEAQNLPLGWEVTVNFKLFVFNHIHEKYLTVQDADGKVRHFNAMKTRCGFAQFLSLDVLKDPRNGYLMDDSCIFGAEVFVIKYSGKGESLSMIKDPVDGTFTWTIENFSALNQEVLDSEIFTVKELKWHVLMHFLHFSSFLIAVKWINVQM

SEQ ID NO: 47804 - protein, 278 aa, Vitis vinifera
MRFSKFFIYFLKLESISRTLRSIQPAHYLFRVESMSVLLDTSIEKYESGSFEVGGYKWRLCLYPNGNKKSDGDGHISLYLVISDTQNLPLGWEVTVSFKLFVFNHIHEEYLTVQDTDGKVRHFNVMKTQCGFAQFLPLDVLTDPCNGYLMDDSCIFGAEVFVIKYSGKGECLSMIKEPDDGTFTWMIENFSRLKQEAIYSEIFTVKDFKWHLVVYPKGNYKAKNKSLSLFLELANRGTLHHQRKLYTEFELLVKEQCNGGHVKPSHVKLNGTLHILFC

SEQ ID NO: 47805 - protein, 462 aa, Volvox carteri
MALSMKMRANARVVSGRRVAAVAPRVVPFSSVARPVLRSTFAPEVSIDIRRAGRSRIVVEAVKKSVGDLGKADLEGKRVFVRADLNVPLDKKTLAITDDTRIRAAVPTLKYLLDNGAKVLLTSHLGRPKGGPEDKYRLTPVVARLSELLGKEVKKVDDCIGPSVEQAVASLKSGELLLLENVRFYKEEEKNDPEFAKKLASNADLYVNDAFGTAHRAHASTEGVTKFLKPSVAGFLLQKELDYLDGAVSAPKRPFVAIVGGSKVSSKITVIEKLMEKCDKIIIGGGMIFTFYKARGLKVGSSLVEEDKLELAKNLEAIAKAKGVQLLLPSDVVVADKFDANANTQTVSVEAIPDGWMGLDIGPDSIKTFQDALADAKTVVWNGPMGVFEFPKFAVGTVAIANTLSELTPKGAITIIGGGDSVAAVEQAGVAEKMSHISTGGGASLELLEGKVLPGVAALDEK

SEQ ID NO: 47806 - protein, 274 aa, Pseudoalteromonas tunicata D2
MFARIKEDVHSVFARDPAARNFWEVFFNSPGLHALWCYRLNHKLWQAGWFFLARTFSTVARWFTGIEIHPAATIGRRCFIDHGMGVVIGETAEIGDDVTLYHGVTLGGTSWQTGKRHPTLEQGVVVGAGAQILGPITIGAGAKIGSNSVVVKHVPSHATVVGIPGRVVTAKAPELAADSAKQQRAAIAEKYGFDAYAVSYDNPDPVANSIGKMLDHIHLLDAKINELSCALNKLGGDVCEQQLPELNLDDQDFCKAEQLAKQKRQQHDDFDPKI

SEQ ID NO: 47807 - protein, 253 aa, Streptomyces coelicolor A3(2)
MADAPYKLILLRHGESEWNEKNLFTGWVDVNLTPKGEKEATRGGELLKDAGLLPDVVHTSVQKRAIRTAQLALEAADRHWIPVHRHWRLNERHYGALQGKDKAQTLAEFGEEQFMLWRRSYDTPPPALDRDAEYSQFSDPRYAMLPPELRPQTECLKDVVGRMLPYWFDAIVPDLLTGRTVLVAAHGNSLRALVKHLDGISDADIAGLNIPTGIPLSYELNAEFKPLNPGGTYLDPDAAAAAIEAVKNQGKKK

SEQ ID NO: 47808 - protein, 438 aa, Desulfitobacterium hafniense DCB-2
MSKMMKFESGFSQEEALAEASRCLQCKKPLCRQGCPVNNAIPQFIRALKEGEYAQGLEAIYRHSYLPAVCGRVCPQEKQCEASCILARKGKAIRIGKLEQFIADNATEVGFPKVAATMGAIAVIGSGPAGLAAAVQLAQLGYAVTIFEGEAEPGGVLLHGIPEYRLPKDVVRRDIKKIENLGVEFRLNTLVGVDLFLDDLLTQGYQAVFIGTGAGLPKTLELPGEYLEGVISALYVLQTINLYNSGQLPEQELPVEKGEHVVVIGAGNVAMDAARTASRLGAEVTVLARRGLNDMAARDIERDEAIADGVKIRTYAAPLAILGEENVTGIKCVNTMVSPAGKVVIKEEESFVLPADKVIFAIGQRPYARIVTTSQGFEINKQGLLICNEHGMTTREGVFAAGDVVHGPATVVKAMGEGRRIAIEIHAYLLRKKLQSAK

SEQ ID NO: 47809 - protein, 411 aa, Desulfitobacterium hafniense DCB-2
MAQINENYLKLPGSYLFSEIARRVNEFKVQNPDADIIRLGIGDVTRPLAPVVVEAMKQAVEEMGRAETFRGYGPEQGYDFLIEKIIANDYAPRGVQLGMDEVFVSDGAKSDTANFQEIFGVDNIMAVTDPVYPVYVDSNVMAGRTGNYDTEKGQYGRIIYLPCTEEGDMKPELPTAPVDMIYLCFPNNPTGMTLTKEELKVWVDYARENKAIILFDSAYEAFIREEGVPRSIYEVEGAREVAVEFRSFSKTAGFTGTRCAYTVVPKDIMIYDSTGEGHSLNKLWLRRQTTKFNGVSYPVQAGAAAVYTEEGKKQIQATIDYYMENARIIREGLQEAGFKVFGGVNAPYIWMKTPGTMGSWEFFDKLMTEAHVVGTPGAGFGANGEGFFRLTAFGTRENTEKAIERIKARMK

SEQ ID NO: 47810 - protein, 2228 aa, Kluyveromyces lactis NRRL Y-1140
MSIITPTAPITPPMESTGDRMITLELKDGTTLQGYSFGAETTAAGELVFQTGMVGYPESITDPSYEGQILVITFPLVGNYGVPDRKLMDEYVEGLPRYFESNRIHVAGLVIAHYTEEYSHWLAQSSLGTWLKESNVPAVYGIDSRSLTKHLREAGSMLGRFALQKPGTSFEDANSAEWMSYFETPEWVDPNVDNLVAKVSLKAPKLFVPNHPDIDLVQGPDGKTLRIVAVDVGMKYNQIRCFVKRGVELLVVPWDYDFTTEEYDGLFISNGPGNPAILQEVSDRLTKVLDAKKTPVFGICLGHQLLARASGASTLKMKFGNRGHNIPCTSTVSGRCYITSQNHGFAVDETSLTNGWKSLFTNANDGSNEGIYHSELPYFSVQFHPESTPGPRDTEFLFDVFIQSVLDFKQTGVLKQVEFPGGNIEENLAAHPREDVKKVLVLGSGGLSIGQAGEFDYSGSQAIKALKEEGIYTILINPNIATIQTSKGLADKVYFLPVTAEFVRKVILHERPDAIYVTFGGQTALSVGIEMKDEFETLGVKVLGTPIDTVITTEDRELFANAMDEINEKCAKSAAAATVAEALEAVKDIGFPVIVRAAYALGGLGSGFASNEKELVDLCNVAFASSPQVLVERSMKGWKEIEYEVVRDAFDNCITVCNMENFDPLGIHTGDSIVIAPSQTLSDEDYNMLRTTAVNVIRHLGVVGECNIQYALNPTSKEYCIIEVNARLSRSSALASKATGYPLAYTAAKLGLNIPLYEVKNSVTRSTCACFEPSLDYCVVKMPRWDLKKFTRVSTLLSSSMKSVGEVMSIGRTFEEAIQKAIRSTEYSNIGFSETDDELDIDYELSNPSDMRIFAIANAFAKFGYSIDQVWEKTNIDKWFLNKLYSLIKFSDKISSYGSKENLPALVLKQAKQLGFEDRQIAKFLNSNEVAIRRLRKEYGIIPFVKQIDTVAAEFPAHTNYLYLTYNAAAHDLDFNDHGVMVLGSGVYRIGSSVEFDWCAVTAVRTLRKNNFKTIMVNYNPETVSTDYDEADRLYFETINLERIMDIYELESSAGVVVSMGGQTSNNIAMSLHRENVKILGTSPEMIDSAENRYKFSRMLDQIDVDQPAWKELTSMDEAEDFAEKVSYPVLVRPSYVLSGAAMNTVYSKDDLESYLNQAVEVSREYPVVITKYIENAKEIEMDAVALDGELIMHVVSEHVENAGVHSGDATLIVPPQDLDPETVRRIVEATAKIGRALQITGPYNIQFIAKNNEIKVIECNVRASRSFPFISKVVGVNLIEMATKAIMGIPVTPYPVEKLPDDYVAIKVPQFSFPRLAGADPVLGVEMASTGEVAAFGHSKYEAYLKSLLATGFKLPKKNILLSIGSYKEKQELLPGVKKLYNMGYKLFATAGTADFISEHGIPVQYLEVLNEEDDEKSEYSLTQHLANNKIDLYINLPSANRFRRPASYVSKGYRTRRMAVDFSVPLVTNVKCAKLLIEALSRNMSLDVSERDAQTSHRTVTIPGLINISAYVPNISNVLLGPAELKEVTRLSVESGFTYSQIMPKSSSGPVITDAASLKVANSVVKDSAYTNFGFTVAATPNNIDTVSAVANEATSLFLPYRELSNNVPAVSEHLKHWPLDKPVIAEAKTSDLASVILLASLQNRSIHITAVSNKEDLSLVMAVKEKQSNVTCDVNIHSLFVSQDDYPEAKFLPTKEDQEFFWSNLESIDAFSIGSLPTALAAVTGNEIVTGLGIKEALPLLLSAVNDGRLTIDDIVERLHINPAKIFSIPEQNSAVEVDLDFTFRHTKRWSPYQKGGLTGGIQRVLINEETIVLSGDLVATEAKGQPILPSKFTPTTPAVAKETPLAAVGTPILGAISTSRKRFSFSNERRLSINSMDGDDEEAILDQPLEQRLMSSRPPKELSAPSVLINLIRTKNPFLRRNILSVNQFKRSDFHALFAVAQELRAGVEREGVLDVMKSRVLTTMFYEPSTRTSSSFIAAMERLGGRTVNINTSASSVKKGETLQDTIRTLACYSDAIVLRHPDEMSAHIAAKYSPVPIINGGNGSREHPTQAFLDLFTIREELGTVNGITVTFMGDLKFGRPVHSLCRLLQHYQVRINLIAPKELRLPNALRKELQDSGLLGIESETLTPEIISKSDVLYCTRVQQERFETEEDYLKLKDTYIVDNKILSHAKQQMVVMHPLPRVNEIREEVDYDHRAAYFRQMRYGLFVRMALLAMVMGVEL

SEQ ID NO: 47811 - protein, 492 aa, Pseudomonas putida
MSGKFIEKHGIWSDTQKAAAADVLNKIEKAGLQMVRLSWPDQYGLLRGKMLSVAALRSAFASGSEITMAPFFFDTASAIVFNPFSADGGLGSAELAGSPNVVMVPDPTTFRILPWADRTGWMLADLYMTSGRPFALSPRAILKKALVEMQDLGYDYQAGLEVEWYLTRIVDPCLEPETLGGPGTPAAPPKVMPVAKGYSYLLENHLDEVEPIMAEVRQHLLALGMPLRSIEDEWAPSQMETTFDVMPGLDVADTMVLFRNAVKQVCRRRGYLASFMCKPAIQGFLASGWHLHQSLTARDSGANAFIPQPGEALSALGRSYVGGLLEHACAASSFTTPTINGYRRRRPYSLAPDRVTWAKDNRAAMARVISAPGDPASRVENRIGEPAANPYLYLASQVFSGIDGIRRQLDPGPLQETPYAGDVTILPHNLSEALEVLETSKFFREAFGEEFIRYWMHLRRSEWKRFVDAEGQVDFSGDPVTNWEHREYFELF

SEQ ID NO: 47812 - protein, 365 aa, Glycine max
MGSISQPQLLPFPLLMNGNYTASTIPWRLPSDDPSIPTPIELSWLNLFLNTIPTFKKHAESDTSVPDAANKAEEFAQRWFARIIEDFKKDPASQGVPLDVLLPCRLREQVLKELGFRDIFKKIKDVENANAISLFENVVHLNDAIEDEGKRLENLVRGIFAGNIFDLGASQLAEVFSRDGMSFSVTCQNLVPRPWVIDDLETFKMKWSKKSWKKVIIFVDNSGADIILGILPFARELLRHGSQVILAANDLPSLNDVTYAELLEIISKLKDEEGCLMGVSTSNLIIANSGNDLPVIDLTRVSQELAYLANDADLVILEGMGRGIETNLYAQFKCDSLKIAMVKHPEVAEFLGSRLYDCVIKYDEV

SEQ ID NO: 47813 - protein, 155 aa, Arachis hypogaea
MHLEAETWTALVVILCFLGLILKESIMGGKSSRESGGDRRHVPSYGSGGASSSSWDNYGYSQPPPYAYQPSIQHRPPAAPYYDYQQPKRRLDRRYSKIADNYRSLDEVTAALSQAGLESSNLIVGIDFTKSNEWTGKRSFNRKSLHHLRNGHNPL

SEQ ID NO: 47814 - protein, 267 aa, Legionella pneumophila subsp. pneumophila str. Philadelphia 1
MIMLKQIVLTGLVIIGIVITLMYLFQRHLIYFPNRHTPKLEDYNASDMKVVSLRTKDNLHLKSWYKPASKHRPTILYLHGNAGHIGYRMPLVREFIDAGLGVFLLEYRGYGGNPGKPGEKGLYEDGETAIEFLIQHGVPSKRVILYGESIGTGVATHLATKYPVCAVILQSPFTSLTRLAQYHYPLNFLKPWDQYNSLARMKKINAPILVLHGKLDQIVPYQEGLNVFNEANEPKKMVSFDDKEHNDLWSADNFSREIIQFALNQCS

SEQ ID NO: 47815 - protein, 228 aa, Streptomyces steffisburgensis
MAVQINPSILSADFARLADEAKAVEGADWLHVDVMDNHFVPNLTLGVPVVESLARATDTPLDCHLMIEAPDRWAPQYVEAGAGSVTFHVEAAAAPVRLAREIRAKGARASMALKPATPIEPYEDLLPELDMLLIMTVEPGFGGQAFLDIMLPKIRRTRELISKHGLELWLQVDGGVSASTIERCADAGADVFVAGSAVYGANDPAEAVRALRTQAEAITAKASWACDH

SEQ ID NO: 47816 - protein, 521 aa, Triticum aestivum
  misc_feature (344)..(344): Xaa can be any naturally occurring amino acid
MEMELNLVSYVSIALFVLSGAYVYHATRSRSPRQRLPPAPPGWPVIGHLHLLTDMPHHALAELAKTMRAPLLRLRLGSVPALVISKPDLARAALTSNDAAMASRPHLLSGQFLSFGCSDVTFAPAGPYHRMARRVVVSELLSARRVATYGSVRGKELRRLLAHLTKNTKPGTPVDLSECFLNLANDVLCRVAFGRRFPHGKDDKLAAVLAEAQDLFAGFTIGDFFPELEPFASTVTGLRRRLKSCLADLREVCDDIVEEHVSGKHQRLPGDRDEDFVDVLLRVQKSPDLEVPLTDDNLKALVLDMFVAGTDTTFATLEWVMTELVRHPRILQKAQEEVRRVVGXRARVEESDLAELHYMRAIIKETFRLHPAVPLLVPRETVAACTLGGYDIPAKTRVFINTFAMGRDPEIWEEPLEYSPERFEVAGAGGEIDLKDPDYKLLPFGGGRRGCPGYTFALATVQVSLASLLYHFEWALPAGVRAEDVSVEETFGLATRKKEPLFVAVSKSDVYQFKGEELNEV

SEQ ID NO: 47817 - protein, 293 aa, Bacillus cereus ATCC 10987
MKKVRKAIIPAAGLGTRFLPVTKAMPKEMLPIVDKPTIQYIVEEAIESGIEDIIIVTGKGKRAIEDHFDHSFELEQNLLEKGKYEMLEKVQASSKINIHYIRQKEPKGLGHAVWCARKFIGNEPFAVLLGDDIVQAETPCLRQLMDQYEETQSSVIGVQTVPENETHRYGIIDPIEKNERRYQVRQFVEKPAEGTAPSNLAIMGRYVLTPEIFMFLEDQQTGAGGEIQLTDAIQRLNEIQRVFAYDFEGIRYDVGEKFGFIKTTIEMALQNEELNVELMKYMKELVKKEEAHS

SEQ ID NO: 47818 - protein, 259 aa, Rickettsia akari str. Hartford
MNNNLIAALKDLIINTGKVALDIKKAGILTDIKSDGSVVTNADKEISKIIYQTLRSLTSQIAIVCEEQPLPILSSDTFWLIDPIDGTRSYVDGKSTYTVNIGLIENGFPTIGLIYHPETAKLYYTDVNGRLKIEQNSKEIFVNHEPKHEELNAVIGFYNSNKATKEFLSKYSFGQINEIGSSIKLCLIAEGAADIYPQFSQTMEWDIAAGHALIKAGGGNILDTHGQEITYGKENFANPNFFACGKYWLEKYPACNTLA

SEQ ID NO: 47819 - protein, 2126 aa, Candida albicans SC5314
MSPSASYLPQEEFSTTNVYDYDEVPENKSWASSLPVAKGLYNPELEKDACGVGFTCHLKGVPSHKIVSDAKSLLCNMTHRGGELNPQDGDGAGLLSSIPHKFLKREFQYYCNVELPAKGQYGVGNVFFKKDDAVFEKSKKTFESIADSLGLKVLGWREVPHDSSILGAAALSREPYILQPAVVYKEIWGQKVSDDEFDSKYRKDFEKRLFILRKQASHTIGLHNWFYICSLSNKTIVYKGQLAPKQVYSYYHDLVNAEYESHFALVHSRFSTNTFPSWDRAQPLRLAAHNGEINTLRGNKNWMRAKEGVMKSKLFGDEMDKLFPIIEEGGSDSAAFDNVLELLVINGVVSLPEAVMMMIPEAWQNDENIDPKKKAFYEWAACLMEPWDGPALFTFADDRYCGANLDRNGLRPCRYYVIDDDRMICASEVGVIEIQPEKVIQKGRLQPGRMLLVDTKEGRIVDDRELKSKVASRYDFKSWVLANMISLQDLNEKLASRKIDINAKPIDVNVNVQSDPRLIAAGYSHEQILFVLAPMAEGNEALGSMGNDNALACISEQPKLLYEYFRQLFAQVTNPPIDPIREKIVMSLECYVGPQGNLLEMKPDQLNRLLLKSPILTSSELLAIKNIQTVYPSWSVANIDITFEKSEGIQGYINTIDRICQAASQAIADDNQIIILSDVATSAERLPISALIAVGAVHHHLVRQKQRSKVALIIETQEAKEVHHACCLVGYGADAINPYLAMETLVRMKHQGLLKNESLTEEKIIQNYKGSIDAGILKVMSKMGISTLASYKGAQIFEALGIDNSVIDRCFAGTASRIKGVTFEYIAQDAFTLHERGYPTRDTIKPIGLPETGEYHWRDGGDAHINDPAAIASLQDAVRNKNERAYEAYAKKENEAVRNCTLRGLLDFEFESSTEVPIDQVEPWTEIVRRFFTGAMSYGSISMESHSTLAVAMNRLGGKSNTGEGGEDAARSQVLENGDTMRSAIKQVASGRFGVTSYYLADADELQIKMAQGAKPGEGGELPGHKVSAEIGKTRHSTPGVGLISPPPHHDIYSIEDLKQLLYDLKCANPRARTSVKLVSEVGVGIVAAGVAKAGSENILVSGGDGGTGAAKLTSIKYAGLPWELGLAESHQTLVLNDLRGRVILQTDGQIRTGRDIAIACLLGAEEWGFATSPLIAMGCIYMRKCHLGTCPVGIATQDPELRKKFEGTPEHVINFFYYLANDLRKFMAKLGFRTINEMVGRTEKLKVRDDLRNTKNANIDLSPILTPAHTIRPGVATHCVRKQDHKLHIRVDNKLIDESELTLAKGLPVTIDCEVVNTDRSLGTTLSYRVSKTFGEQGLPHDTIHVNVTGSAGQSFGAFLASGVTLELEGDANDYIGKGLSGGRIIVYPPRESKFKAEDQIIAGNTAFFGATSGSAFIRGIAAERFAVRNSGAIIVTEGTGDHGCEYMSGGRVVVLGATGRNFASGMCGGIAYVLDMAQDFSEKVNRAQVELSQVTETEEIAFLRNLIEDHRHYTGSEVADNILNDFNRYLPRFVKVLPNDYKKVLEKEKKLAEEAKKKELSSFLKSIKEDPESDVTNGEAYKIKKGHVHHPNKGKNEPKVADVEDTIFNTEFEKKAPVKLDKLRGFMKYKRRNEKYRDAKARTKDWNEMTSRLTKEELKYETARCMDCGVPFCTSDTGCPISNVIPKWNELVFNDRWYDALQRLMMTNNFPEFTGRICPAPCNGACVLGINEDPVNIKSVECAIIDHGFEQGWIKPTPPAHRTGKTVAVIGSGPAGLAAADQLNKAGHLVTVYERSDRPGGLLMYGIPNMKLDKGIVKRRTDLLAAEGIEFICNTTVGEDITVSELKSQFDAVVFAVGSTIPRDLRIPGRELKNINFAMQLLHSNTKALLDDQLEDIRKNLAGKNVVVIGGGDTGNDCLGTSTRHGAKSVTNFELLPNPPNARPKDNPWPQWPRIFRVDYGHTEVATHYGKDPREYSILSKEFVGDEEGNVKGIKTVRVEWKRSDSGAWQMAEVPGSEEFFPAEVVLLSMGFLGPEADNLEVQKTKRGTITTVDPNVYKVDKDDNVFAAGDCRRGQSLVVWGIQEGRQCAREVDEYLMGSTRLPGNGSVEQRNYKLLEELAEKV

SEQ ID NO: 47820 - protein, 506 aa, Yersinia pseudotuberculosis IP 32953
MRYAHPGTPEALVSFKATYGNYIGGEFVEPLGGQYFMNTSPVNGSDIAQFPRSDARDIDAALDAAHRAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDLFPAGVLNVVQGYGREAGEALASSKRIAKIAFTGSTPVGRHIMACAAENIIPCTVELGGKSPNIYFADVMEAEPEFIEKAVEGLVLGFFNQGEVCTCPSRALIHESIYAPFMARVMAKVANIRRGDPLDTETMIGAQASRQQFDKILSYIDIARKEGGEILTGGARATMTPALDAGFYIQPTLIKGDNLMRCFQEEIFGPVIGVTTFKDEAEALAIANQTQFGLGAGIWTRDTHLAYRMGRGIKAGRVWTNCYHVYPAHAAFGGYKQSGVGRETHKMALNQYQQTKNLLVSYDTAPLGLF

SEQ ID NO: 47821 - protein, 306 aa, Pseudomonas fluorescens Pf-5
MSQNMQDLLNQILDEVRPLIGQGQVANYIPALADVPANQLGIAVYGNDGQVFSAGDADTPFSVQSISKVFSLVQAIGHSGEAIWERLGHEPSGQPFNSLVQLEFERGRPRNPFINAGALVICDINQSRFAAPALSMRDFVRRLSGNLQVMVDGRVAESEYQHRARNAAMAYLMQSFGNFHNDVEAVLRSYFSHCALRMSCVDLARAFCFLANDGFCKHSGEQILTRRQTQQVNSIMATSGLYDEAGNFAYRVGLPGKSGVGGGIVAVVPGQFTVCVWSPELNSAGNSLVGMAALELLSQRIGWSVF

SEQ ID NO: 47822 - protein, 455 aa, Sulfolobus tokodaii str. 7
MKYDVTVIGAGGGGYPGAFRLAKSGYNVLMADPKGELGGNCLYSGCVPSKTVREMAQLIWRTSRVLKQEIKVNFERIQAHKDFVQETRFKQHKRELSEYNSITFYKGVIKIKDPNHVIVKTEDKEIEAETRYIIIASGSEPFKPQFPGSEYCITSDDLYSYKTPLRKLPQDMVIIGGGYIAIETASIFNILGVKTHLLVRGDRVLRGFEDEIVNTLLPILKLDIIYNAPVLEIKKIKEDEFEVIYSSKDGAKKSIRTNLVLLATGRKPVLPEGIENTGIALDKRGYIVVDNAMRTNLPNVFATGDVNGKAPYFHAAVRMSIAAAYNIMANGSPIDYVDYKSIPVTIYSVPSASYVGIMPSEAKRMGIEIMEATYNMEDEVMAQMYDEREGMLKLIFEKGSLRLIGAWMVGVHSQYLINELGQAVLHGLTAKQLASFADQHPSTNEIIAYAARKVL

SEQ ID NO: 47823 - protein, 508 aa, Zea mays
MQPPTTLLPLGAVVVAILLLATAPSPAVSRHRHSSAADTETLDVAASLSRARAALSTDAVSLHQSAAAAAAGAKRSPRAREGGLTLRLHSRDFLPEEQGRHETYRSLVLSRLRRDSARAAAVSARATLAADGVTRLDLRPANGSAVFAASAAIQGPVVSGVGQGSGEYFSRVGIGSPARQLYMVLDTGSDVTWVQCQPCADCYQQSDPVFDPSLSASYAAVSCDSQRCRDLDTAACRNATGACLYEVAYGDGSYTVGDFATETLTLGDSTPVGNVAIGCGHDNEGLFVGAAGLLALGGGPLSFPSQISASTFSYCLVDRDSPAASTLQFGDGAAEAGTVTAPLVRSPRTSTFYYVALSGISVGGQPLSIPASAFAMDATSGSGGVIVDSGTAVTRLQSAAYAALRDAFVQGAPSLPRTSGVSLFDTCYDLSDRTSVEVPAVSLRFEGGGALRLPAKNYLIPVDGAGTYCLAFAPTNAAVSIIGNVQQQGTRVSFDTARGAVGFTPNKC

SEQ ID NO: 47824 - protein, 165 aa, Oryza sativa Japonica Group
MGPNGNRRSTLLGLDDKLREKSKRISRSDSHRFNQLLEGIDGVQQAQHTTASLDTCEHSPPLLAPPGRVVAGDLHRASRAGERIMVAFCSPKSRNMVNAIKGLFISCDVPMAQFIVNLNASMPASDKFILHMLDPTHMFVQPHVAEMIRGKISEFRDQNSYEKPT

SEQ ID NO: 47825 - protein, 294 aa, Streptomyces coelicolor A3(2)
MANVVDLICYPVKGCAGASTSDALLTPAGLAHDRSFMVISENGIFRTQRRHPRLALIRPAIGTDGTRLTLDAAHGADGTGRFGTLCLDVTTSAPRRDVDLFGTAFQGIDQGDEAAAWLSEFLGAPSRLVRVPPEHNRITDGLTPGPSGYADSSAVHLLSRASLALLNQRLAERGAAILPMNRFRPNIVVDSHEDHDHDSGGDPAALPHAEDRARRISLGGTELGYAKLAVRCAVTLVEQETGARRGPEPLRTLAAYRRAASGGVVFGAKFSVITPGKLSVGDEVVIQEWGDADL

SEQ ID NO: 47826 - protein, 121 aa, Triticum aestivum
  misc_feature (46)..(46): Xaa can be any naturally occurring amino acid
  misc_feature (61)..(61): Xaa can be any naturally occurring amino acid
  misc_feature (106)..(106): Xaa can be any naturally occurring amino acid
MAVTITWVKARQIFDSRGNPTVEVDVGLSDGSYARGAVPSGASTGXYMRLGSLRDGGSDYXGKGVLKGCQAMLNTIIGPSIGWERPTEQFELTLQWPTLDGTSNGXGWCKQNLGANASLRS

SEQ ID NO: 47827 - protein, 451 aa, Oryza sativa
MAEPEFEQAYKELASTLESSTLFEKNPEYRKALEVVSVPERVIQFRVVWEDDSGKCQVNKGYRVQFNSALGPYKGGLRLHPTVNLSILKFLGFEQIFKNALTGLNMGGGKGGADFDPKGKSDNEIRKFCVAFMTELSKHIGADTDVPAGDINVGGREIGYMFGQYRRLRNQWEGVLTGKGLNWGGSLIRPEATGYGLVYYVDHMINYASGGKESFKGKKVAISGSGNVAQYAALKVIELGGTVVSLSDSKGSLIATEGKGFTPEDISQIAALKLKRQALTALEGHSYNYIEGARPWKHVGNVDVALPSATQNEVSQDEAEALIAAGCKFIAEGSNMGCTQEAIDAFENHRKSNKGSSIWYAPGKAANAGGVAVSGLEMAQNSQRLSWTNEEVDAKLAKIMKDCFENCLATAKEYITPAEGEFPSLVAGANVAGFKKVAAAMHDQGDWWGTA

SEQ ID NO: 47828 - protein, 395 aa, unidentified eubacterium SCB49
MKTVNDFNFKGKKALIRVDFNVPLNENFEVTDATRIEAAKPTIYKILEDGGSCILMSHLGRPKNKEEEFSLKNIVKKASEILGVTIKFSEDCVGETAETAAASLGEGEILLLENLRYHAEETEGNRDFAQALSTLGDVYVNDAFGTAHRAHASTSIIAEFFPDNKCLGLLLSSEIENVNKVLSDSKKPVTAVIGGAKVSSKITVLENILDKIDHLIIGGGMAFTFIKAQGGKIGGSLVEDDKQNLALEILEKAKQKGVEVHLPIDALIADSFSVHASTEIASSSDIPEGWMGLDCGDATNRIFEEVLLKSQTILWNGPVGVFEMEPFAKGTIHLGNAIAEATKNGAFSLVGGGDSVAAVKQFNLSKKVSYVSTGGGAMLEMLEGKTLPGIKAMQD

SEQ ID NO: 47829 - protein, 520 aa, Glycine max
  misc_feature (487)..(487): Xaa can be any naturally occurring amino acid
MASACVTLKSNTHLANSEKGFLGERIKGGFNNSALVMNQLAIRSRSHKRVKHGVGVVSAVLTSNNAKESLTLQVPSFLRRRADPKNVISIILGGGPGTQLFPLTKRAATPAVPVGGCYRLIDIPMSNCLNSGINKIFVLTQFNSASLNRHIARTYFGNGINFGDGIVEVLAATQTPGEAGKNWFQGTADAVRQFTWVFENTNVENVLILAGDHLYRMDYMDLVQSHVDRNADITVSCAAVGDSRASDYGLVKVDDRGRIIQFSEKPNGDDLKAMQADTSLLGLSPQDALKSPYIASMGVYVFKTDVLLNLLKWRYPTSNDFGSEIIPAAVRDHDVQSYFFEDYWEDIGTIKSFYDANLALTEESHKFEFYDPKIPIYTSPGFLPPTKIDKCQIVDAIISHGCFLRECTVQHSIVGERSRLDYGVELLDTVMMGADYYQTESEIASLLAEGKVPIGIGRNTKIRNCIIDKNAKIGKDVIIANKDLSLXGVQEADRPEDGFYIRSGITIIMEKATIEDGTIV

SEQ ID NO: 47830 - protein, 329 aa, Bacillus licheniformis ATCC 14580
MAILVCGGAGYIGSHAVAELLSRNEDVVIIDNLQTGHEEAALKGASFYNGDLRDEAFLRKVFQENDIEAVMHFAADSLVGESVTDPLKYYDNNVYGAVCLLKVMKEFDVKQIVFSSTAATYGEPDRVPIMETDPTDPTNPYGETKLAIEKMLKWSEKAYGIRHVVLRYFNVAGAHVDGLIGEDHQPETHLIPIILQVALGKRDKIMIFGDDYPTPDGTCIRDYIHVMDLVDAHILAVERLRNGGESAVYNLGNGTGFSVKEVVETARKVTGCPIPAEVAERRAGDPAQLIASSEKAVKELGWQPKYAELETIIDSAWKWFKAHPNGYQS

SEQ ID NO: 47831 - protein, 464 aa, Vibrio fischeri ES114
MPLHSKNAVRDDLLDDIYSSADLSLSMPKYKMPEQEHDPRHAYQVIHDELMMDGNSRQNLATFCQTWVEDEVHKLMDECIDKNMIDKDEYPQTAELESRCVHMLADLWNSPDAENTLGCSTTGSSEAAMLGGMALKWAWREKMKKLGKPTDKPNMICGPVQVCWHKFARYWDIELREIPMEGDRLIMTPEEVIKRCDENTIGVVPTLGVTFTCQYEPVKAVHEALDKLQEETGLDIPMHIDAASGGFLAPFCDPDLEWDFRLPRVKSINASGHKFGLSPLGVGWVIWRDASALHEDLIFNVNYLGGNMPTFALNFSRPGGQIVAQYYNFLRLGKEGYRKIHQACYDTAVYLSSEIEKLGMFEIIYDGKGGIPAMSWSLKEGVDPGFNLFDLSDRIRSRGWQIAAYAMPPKREDLVIMRILVRHGFSRDQADLLVADLKHCVEFFAKHPISHGSDELESSGFNHG

SEQ ID NO: 47832 - protein, 309 aa, Erythrobacter sp. SD-21
MGDATPFEQTLARVSDRSRFAPSIVVAGKDHCELVERQGGHHSLIVEPVGRNTAPAIALAALTLPPETVMLVCPSDHHIANESAFRAGVERAAKLARKGWLVCLAVEPERPETGYGYIERGAREEAGHLIARFVEKPDCATAQSYVASGKFVWNTGIFVFRAADFLAELALQRPQMMDLIERAHQNGLADGTTFLAACQPFAQINPESVDYAVMEHTKRGAMVSADMGWSDIGNWDALMTLAEGDTHGNVVEGRADLVDCSGVLVRSEGLRVSALGLKDVVIVVSHGELLVTTREHSQNIGELPGAQER

SEQ ID NO: 47833 - protein, 475 aa, Exiguobacterium sibiricum 255-15
MKSYQLVVIGGGAAGMTIAAGAASLGAHVALIEKHTHLGGDCLHYGCVPSKALIEAAHDVHVMKQTAAKYNVTLNGEAVYSKTKASVDRARNIIQSHDGTKRFKDLGVDVYIGEASFLSANEVEVAGQLVVGEKFAISTGSQPIIPPIEGLDTIPYLTNETIFEQTERPERLLVIGGGAIGLELSQAYAHLGTEVTVIEGAKSLMPKEDRSMVEVLQRQIEQELTLHLDTTVTSVRKAAKGIEVTVKTGEESRVIETDAVLVAVGRKPRIDALRLDRAGVHVEKGYVQVDGSLRTNQRHIFAVGDTIQSLPFTHVAGLEGKTVVTNALFGLRTKPDYRAVPWVTFTTPELFHLGLTEEEARQKYSDIKVYETGLDEVDRFVINGRTEGHVKLIADKRGKLIGAHAIGEQAGEWMQEVVYAMARKDKVGQLSRVVHPYPIRGAAVQRAADLYWRERLFDGPLPKWLKRYFDWKQGE

SEQ ID NO: 47834 - protein, 281 aa, Zea mays
MYAAAPSSSRVAAAAAAFFIVISLSPQLLVRPFGASTTVHWAAAQELDEEDFSYRRNAGNGPARWGLIRREWATCNVGLLQSPIGLSDTLAGLADRSGRLGRSYRPAAASLVNRGHSIMVRFNSNPGGVVIDGVAYRLRQMHWHAPSEHAINGRRYALELQMVHQSDTNRYAVVSQLYRISRRRPDRTIHRLERYIRRIARRKNHEELIDEEVDPRRPVSRSTAYYKYTGSFTTPPCTEGVTWVVAHQGTRSNRRPLQEANGRAIPFFYTSPAHGRGANGD

SEQ ID NO: 47835 - protein, 363 aa, Hypocrea jecorina
MATQTINKDAISNLSFVLNKPGDVTFEERPKPTITDPNDVLVAVNYTGICGSDVHYWVHGAIGHFVVKDPMVLGHESAGTVVEVGPAVKSLKPGDRVALEPGYPCRRCSFCRAGKYNLCPDMVFAATPPYHGTLTGLWAAPADFCYKLPDGVSLQEGALIEPLAVAVHIVKQARVQPGQSVVVMGAGPVGLLCAAVAKAYGASTIVSVDIVQSKLDFARGFCSTHTYVSQRISAEDNAKAIKELAGLPGGADVVIDASGAEPSIQTSIHVVRMGGTYVQGGMGKSDITFPIMAMCLKEVTVRGSFRYGAGDYELAVELVRTGRVDVKKLITGTVSFKQAEEAFQKVKSGEAIKILIAGPNEKV

SEQ ID NO: 47836 - protein, 464 aa, Burkholderia sp. 383
MSTAALVEGKIVQCIGAVIDVEFPRDSMPKIYDALILDGSELTLEVQQQLGDGVVRTICLGASDGLRRGLTVKNTAKPISVPVGKPTLGRIMDVLGRPIDEAGPIESETTRSIHQKAPAFDELSPSTELLETGIKVIDLICPFAKGGKVGLFGGAGVGKTVNMMELINNIAKEHGGYSVFAGVGERTREGNDFYHEMKDSNVLDKVALVYGQMNEPPGNRLRVALTGLTMAEHFRDEGLDVLFFVDNIYRFTLAGTEVSALLGRMPSAVGYQPTLAEEMGKLQERITSTKKGSITSVQAVYVPADDLTDPSPATTFGHLDATVVLSRDIASLGIYPAVDPLDSTSRQIDPNVIGEEHYSITRRVQQTLQRYKELRDIIAILGMDELSPEDKLSVARARKIQRFLSQPFHVAEVFTGSPGKYVPLKETIRGFKMIVDGECDHLPEQAFYMVGTIDEAFEKAKKIS

SEQ ID NO: 47837 - protein, 126 aa, Oryza sativa
MSEINPKAFPLADEELNKSILDLVQQALNYKQLKKGANEATKALNRGKAELILMAADTEPIEILMHLPLLCEDKNVPYVFVRSKQGLGRACGVSRPVIACSITQNEGSQLKNQIDALKVNIEKLLV

SEQ ID NO: 47838 - protein, 578 aa, Cryptococcus neoformans var. neoformans B-3501A
MEQPAGYRTPRPQKHSVYDPTQPRSKNQVLISHGRAPWYGPDGRNIEAYVVGIAGGSASGKTSVARAILSALNYIPTVLILSQDSFYNAHSPEEVELAFKNDLDLDHPDAIDMTLFAQCIKDLKQGKATEIPVYSFHHHQRMSEKKYIYGASVIIVEGIMALQSAELRELYDLKVFVNCDSDLMLARRIKRDVKERGRDVEGILDQYLRFVKSSYDTFVQPSSRYADIIVPGSSNQLAIELLVSHIKRQLESRSLRFRRVLADIGENRGSSTPSVEKFDKQIVLLEQSNQLRGIMTILRDRTTCREEFIFHIDRLSTIIVEKALTLIPCEPKVVKTPNKNVYKGVSQTKNLVGVSILRSGLPFSQGLRRVIRDVPIGGILIQSDPKTGEPLLLKSDLPHCLRSRKTNGDVRCLLLDSQMGTGAAAMMAIRVLLDHGISQNRIIFLTYLISRSASYSVLRAFPNIQIVTAAIDPGLDEVKISYMPGSLIIGEAAGEGDFAIRLVDQLGHEEDGKRDNVKDLLKTDEELAADGFKMNILKGTEELKFSRKHKRTYSSTGEKRAWVISPGMGHVGDRYYLV

SEQ ID NO: 47839 - protein, 401 aa, Cucumis melo
MDYVYGPGRNHLFVPGPVNIPEQVLRAMNRNNEDYRSPAVPALTKTLLEDVKKIFKTTSGTPFLFPTTGTGAWESALTNTLSPGDRIVSFLIGQFSLLWIDQQQRLNFKVDVIESEWGEGAKLDVLAAKLAADTDHTIKAVCIVHNETATGVTNDLSLVRRILHEYRHPALFLVDGVSSICALDFRMDDWGVDVALTGSQKALSLPTGIGIVCASPRALEASKTAKSLRVFFDWKDYLKFYNLGTYWPYTPSIQLLYGLRPALDLVFEEGLENVIARHKRLGQATRLAVEAWGLKNCTQKEEWHSDTVTAVVVPPYIDSAEIVRRAWKRYNLSLGLGLNKVAGKVFRIGHLGNLNELQLLGCLAGVEMILKDVGYPVKLGSGVAAASSYLQNNIPLIPSRI

SEQ ID NO: 47840 - protein, 463 aa, Rickettsia akari str. Hartford
MSFLRKKSFESVKEIGSSSGLSKTLGALDLILLGLGAMIGTGVFVVTGIIAAKYSGPAVMLSYAIAGITCIFVALVYTELAAMLPTSGSIYTYSYVAFGEVFAWMIGSVIILELGVAAGIVAAGWSGYVQGILAAGGINLPKELTTVPTNGGIINLPAFLISVFIGFILYLGTKDSKRLNAILVFIKMVAIFVFILAAAPHFDVTNWSNFMPFGFSNVLVGASILFLAFTGFGTIATAAEECKNPKRDIMIGIIGSLVLTTIVYVTMAGLVTGIAHFDQLNNDQPLAYALTINNSKIGSAIVATGAVCGMMTVLMMNIYGTSRIFYAIARDGLLPKSFAKLHPKYDSPYITIIIFASLSAILGGFCSTELLTQFTSMGALIDYITVTIIVVLFRVKLPDAQRPFKCPLVFIIVPFILIACAYLLFIQIYDGEFNILMAGRALIYWFITIFILYIIRSFFMTKE

SEQ ID NO: 47841 - protein, 659 aa, Physcomitrella patens subsp. patens
MSDFRRQNPKSFSNVGQVDDWLKFASSFGVGSEFEGACAYANSYLTLRTFLVGNELTIADITVVAYLAGAGPRWESFRKSSKFPNLVRWYNCILAQYAAIADVLPRRGSGKPAAEVSKPSSTAAAPDEAKEKVDGSFEVDLPGAEMGKVCTRFPPEPSGYLHIGHAKAALLNQFFAQKYKGRLIIRFDDTNPAKEKDEFVESILHDLETLGVKGDVITYTSDYFPQLMEMCEKLIKEGKAYVDDTEREQMQTERKAMIESKCRNQSVEENLILWKEMIAGSPRGVQCCVRAKMDMSNPNASLRDPVYYRCNPAPHLRVGSKYKVYPTYDFACPYVDSIEGVTHALRSSEYHDRNDQYYRVLEDMQLRKVHVWDFSRLNFVYTLLSKRKLQWFVDNGRVEGWNDPRFPTVQGIIRRGLTIEALKQFILSQGASKNLNLMEWDKLWTINKKIIDPICPRHTAVLSEGKVLLDLSNGPETPFTRVILRHKKYEPAGKKASVFTKRIWLDHADATAVSEGEEVTLMDWGNCFIRKVERDQYGLVTRLQGELHVEGSVKTTKLKLTWLPEFSELVPVTLVDLDHLIVKKKLEENDDFVSVLNPVTRIETSALGDSNMRNLQRGEIIQLERKGYYICDVPFLRSSKPIVLISIPDGRQQKPPGPQ

SEQ ID NO: 47842 - protein, 499 aa, Pisum sativum
MDTLTLSLGFLSLFLFLFLLKRSTHKHSKLSHVPVVPGLPVIGNLLQLKEKKPHKTFTKMAQKYGPIFSIKAGSSKIIVLNTAHLAKEAMVTRYSSISKRKLSTALTILTSDKCMVAMSDYNDFHKMVKKHILASVLGANAQKRLRFHREVMMENMSSKFNEHVKTLSDSAVDFRKIFVSELFGLALKQALGSDIESIYVEGLTATLSREDLYNTLVVDFMEGAIEVDWRDFFPYLKWIPNKSFEKKIRRVDRQRKIIMKALINEQKKRLTSGKELDCYYDYLVSEAKEVTEEQMIMLLWEPIIETSDTTLVTTEWAMYELAKDKNRQDRLYEELLNVCGHEKVTDEELSKLPYLGAVFHETLRKHSPVPIVPLRYVDEDTELGGYHIPAGSEIAINIYGCNMDSNLWENPDQWIPERFLDEKYAQADLYKTMAFGGGKRVCAGSLQAMLIACTAIGRLVQEFEWELGHGEEENVDTMGLTTHRLHPLQVKLKPRNRIY

SEQ ID NO: 47843 - protein, 525 aa, Pseudomonas syringae pv. phaseolicola 1448A
MALDIHAHRILILDFGSQYTQLIARRVREIGVYCELHPFDMDDEAIREFAPKGVILAGGPESVHEANSPRCPQAVFDLGVPVFGICYGMQTMAEQLGGKVAGSELREFGYARVDVVGKSRLLDGIEDHIDADGLFGLDVWMSHGDKVTKLPEDFHILASTPSCPIAGMADDARGYYGVQFHPEVTHTKQGGRILSRFILDICGCEALWTPSKIAEDAIAQVRAQVGTDNVLLGLSGGVDSSVVAALLHKAIGDQLTCVFVDNGLLRLHEGEQVMAMFAENMGVKVIRANAEEQFLNNLEGESDPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 47844 - protein, 170 aa, Streptomyces coelicolor A3(2)
MGSESSGTAELPPLPQVGIGTDIHAFEDGRELWCAGLKWEGEGTGLAGHSDADVVAHAACNALFSAAGAGDLGQHFGTGRPEWSGASGVTLLAEAARIVRARGFRIGNVAVQVVGARPKIGKRRDEAEAVLSAAVGAPVSVSGATTDGLGFPGRGEGLMAVATALVVRGA

SEQ ID NO: 47845 - protein, 567 aa, Oryza sativa Japonica Group
MASKAVPDVVTDKKCDKTMAASSEMSQSQEVISRGGKLGTASSRETLLGDVATSSGVKEQDKDSCSVDESVKLDGNEDAEKSSLRGSVKDSSASAKGSDRASSLTKVSGSTKVSDHAADIVGSSKSSVYRASAGSDVSDESTCSSICSSASKPHKSNDSRWEAIQMVRTKEGSLGLGHFRLLKRLGCGDIGSVYLSELSGTKCYFAMKIMDKASLASRKKLLRAQTEREILQCLDHPFLPTLYTHFETDKFSCLVMEFCPGGDLHTLRQKQPGKFFPEQAAKFYVAEVLLALEYLHMLGIIYRDLKPENVLVREDGHIMLSDFDLSLRCAVSPTLLKSSNPGVDPNQKGNPSYCVQPVCIEPACIQPSCVTTTTCFAPRFFSSKSKKEKKAKTDIASQVRPLPELVAEPTDARSMSFVGTHEYLAPEIIKGEGHGSAVDWWTFGIFLYELLFGKTPFKGSGNRATLFNVVGQSLRFPESPVVSFAAKDLIRGLLIKEPQHRLAYKRGATEIKQHPFFEGVNWALIRCATPPDIPKPVEIPRSVASTSQKATTTAEKGSDNYLEFDFF

SEQ ID NO: 47846 - protein, 345 aa, Triticum aestivum
MPTITHYVLDPFLETGSLPNLQKLVPKPPPAAPLPPEKSSEKPIPVPVAPARTSTLPALYSTPESTPLPDSPSSFPGTWSPYLINHKRRGPGLIKTSSQGDVGSEGSLPKFPEGLPALPKRSEAFQVQESEFRFSQESDGVVNNGVKETLDGGVQKGKVTLFGQDEQDQPEFEFRHESPDALVRPVNVGRLVNNGMPRDGENDAFLEPQDSQSVTSNSEAEDAGGQGWWKPSSPYGTSAGTPGAEFYDAFEEISSDGATRSSRCIDDEYREMRLSMLTEIEGRKQAEEVAETWQKEWKKLSHHLSLIALSLPSPTVAENDDDTSADPGAELCQQITVSQLVAAAI

SEQ ID NO: 47847 - protein, 259 aa, Rhodospirillum rubrum ATCC 11170
MVMQRAFSHAAMAVAFGLVGFSGAPAVAAETAHPPHWAYEGKGGPVDWGALSEDYHACAAGKEQSPVDIRDAIPAKLPAIAPAYQAQSAVVVNNGHTLQVNVSPGSSLDFRGQRYELLQYHFHHPSEHLVNGKAAPLELHLVHKGPTALTVIGVMLVPGAANPAIEAIWKVAPAKEGGEATLGDPGPDLGKLLPESKSYTFYEGSLTTPPCSEVVNWINLKTPVTVSEDQIARFAALFPMNARPPQALHRRIILESQDQ

SEQ ID NO: 47848 - protein, 554 aa, Oryza sativa
  misc_feature (157)..(157): Xaa can be any naturally occurring amino acid
MAASCLTLLHNKYSCLFGCFSSYPCIITLLSQYCWLPLLFPKLPWNFELFKMPRRTDNAASANSVEPEKSEECLEFDDDEEEEVEEEEIEYEEIEEEIEEEEVEEDEDVVEEVEEVDEEEDEEEEEESDETEGVSKTKGVHQKDVTEKGKHAELLAXLPPHGSEVYVGGISSDVSSEDLKRLCEPVGEVVEVRMMRGKDDSRGYAFVNFRTKGLALKAVKELNNAKLKGKRIRVSSSQAKNKLFIGNVPHSWTDDDFRKVVEEVGPGVLKADLMKVSSANRNRGYGFVEYYNHACAEYARQEMSSPTFKLDSNAPTVSWADPKNNDSASTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGGRYGGGGGSSGSSRPGAKRQRGDDNSSSRHKGRRRPY

SEQ ID NO: 47849 - protein, 312 aa, Arabidopsis lyrata
YLSGMDILLTVDPVNIHYILSSNFANYPKGMEFKKIFEVVGDSIFNVDSGLWEDMRNSSHAIFSHQDFQRFWVSTSVNKLRQGLVPIIENAADKNILVDLQDLFQRFLFDTSLILMTGYDPKCLSIEMPKVEFGDAVDGVSDGVFYRHVKPVFLWRLQYWIGVGVEKRLKRGLAVFDQLLEKIITAKREEIKSLGTQHHSRGEAIDVLTYYMTMDTTEYKYLKPSDDKFIKDTILGFLIAARDTTSSALTWFFWLLSKNPEAMNKIRQEVNKKMPRFDPADLDKLVYLHGAVCETLRLYPPVPFNHKSPAKP

SEQ ID NO: 47850 - protein, 378 aa, Corynebacterium efficiens YS-314
MARDYYGILGVDRNATDSEIKKAYRKLARKYHPDVNPSEEAAEKFREASVAHEVLTDPDKRRIVDMGGDPMEQGGGAGHPGGFGSGGLGDIFDAFFGGGAGSRGPRSRVQPGSDTLWRTSITLEEAFTGVKKDLTLDTAVLCSKCHGSGSASNAKPKTCGTCHGSGEIQEVQRSFLGNVMTSRPCHTCNGTGEVIPDPCDECAGDGRVRARRDIVADIPAGIQSGMRIRMAGQGEVGAGGGPAGDLYVEVMVRPHAVFTRDGDDLHASIRVPMIDAALGSELEVESLTGEEITVVIPAGTQPNQVITLEGEGMPRLRAEGRGDLMAHVDLFVPTEIDDRTRELLEQIRDYRRDNSSVHREGEEHGGLFDKLKSKFRNR

SEQ ID NO: 47851 - protein, 134 aa, Oryza sativa
HHVARQPSQPTVPQAQHTTASLDTCEHSPPLLAPPGRVVAGDLHRASRAGERIMVAFCSPKSRNMVNAIKGLFISCDVPMAQFIVNLNASMPASDKFILHMLDPTHMFVQPHVAEMIRGKISEFRDQNSYEKPT

SEQ ID NO: 47852 - protein, 384 aa, Burkholderia sp. 383
MRSATAPRSKLPDVGTTIFTVIGQLAAQHDALNLSQGAPNFAPDPSLVEGVARAMRDGHNQYAPMAGVMALRERLAEKTEALYGTHYDPATEITVIASASEGLYAAISALVHPGDEVIYFEPSFDSYAPIVRLQGATPVAIKLSPEHFRVNWDEVAAAINPRTRMIIVNTPHNPTATVFSADDLERLAQLTRDTGIVILSDEVYEHVVFDGAQHQSMARHRELAERSVIVSSFGKSFHVTGWRVGHCVAPAELMDEIRKVHQFMVFAADTPMQVAFAEILARPDSYLGLSAFYQAKRDLLARELADSRFELLPSEGSFFMLARFRHFSDESDSDFVLRLIRDARVATIPLSAFYTDGTDAGVIRLSFSKDDATLVEGARRLRSL

SEQ ID NO: 47853 - protein, 608 aa, Coprinopsis cinerea okayama7#130
MVDLPPGLLYLIQHLPSLAIPPATVLASTKLIYHFDLLDGVVESAIPVWAVVLASALSLPVAFVGKALLKGLKDRRDAARNGAVLPPQIYDPLPGGVGLLRATLDNFENGYPGELFEDWVKEYGNIVNFKILGEDRFFTVEPDHIKAILATQFESFEKGPNFQRFMGSILGTGVFNSDGDMWRFHRAMTRPFFTRDRISHFDIFDRHATDALNQLKARLREGYAVDIQDLASRFTMDSATEFLFAKDVQSLAAGLPYPHDSPLHASTSLAASTHPANKFALAFDEAQRLTAIRSRMGVNWPLAEFWRDRVKKEMVTINKFIDPILAAAVQRKRESGGVVGEKVGVGGEREVKENESLLDHLVNYTDDEKVLRDETLNILLAGRDTTTNSITWSVYMLSQHPDVLARLRQEILEVVGETRRPTFDDMKDMKYLRAVINETLRLYPAVPFNVRTSNRPVVLRSKNGGVDHYVPANTKFAYSVFLMHRRKDLWGPDADKFDPDRFLDSRVKTYLTPNPFIFLPFNAGPRICLGQQFAYHETSFFLIRLLQQFKRIEHVPEAQPVWSRPPARWRGSAGPKGVDGVRIKSYLTMSVMGGCWVRMEEAGGEENV

SEQ ID NO: 47854 - protein, 517 aa, Triticum aestivum
  misc_feature (82)..(82): Xaa can be any naturally occurring amino acid
  misc_feature (260)..(260): Xaa can be any naturally occurring amino acid
MELPQLASFLGVVLATVLFLKAVLRRRRQYNLPPGPKPWPIIGNLNLIGTLPHRSIHALSKKYGPLMQLQFGSFPVVVGSSXVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDEAGAVITTPEEFKWMIDELFLLNGVLNIGDSIPWLDWMDLQGYIKRMKKLSKMFRPAAXEHVVDEHSERRRREGESFVVKDMVDVLLQFASDPGLEVKLNREGVKAFTQDLIAGGTESSAVTVEWALSELLKKPEVLAKATEELDRVVGRGRWVTEKDMPSLPYVDAIVKETMRLHPVAPMLVPRLSREDTSINGYDIPAGTRVLVMVWSIGRDPELWEAPEEFMPERFLGSRLDVKGQDYELLPFGSGRRMCPGYSLGLKVIQVSLANLLHGFTWRLPDGVELSMEEIFGLSTPRKFPLEAVMEPKLPAHLYVEA

SEQ ID NO: 47855 - protein, 224 aa, Staphylococcus aureus subsp. aureus MW2
MRVKDNLQQISTQINDKSEKNNFSTKPNVIAVTKYVTIERAKEAYEAGIRHFGENRLEGFLQKKEALPSDAVIHFIGSLQSRKVKGVINDVDYFHALDRLSLAKEINKRAEHKIKCFLQVNVSGEASKHGIALEDVDQFIDDLKKYDKIEIVGLMTMAPLTDDEAYIRSLFKQLRLKKEEIQRLNLEYAPCDELSMGMSNDYLIAVEEGATFVRIGTKLVGEEE

SEQ ID NO: 47856 - protein, 288 aa, Triticum aestivum
MEAKEEDVRLGANKYSERQPIGTAAQGSEDEDYKEPPPAPLFEPGELKSWSFYRAGIAEFVATSLFLYVTILTVMGYSGATSKCATVGIQGIAWSFGGTIFALVYCTAGISGGHINPAVTFGLFLARKLSLTRAVFYIVMQCLGAICGAGVVKGFQQGLYMGNGGGANVVAPGYTKGSGLGAEIIGTFVPVYTVFSATDAKRNARDSHVPILAPLPIGFAVFLVHLATIPITGTGINPARSLGAAIIYNREHAWSDHWIFWVGPFIGAALAAVYHQVVIRAIPPKTKS

SEQ ID NO: 47857 - protein, 290 aa, Triticum aestivum
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAEFMVHLATIPITGTGINPARSLGAAVVYNNEKAWDDHWIFWVGPFIGAAIAALYHQYVLRASATEFGSSASFGSN

SEQ ID NO: 47858 - protein, 677 aa, Oryza sativa Japonica Group
MAGAFRRSAALQAMAAFSVLALVVPDQVQGRGKCPSFSCGRLSYVHFPFRRQGDPAECGVPSYELTCADSNATIQIDKATYLVTDINYSDQYFWVVDASLDSANNCPLPRWSQTPYNENYRLGEDSHRRVQVQLSPDVDWFATFVKCSQEMNSSNVMYRPVACRSGNSSFVYVLTGLGSYLAENLEPSCGYLAMTPLALGGLENWRTATAAATLEDVNYEDVVRSMSEGFAVRFPFRSGGFIDCLRGLISDSNGEPTVYRIFVIVTNINSYFSICGRHATQLPHPFVVLLMLVPQTFWILRVISACRFVLVMLLMWTSVAYMYWKIKMRVDEVEKFLQLQQMLTPTRYSYTDIIAITSHYRDKLGQGGYGSVYKGVLLPGDVRVAIKMLKGDANCKGEEFISEVSTIGRIHHVNVVRLVGFCSEEIRRALVYEYMPQGSLDKYIFSSEKSFSWDKLNEIALGIARGINYLHHGCDMQILHFDIKPHNILLDNNFVPKVADFGLAKLYPRDKSFVPVSAARGTVGYIAPEMISRGFGAISSKSDVYSFGMLLLEMAGGRRNADPNAENSSQAYYPSRVYRQLTRQETGEITAAADMHELEKKLCIVGLWCIQMRSCDRPMMSEVIEMLEGGVDCLQIPPRPFFCDDDYIPAMESLYLSSEVELAAISEEEDESITELN

SEQ ID NO: 47859 - protein, 481 aa, Bacillus cereus ATCC 10987
MSDPNKDLEDLKREAARRAKEEARKRLVAKHNAEISKLEEENQEKEKALSKNDGMTVEEAKRRAAAAAKVKAAVLAKQKGEGTEEEKAKAKAKAAAAAKAKAAALAKQKREGMEEGTEEEKAKAAAAAKAKAAALAKQKREGMEEGTEEEKAKAKAKAAAAAKAKAAALAKQKREGTEEVTEEERAKAKAKAAAAAKAKAAALAKQKREGTEEVTEEERAKAKAKAAAAAKAKAAALAKQKREGMEEGTEEEKAKAKAKAVAAAKAKAAALAKQKASQGDGDSGDEKAKAIAAAKAKAAAAARAKMEGAEGKKEEEAKQEEPSVNQPYLNQYVEVIKGKVGEDALVDCYINKLSKDVPTLVVEPSKYYEVMELLRSHEELAFDYMSELHATDFVTHMEVYVHLFSYGKKQSVAVKVKLDREAPQVESVTPLWKGADWPEREAYDLLGIVFKGHPNLSRILMPDDWIGHPLRKDYEPYDVEV

SEQ ID NO: 47860 - protein, 290 aa, Triticum aestivum
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 47861 - protein, 466 aa, Lentinula edodes
MLGRVLKSAARSQRGLRSFATTTNLGPFTEISTLSNGLTVATESQPHAQTATVGVWIDAGSRAETDKTNGTAHFLEHMAFKGTGRRSQHALELEVENIGAHLNAYTSREQTVYYAKSFSKDVPVAVDIISDILQNSKLESGAIERERDVILREQQEVDKQLEEVVFDHLHAVAFQGQPLGRTILGPKNNILSIQRDDLASYIQTNYTADRMVLVGTGGVDHQSLVKLAEKHFSSLPVSANPLALGRLSSERKPTFVGSEARIRDDELPTAHVAIAVEGVGWSSPDYFPMMVMQSIFGNWDRSLGASSLLSSRLSHIISSNSLANSFMSFSTSYSDTGLWGIYLVSENLMNLDDTLHFTLKEWTRMSIAPTEGEVERAKSQLKAGLLLSLDGTTAVAEDIGRQIVTSGKRMTPAQIENAVDAVSVDDIKRVAQKYLWDKDFALAAFGNIDGLKDYGRIRNDMSSMLY

SEQ ID NO: 47862 - protein, 533 aa, Zea mays
MDKERKQGFFAALKEEVVRGLSPSRRPRAPPPPPPEKVLEQYLGEQLVARSGSLRPGGEALAPLIEGPDAERLAAGDPDAEDSGRREGFGHWVRGHLTRTPSMASSAAGGGGGPGGSSGSFRRSDLRLLLGVMGAPLAPIPSKTAEPLPLLSIKGTPIESSSAQYILHQYTAASGGYKLLQSVRNAYAMGKVRMVASEFETATRVVKNRGPSGRGAAAVEQGGFVLWQMAPDMWYVELAVGGSKVHAGSNGRLVWRHTPWLGAHAAKGPVRPLRRVLQVPAVLPTPRLIPSPPTRANHLTISASFLSVWHWHWQLAMQGLDPLTTAGLFAEARCVGEKKVNGEDCFILKLSADPQTLKLRSEGPAEIIRHVLFGYFSQRTGLMVQMEDSHLTRIQPHAGGDAVYWETTISSALEDYRAVEGVMVAHAGRSAVTLFRFGEAAMSHTKTRMEEAWSIEEVAFNVPGLSVDCFIPPADIRSGSVGEACELPSQPHGERARTGAAVHPSRVAAVERAGTAAGAGGRGEKKVMWRVQV

SEQ ID NO: 47863 - protein, 299 aa, Campylobacter jejuni subsp. jejuni NCTC 11168
MKVHEKVSELIGNTPIIHLKKFGINVFAKCEFLNPSHSIKDRAAFEMIKDALDSKKINQDTTIVEATSGNTGISLAMICADLGLKFIAVMPESMSLERRKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDEVITVSNEDAINTAKELAKSGLMVGISSGANVFAASMLAKKFPDKRILTMLNDTAERYLSTDLFA

SEQ ID NO: 47864 - protein, 432 aa, unidentified eubacterium SCB49
MKITVVGTGYVGLVTGTCLAETGNEVLCVDIDENKVDKMRAGEVPIYEPHLDVLFERNIKADRLKFSTSLQEGLDFGEIIFLALPTPEDEDGSADLSYVLGVSEEIGKLIKSYKVIVDKSTVPVGTAEKVNAVIAEHAGCDFDVVSNPEFLREGFAVDDFLKPERIVIGSSSDKATALMQKLYAPFVRSGNPVIVMDEKSAELTKYAANSFLATKITFMNEIANYCEKVGADVDKVRVGMGTDSRIGKRFLFPGIGYGGSCFPKDVKALQKAGKDEDYDFKILDAVIDVNERQKTILLPRISNHFGGNIKGMKFAIWGLAFKPETDDIREAPSIYMMKGLLEQGASLNVFDPEAMDNIEKQFGDSLAYADSMYDALQGADALIICTEWSIFRTPDLDKLKSSLTNPVIFDGRNLYDTAEMKREGFTYISIGR

SEQ ID NO: 47865 - protein, 462 aa, Salinibacter ruber DSM 13855
MDITVIGTGYVGLVSGTCFAEMGHDVTCVDVDEEKVAQLSDGEIPIYEPDLDRYFERARAEDRLRFTTDLAEGIAGSKIVFFALPTPPGEDGSADLSYVLDAAGDVADLLVEADDPEHRIVVNKSTVPVGTGDRVEEAFADRGLDIGGEVDVVSNPEFLREGSAVDDFLKPDRVVIGTESDRAAETMKRLYEPFVRQGNPVLVVDRRSAEMIKYAANSLLATRISFMNEIANVCERVGANVDKVRLGISKDHRIGPHFLYAGIGFGGSCFPKDVQALARKGREKGYDFQILDAVLDVNDQQRRRLAEQVEDYFDGDLDGRRIAVWGLSFKPGTDDTREAPSHVIIDYLLERGADVVGYDPEAIETTKETFGDQIAYADGMYEAVEGAESLLICTEWHEFRRPDLGAVREHLENPLVLDGRNLYDPARMAEMGFEYHSIGRPSYAPETNQEAIEAAIVENGQP

SEQ ID NO: 47866 - protein, 272 aa, Dioscorea alata
MSSPTLLHLFLLSSLLFSCFSNARLDGEDEFSYIEGSPNGPENWGSLKPEWKTCGNGMEQSPIQLRDNGVIFDQTLGKLRRDYRATDARLRNSGHDVLVEFKNNAGSLSINRVAYQLKRIHFHSPAEHEMNGERFDLEAQLVHESQDQKRAAVSILFRFGPADPFLSDLEDFIRQLSNSQKNEINAGVVDPNQLQIDDSAYYRYMGSFTAPPCSEGISWTVMRKVATVSPRQVLLLKQTVNENAINNARPLQPTNFRSVFYFEQLKSKLGVI

SEQ ID NO: 47867 - protein, 309 aa, Campylobacter jejuni subsp. jejuni NCTC 11168
MRGYKIFSGSANVEFARQVSKYLSLPLSDAGVKRFSDGEISVQIDESVRGKDVFIIQSTCAPTNDNLMELLILTDALRRSSANSITAIIPYFGYARQDRKANPRVPITAKLVANLIQAAGIDRVATIDLHAGQIQGFFDIPVDNLYGSIVFNDYIKAKHFKNAIIGSPDIGGVARARSVAKHLGLDIVIVDKRREKANESEVMNIIGDVKDKEVILVDDIIDTAGTIVKAAEALKEKGAKSVMACCTHAVLSGKAYERIASGVLDELVVTDTIPLKEQLPNIKVLSVTPVFAEVIRRVYHNESVNSLFI

SEQ ID NO: 47868 - protein, 555 aa, Corynebacterium efficiens YS-314
MTCKGAPATVFTVTNLKVTRGLDFSIGRCALPRPHDRIPMTETNTAGSRPTPASPEALPPNGVVASFRYAFSSPARLRIEVLAGLAVSLALIPEAIAFSILAGVDPSMGLFASVVMAIVIAFTGGRPAMITAATGAVALVIAPVAREHGIDYFIATVLLAGVLQIVLAALGVAKLQRFIPRSVMLGFVNALGILIFTAQLEHLIDVPWLVYPLFVLGLVIMIFFPKITTAIPAPLVTIVVLTALVIMAGINVPNVSDMGQMPDSLPSLFIPDVPYTLETLQIIGPYALGMAIVGLMESLMTAKLVDDITDTHSDKTRESWGQGVANIASGFFGGMGGCAMIGQTMINVRESGARTRLSTLLAGVFLLILIVVLGDIVGLIPMAALVAIMVLVSLGTIDWHSVHPRTLKFMPLSETAVMAVTVIATLATNNLAIGVVLGVLTAMVMFARRVAHLVTIEMVEALDVDKDGTIDIRTYRVHGQLFWASSNDLVYQFDYNDEADHIIIDMSAAEIWDASTVATLDSITQKFQERGKTVEITGLDGPSRERLAKLSGRLN

SEQ ID NO: 47869 - protein, 262 aa, Xanthophyllomyces dendrorhous
MSEVRGRGAFGRGGAGARGGRGDTRGRRGPRRGGRKDEDKEWVPVTKLGRLVKDGKIKSMEEIYLFSLPVKEFQIIDFFLPTLKDEVMNITPVQKQTSAGQRTRFKACVAVGDFDGHVGLGVKCAKEVATAIRGAIIAAKLAIIPVRRGYWGAALQEPHTIPCKVSGKTGSVMCRLIPAPRGTGIVAAPASKRLLQMAGIADVYTQSKGSTATTPNFLKATFVALSKSYQILTPDLWRDIAPGQTPYDQFSLFLAQSAKKAY

SEQ ID NO: 47870 - protein, 173 aa, Glycine max
  misc_feature (145)..(145): Xaa can be any naturally occurring amino acid
RITSPSVTTVNRAGGGMVAPFTGLKSMAGFPTRKTNDDITSIASNGGRVRCMLLFSPVGKKKFETLSYLPDLDDAQLAKEGEYVLRKGWIPWLEFELGHGFVYREHNRAPGYYDGRYWTMWKLAMFGCTDASQGLRELQEAKTAXPNGFIRSIGFEKGSPRGGGSGIIGYKPP

SEQ ID NO: 47871 - protein, 133 aa, Oryza sativa
  misc_feature (102)..(102): Xaa can be any naturally occurring amino acid
MSRSLGIPVKLLHEAAGHVVTVELKTGEVYRGAMVECEDNWNCQLDNITFTAKDGKVSQLEHVFIRGSRVRFMIIPDMLKNAPMFKRLEARIRGKGSAIGVXGRGRAVAMRARAAAGRGGGPVGRGGAPPVRR

SEQ ID NO: 47872 - protein, 130 aa, Zea mays
MHKTTAKMSSTATVTRAHLDNKLALAKRCSREATLAGAKAAAVATVASAVPTLASVRMLPWAKANLNPTGQALIVCTVAGMAYFVAADKAILSLARRHSYESAPDHLKDTSFHGGAAAAARPRPPAFFRP

SEQ ID NO: 47873 - protein, 383 aa, Oryza sativa Japonica Group
MGSVSLNVPAPRRGGGRRISCHCTPSLLNLLMFLALLSTNALALLAFFSSSSSSSSSPAASAATAAASTISDHVAAIAREIDTSSSSHLPYRADGLPPELLLFLSPHALPLGRDARTGLTHMPASVAHSCFRSPATLSLLAAFMSYDPHAACPRNATLQQHRLLSKACEPLPRRRCLSGGPRAALPASNMGVDGRRWVRPRHDYEFLLDDVLRLGATRIRIGLDVAGGAANFAARMRDRGVTVVTTVLDNAGKPMNEFVAARGLFPLLLSPAHRFPFYDGVFDLVHVGTNALDEGGAPSMGNSGTEEALEFFMFDVDRVLRVGGLLWIDSYLCQSEERRQLVVNLIKRFGYKKLKWMVGEKAGTGSAKTALYLSALLQKPARD

SEQ ID NO: 47874 - protein, 470 aa, Burkholderia sp. 383
MKAESNGRPAAGAKSSGQPALQQTLGTWQLWGIAVGLVISGEYFGWSYGWASAGTLGFVVTALFVAAMYTTFIFSFTELTTSIPHAGGPFAYARRAFGPTGGYLAGAATLVEFVFAPPAIALAIGAYLHVQFPGLEPKHAAMGAYLVFMALNIVGVQIAATFELVVTLLAIFELLVFMGVVSPGFAWSNFMKGGWSGADHFSVGAFHGMFAAIPFAIWFFLAIEGVAMAAEEAKNPKRSIPIAYVAGILTLVALAIGVMVFAGGAGDWTKLANINDPLPQAMKYIVGANSGWMHMLVWLGLFGLVASFHGIILGYSRQIFALAREGYLPEWLAKVHPRFKTPYRAILAGGVVGIAAIYSDELIQFGGQTLTANIVTMSVFGAIVMYIVSMASLFKLRRSQPNLERPFRAPLYPIFPAFAILAALVCLATMVVFNGLVALVFLGFLAFGYAYFLATRSQRASAPGDVLLEE

SEQ ID NO: 47875 - protein, 295 aa, Vitis vinifera
MAGERRVHPDCINASNPYHECVEYCFRKIAEAKAQMDKKESGVPDQDKNPHDEGTDPEEQSDDDNDQPVEEIEEVDFTQLTGRQKKLFELRLKMNEARKANQTAMVAEKKKMEAPPESRGISKQKWIEERKKKIGKLLDVNGLDMKKAYMLDTQEMAETKYKKWEKDPAPFGWDVFNQKTLYNAYKKRTKNIEVDIDEYNKMKEADPEFYREASSLQYGKAPKCSEDKIDKMVKELKDRDEKRQSFSRRRKFHEEKDIDSINDRNEHFNKKIERAFGKYTLEIKNNLERGTALPD

SEQ ID NO: 47876 - protein, 342 aa, Mesorhizobium sp. BNC1
MGSMSNGVDRHLHHYDGRVLAIAPMMDWTDRHCRFFHRQLSKDALLYTEMIVADAIIHGSRERLLAYDPAEHPVALQLGGSEPGKLGEAARIAASFGYDEINLNVGCPSDRVQSGTFGACLMKTPELVSACVAAMKECVDVPVTVKCRIGVDDQDPEEALDRIAELVFAAGADALWVHARKAWLQGLSPRENREIPPLDYDRVYRLKKKYPGKFVGINGGIQTIDEAVNHLAHMDGVMLGRAAYHTPGILAEVDSRIYGGQNEPVSFAEVVEAMAAYAQRHIERGGRLAHVTRHMTGLFHGRAGARRFRQILSTEATRPRAGPDVLLRALAEIDPAARHEAA

SEQ ID NO: 47877 - protein, 610 aa, Francisella tularensis subsp. holarctica
MWAIVGSSGFESFDDFEIIEELPRETPFGLCSNGLFKIKVEDKEVLFLNRTGLGQNILPHQINYKANIYALKKYGATSIIALSSVRSLREELKPGDMVIPYQFIDRTKSLREFTFCEQGLLNYVSLSKPITESIAEEIRAKKKEFDFEIHFKQSYVCIEGPQFPTIIDAKCFQSMGGGVIGMTAFPEFALAREAGLNYISCNFIVDYVPWSYDVRNLYNVLEIRETNNLKAEKLVKWLVNNLPFYAENDCHELGIARYLSTPIESLPPNKKAWLKVIAKDNSEHEEALEAEILKKVPDLYGGIKTIPAKLQDLLTFIGKYDREGNRKDLEATRKAAASLDLYSYPKVDLENVEDIQITHDDGHNIPVRVYNPKVDEKLKVIIFSHGGGFVSGTLDSFDAFCRKLALTTNRVVFSVDYRLAPEHKFPAGLNDVEFVAEHIFKHSKKFGVSKKKFTLMGDSAGANLTVLATYNLLQKDTVKIANNIILYPSVDLSHMPTKSLEDFASGYILTKAKTMWYSELYVPENIDKRSPEVSPFYIKELDNMPRTLVMTAGYDPLRDEGLLFAERLLRHDVEVQHYHFDSLVHGFINFSKLIPKEMDVLHSRVVKFLG

SEQ ID NO: 47878 - protein, 526 aa, Cryptococcus neoformans var. neoformans JEC21
MMRIPAAPRFASKASTSSRLLVPSRRATTAATSSAHTLNPAGTVTTLPNKLRVATESIPGHFHAVGVYIDAGSRYESQRTSGVSHLLDRLAFKSTDKHTDAQMTTLIDSLGSQVTCASSRETIMYQSTVFPQSLPLAFELISSTIRHPLLLPEELLAQKEAAAYEIREIWAKPELILPEILHTVAFRDNTLGMPLLCPESQLGVLGEEEVRGFMRDWYRPERMVVAGVGMPHEELVMLAEKFFGDMPATTTSPGSLHPSVTQAQQPLGSKSFATASALPVSQDYTDLAHAKAQYTGGELYMEKPEEEFVHIHIGFEGLGIHDPDIYALATLQTLLGGGGSFSAGGPGKGMYTRLYTKVLNQYHAVDFCAAFHHCYADSGLFGISASVYPQFASRIVDVMAGQLHALTGPMFGGVEEKEVRRAKNMLKSTLVMALESRLTAVEDLGRQVQIHGHKVPVEDMCAKIDALTMADLHRVANRILRPGNSSEGRVNYGLGSGKATVVAQGPGLGALGDVRRILKDRWVLGV

SEQ ID NO: 47879 - protein, 401 aa, Nostoc sp. PCC 7120
MTILNSNLSMTSISTLQTRLHSHREQFPALANKTYFNYGGQGPMPQGAMDIITQSLTYIQQIGPFGTEAGNWITRQTQAVREAIASELNASSDTITFTDNVTVGCNIALWGIPWQAGDHILLSDCEHPGVIAATQEISRRFGVEVTTCPLKSTLNEGEPTTIIAQHLRKNTRLVVLSHVFWNTGQVLPLDKIVEVCRNNNSLLLVDAAQSVGALPLNLTELGVDFYAFTGHKWLCGPEGVGGLYVRPEVRESLNPTFIGLYGIIVDNQAQPVSWKPDGRRYEVSTLAYPLYLGLKEAIATHQRWGTPQERYAQICHNSEYLWRSLAAIPNVKCLRDTPPETGIVSFQLHQTPSLKLVQFLDSQKILTRTIADPSCIRVTVHYLTLESEIDQLVEAIARFSV

SEQ ID NO: 47880 - protein, 260 aa, Medicago truncatula
MSQEQPRRPQAGQDPIKYGDVLPVSGDLSQKPITPEDAAMMQSAESRVLGQTQPGGVASVMQSAATRNEQAGIVGHKDVTDVTGDRGVTVTETQVPGRRIITETVGGQVVGQFVEPTPVQVGLTGAVRESALTIGEALEATAHTVGDKPVEQSDASAIQAAEVRATGSNVITPGGLASMAQSAAAFNAECQREEEKIKMGNVLTGATAKLPADKAATRQDAAGVASAEMRNNPDATATPGGVAASVAAAARLNENVGNVM

SEQ ID NO: 47881 - protein, 249 aa, Triticum aestivum
MVKLAFGSCGDSFSATSIRAYVAEFIATLLFVFAGVGSAIAYGKITDDGALDPVGLVAIAIAHAFALFVGVAIAANISGGHLNPAVTFGLAVGGHITILTGIFYWVAQLLGSTAACFLLRFVTHGKAIPTHGVTAGMNEFEGVVMEIVITFALVYAVYATAADPKKGSLGTIAPIAIGFIVGANILAAGPFSGGSMNPARSFGPAVAAGNFAGNWVYWVGPLIGGGLAGFVYGDVFIASYQPVADQDYA

SEQ ID NO: 47882 - protein, 516 aa, Francisella tularensis subsp. holarctica
MTDIHNHKILILDFGSQYTQLIARRVREVGVFCEIFPHDVAADFIKNYQAKGIILSGGPESVYDSDVKAPEIVFELGVPVLGICYGMQTMVMQHGGEVKGADQSEFGKAIINILNLTNNIFSNMEHEQLVWMSHSDKVTQTGEHFEIIASSTNAPVAAVAHKNKPFFGVQFHPETTHTENGKQIIENFVVNICGCDTLWNIENIIENDIKEIKQKVGTDKVILGLSGGVDSSVVAAILHQAIGDQLTCIFVDTGLLRLNEGDQVMQVFAEHMDINVIRINAKNRFLDALRGICDPEQKRKIIGKLFVDIFDEEAAKIENAKWLAQGTIYSDVIESASNNQSKAHVIKSHHNVGGLPKEMKLKLLEPLRELFKDEVRKLGLGLGLPYNMLYRHPFPGPGLGVRILGEIKKEYVETLQKADAIFTEELYKHNLYHDVSQAFGVFLPIKSVGVVGDQRRYEYVIALRAVVSIDFMTATWANLPYDFLSLVSNRIVNEVKQVSRVVYDVTGKPPGTIEWE

SEQ ID NO: 47883 - protein, 468 aa, Bacillus cereus ATCC 10987
MNKGRVTQIMGPVVDVKFDGGKLPEIYNALTVKQSNENGELNLTFEVALHLGDDTVRTVAMSSTDGLVRGTEVEDTGKAISVPVGDATLGRVFNVLGDAIDLDGEVPADVRRDPIHRQAPAFEELSTKVEILETGIKVVDLLAPYIKGGKIGLFGGAGVGKTVLIQELINNIAQEHGGISVFAGVGERTREGNDLYHEMSDSGVIKKTAMVFGQMNEPPGARQRVALTGLTMAEYFRDEQGQDVLLFIDNIFRFTQAGSEVSALLGRMPSAVGYQPTLATEMGQLQERITSTNKGSITSIQAVYVPADDYTDPAPATTFAHLDATTNLERRLTQMGIYPAVDPLASTSRALSPEIVGEEHYEVARQVQQTLQRYKELQDIIAILGMDELSEEDKLVVHRARRIQFFLSQNFHVAEQFTGQKGSYVPVKDTVRGFKEILEGKYDDLPEDAFRLVGGIEEVIENAKKMMA

SEQ ID NO: 47884 - protein, 615 aa, Francisella tularensis subsp. holarctica
MSKYTILDKINTPSDLKLIPESQLKILSAELRAFLVDTLDVSGGHFASSLGATELTVALHYVYNAPYDNIVWDVGHQTYIHKILTGRKDKLVTIKKDGGISGFPKRSESEYDTFGVGHSSTSISAALGMAIADRLQGKSSNTVAVIGDGAITGGMAFEALNHAGGIKEDILVILNDNEMSISDNVGGLSAHFSKIISGGFYNSIREKGKEVLKNIPPIFEFVKKIETQTKGMFVPANFFEDLGFYYVGPIDGHDVTELVKTLRILKDHKGPKLLHVITKKGKGYTKAESDPIKFHHVAPSFHSGENITTKISKPTYSNIFGDWICQKAAKDKRLVGITPAMKEGSDLIRFSQLYPHRYFDVAIAEQHAVTFAGGLACQGLKPVVAIYSTFLQRAYDQVIHDIALQNLDVLYAVDRAGLVGADGATHDGSFDLAFMRCIPNHVIMTPSDENETYHMLEFGYEYNGPAMVRYPRGAGIGAEITGSLDLELGKAKIVKQGSKIAILNFGTLLPLAKQLAEKYHATVIDMRFVKPLDKIMLDKVSQTHEIILTLEENCIAGGAGSAVNEYFVAKDLSNKIIVRNFGLQDKFLNHGTKDLLLAQSKLCVENISKELDKLI

SEQ ID NO: 47885 - protein, 345 aa, Leuconostoc mesenteroides subsp. cremoris
MTTEGKLTAEEIDEAHRVLSKVVTHTPLAYDDYLSKKYRANVYLKREDMQRVRSFKIRGAYYNIIKAEKEKLNNGVVAASAGNHAQGVADTCHNLKIQATIFMPVTTPNQKVEAVKRFGSQYVTVILVGDTFDEAQSAAFEYTEKHNMFFVAPFDDRRTMAGQGTVAVEVFEDAVEQNINVDYLIASVGGGGLIGGLSTYSKKVSPQTTVVGVEPETAQSMKADFQAQKPTTVENIDHFVDGAAVARVSQFTYNQAQQYVDKLLAIPEGKVAQAVLDLYTYEAIVAEPAGAMPIASLDFMASDIVGKNVVLVVSGGNNDIGRMQEMEQKALMYKGRQQFYLVEFP

SEQ ID NO: 47886 - protein, 273 aa, Pseudomonas fluorescens Pf-5
MRTLMLADTQVPVIGQGTWRMGEDRHLRDQEVAALRTGIDLGLTLIDTAEMYGEGGAEEVVGQAIAGRRDQVFLVSKVYPHNASRKGLPLACERSLKRLGSDFIDLYLLHWRGQYPLAETVDALERLREAGKIRRWGVSNFDVADLDELDSPACATNQVLYNLESRGIEFDLLPACQQRRMPLMAYCPIGQGGALLAEPVLLQVAQRHGVTAAQVALAWLLRQDGVLVIPKAVRPAHIRQNAQAGQLQLPDEDLQALDQVFAPPRRKQRLEMV

SEQ ID NO: 47887 - protein, 431 aa, Debaryomyces hansenii CBS767
MLSRVQLKRIPNCRQFSVMNRACKWNDIPLAPPDKILGISEAFVKDSNTKKINLGVGAYRNNSGKPIVFESVKNAEAKLLETETEKEYTGIIGNKNFQKVVRNFIFNNSGKDANGARLIDENRIVTSQTISGTGSLRVIADFLHRFNTAKKIYVPKPTWANHIAVFTDAGMSTEYYDYYNKEINNLDYDKLKQSLSNAEEGSVVLLHACCHNPTGMDLSSEQWDEVLAIVQQKQLFPLVDMAYQGFASGNPYKDIGLIRRLNELVVNGDISTYALCQSFAKNMGLYGERTGSISIVTESAEHSTAIESQLKKLIRPIYSSPPIHGSKIVETIFADESLYNSWLSDLDQVVSRLNTVRTKLYEKLDKSNYNWDHLLKQRGMFVYTGLSAEQVIELREKYSVYATEDGRFSISGINDNNVDYLADAMNQVVNK

SEQ ID NO: 47888 - protein, 292 aa, Hordeum vulgare subsp. vulgare
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAAGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRG

SEQ ID NO: 47889 - protein, 109 aa, Glycine max
SGCSGKRKENENGWWVQVFGIVGVGFGVDEELIPCVNFLNGTTTPPSSCCDPLKQTVENQLDCLCNIFFSPGLLQSFNVSVDQALALSRRCGVTNGITSCSNGSAPAPG

SEQ ID NO: 47890 - protein, 367 aa, Oryza sativa Japonica Group
MGKVPHAMRAAKLPLAVLAKPTHASASQPPAPPRPSNPRHRKTPAKASKTPAPATAAAPPPVEKRPIKTASDLAAAIRAAADADVDAAVDLARSAARTIPLPPHSLSLLLRRLARHRSVAAARGLLAELHPSPASPPPRPALLALSDAVCRRGEPREIAQLLPVLADHGVKADAPVYNALMKAHCAASDPAGVLGVLRRMKDDGVEPDLVTYNTLVFGLARAGMVTKARTYLDAMAAAGHFPDVITYTSLMNGMCVKGDAMGALALLEEMEAKGCEPNERTYNTLLMGLCKNKKLDKAVDVYKSMVGAAMKLEAPAYATFVRALCRAGRIPDAYEVFDYGIESKSFAEVTLYTELENSLKWLHRMKS

SEQ ID NO: 47891 - protein, 448 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLGLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRGIAA

SEQ ID NO: 47892 - protein, 439 aa, Pyrococcus horikoshii
  misc_feature (1)..(1): Xaa can be any naturally occurring amino acid
  misc_feature (90)..(90): Xaa can be any naturally occurring amino acid
  misc_feature (109)..(109): Xaa can be any naturally occurring amino acid
  misc_feature (286)..(286): Xaa can be any naturally occurring amino acid
  misc_feature (351)..(351): Xaa can be any naturally occurring amino acid
  misc_feature (393)..(393): Xaa can be any naturally occurring amino acid
XIREKALEFHKNNFPGNGKIEVIPKVSLESREELTLAYTPGVAEPCKEIARDPGKVYEYTSKGNLVAVVSDGSRILGLGNIGPLAGLPVXEGKALLFKRFGGVDAFPIXIKEQEPNKFIDIVKAIAPTFGGINLEDIASPKCFYILERLREELDIPVFHDDQQGTAAVVLAGLLNALKVVGKKISEITLALFGAGAAGFATLRILTEAGVKPENVRVVELVNGKPRILTSDLDLEKLFPYRGWLLKKTNGENIEGGPQEALKDADVLISFTRPGPGVIKPQWIEKXNEDAIVFPLANPVPEILPEEAKKAGARIVATGRSDYPNQINNLLGFPGIFRGALDVRARTITDSXIIAAAKAIASIVEEPSEENIIPSPLNPIVYAREARAVAEEAXKEGVARTKVKGEWVEEHTIRLIEFYENVIAPINKKRREYSKAITRA

SEQ ID NO: 47893 - protein, 342 aa, Salinibacter ruber DSM 13855
MSPLADPNSPMASSTQSVSSDERVAALRARIDEALPAVVDGRSPASLYDAVEHVLRAGGKRVRPVLLLLVAQSYGTSVDRALPAALAVEVFHNFTLVHDDLMDEDDERRGGATVHAKWNPGTAILAGDLMMGLSYDLLGQVEGTDAEALYAVYHPMVERLCAGQALDASFETDDAVTVEAYLDMIDRKTGALLSAAFELGSVIGGAPSPERDRLGTAGRLVGRAFQIQDDLLDLTADDEAWGRGVGGDLVQGKKTFLTLRALERAEGAEHDWFARLVTDGGLPRDDVPEARERMADLGIFEEAREAVHTYTEKAHDHLHLLPETAAAETLHWLLDRLQARGH

SEQ ID NO: 47894 - protein, 182 aa, Campylobacter jejuni subsp. jejuni NCTC 11168
MIKLTQEEQKYLLDSIRIIPDFPKKGIIFRDITTLLNNKEALNFLLKHLKERYKDYNLDFIAGTESRGFIFASMICAKLNLPFVPIRKPGKLPFETFSCEYDLEYGSDKVELHKDAFKNIQNARVLLVDDLIATGGTAIASYELIQKAGAKCVEACFLINLKDLNGANKLEKLTSVYSVLEI

SEQ ID NO: 47895 - protein, 314 aa, Mesorhizobium huakuii
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 47896 - protein, 162 aa, Salinibacter ruber DSM 13855
MADHPQWDHPPDLQIDTDAVHEATFETSKGTIHAELYPEHAPHTVNNFAFLADEGFYDGTPFHRVIEGFMVQGGDPTGTGRGGPGYEFDDEIDGNPLTHETGVLSMANAGPNTNGSQFFITRAPQSHLDGKHTVFGDVTDGQDVVDAIEESDTLKSVTVEKR

SEQ ID NO: 47897 - protein, 314 aa, Mesorhizobium loti
VMFDGSSIAGWKAINESDMVLMPDPDTVHMDPFFAQSTMVILCDILDPVSGESYNRDPRGTAKKAEAYMKAEGIGDTIYVGPEAEFFVFDDVKYKADPYNTGFRLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 47898 - protein, 314 aa, Mesorhizobium mediterraneum
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 47899 - protein, 367 aa, Campylobacter jejuni subsp. jejuni NCTC 11168
MSLSVGIVGLPNVGKSTTFNALTKAQNAQSANYPFCTIEPNKAMVEVPDLRLNELAKIVKPERIMHSLIEFVDIAGLVKGASKGEGLGNKFLSNIRETEVILHIVRCFDEENITHVEGGVDPLRDVEIINTELILADIEQLSKKIEKLTKEAKANQKGAKESLELANSLLDHLNKGLAASSYPEKESEIYQALIKELRLLSAKEVIYGANVDENGISEDNDYVKALKEYAKKNDHEVIKLCAKIEEELVGLSDEESHEFLSSLGVNESGLDQIIRTAFAKLGLISYFTAGVVEVRSWTIKKGWKAPKAASVIHNDFEKGFIKAEVISYEDYIQYKGENGAKEAGKLRLEGKDYIVLDGDVMHFKFNV

SEQ ID NO: 47900 - protein, 314 aa, Mesorhizobium ciceri
  misc_feature (100)..(100): Xaa can be any naturally occurring amino acid
VMFDGSSIAGWKAITKSDMVLMPDPETVHMDPFFAQSTMVILCDILDPVSGESYNRDPRGTAKKAEAYMKAEGIGDTIFVGPEAEFFVFDDVKYKADPYXTGFKLDSTELPSNDDTDYETGNLGHRPRIKGGYFPVPPIDSAQDMRSEMLTVLAEMGVRVEKHHHEVAAAQHELGIKFDALVRNADKMLIYKYVVHQVANAYGKTATFMPKPIFGDNGSGMHVHMSIWKNGKPTFAGNEYAGLSESCLFFIGGVIKHAKAINAFTNPLTNSYKRLVPGYEAPVLLAYSARNRSASCRIPFGSSPKAKRVEVRFP

SEQ ID NO: 47901 - protein, 493 aa, Legionella pneumophila subsp. pneumophila str. Philadelphia 1
MIHRNKVLNSILLILFTSQIAFAKSNPASQAYVDSKVSELKNELTNKINSIPSGPQGPQGPRGDKGEAGPKGDQGEAGPQGLPGPKGDRGEAGPQGLPGPKGDQGEAGPQGLSGPKGDQGEAGPQGLPGPKGDQGEAGPQGLPGPKGDQGEAGPQGLPGPKGDQGEAGPQGLPGPKGDRGEAGPQGLPGPKGDRGEAGPQGLPGPKGDRGEAGPQGLPGPKGDKGEAGPQGLPGPKGDRGEAGPQGLPGPKGDKGEAGPQGLPGPKGDRGEAGPQGLPGPKGDRGEAGSQGLPGPKGDKGEAGPQGLPGPKGDKGETGAVGPQGMPGPKGEAGDDGQGVPAGGETGQVLAKSNDLDFNTMWVDPANSGIRRQLGDKALGGTVIYVNALGTHGLVVANSDQVNASTWWDAHDFISNPAHFDNEGKLYSDWRLPTRFELNLIYMMRNELGNFLAGNYWSSIEKSSANSWVFNSKTGEIKDLAKNKTAAVRAVRAF

SEQ ID NO: 47902 - protein, 314 aa, Rhizobium leguminosarum bv. viciae
VMFDGSSIGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 47903 - protein, 406 aa, Arabidopsis thaliana
MIKLWMMTSLQLAELFVSSIVHLLYGFYIFSSAVAGDISQTLNDYLFKSNVAFGETGQNQTNVEGLPPIVLVHGIFGFGKGRLGGLSYFGGAEKKDERVLVPDLGSLTSIYDRARELFYYLKGGVVDFGEEHSEACGHSRFGRRYEQGQYPEWDEDHPIHFVGHSAGAQVVRVLQQMLADQAFEGFEETNENWVLSVTSLSGAFNGTTRTYLDGMRTDDGVSMKPICLLQLCRIGVIMYDWLDISWLKTYYNFGFDHFNISWKKTGVRGLVDCLMGNAGPFASGDWILPDLTIQGSTSINSNLQTFPNTYYFSYATKRTRRVMGMTIPSGVLGIHPMLFLRVFQMSQWKFPQDVSPPYKGYRDEDWQENDGALNTISMTHPRLPVEHPSRFIRSDSECQTLQPGIW

SEQ ID NO: 47904 - protein, 508 aa, Burkholderia sp. 383
MNPFDLKQLGLDVEYPYRQQYDNYIGGKWVPPVKGEYFENVSPINGQPFCRIPRSGTDDIELALDAAHAARRKWGKTSVAERANLLLAAADRMEKNLKLLAVAETIDNGKPLRETMAADLPLAVDHFRYFAGCIRAQEGGISEIDDNTVAYHFHEPLGVVGQIIPWNFPLLMAAWKLAPALAAGCCVVMKPAEQTPASVLVLMELIGDLFPAGTINIVNGFGKEAGEALATSKRIAKIAFTGSTPVGKHILRAAADSLIPSTVELGGKSPNIFFADVLDQDDAFLDKALEGLAMFALNQGEVCTCPSRILIQESIYEKFIEKAVARVERIKAGHPLDLQTMIGAQASQQQLDKILSYIDIGRGEGAQCLTGGERTAPAAELGTGYYVKPTMLLGNNKMRVFQEEIFGPVASVMTFKDEQDAIELANDTFYGLGAGVWTRNGTRAYRMGREVEAGRVWTNCYHLYPAHAAFGGYKQSGIGRETHKMALSNYQQTKCLLVSYQAEALGFF

SEQ ID NO: 47905 - protein, 394 aa, Erythrobacter sp. SD-21
MSDEFYRIKRMPPYVIAEVNAMRHAARQAGRDIIDLGMGNPDQPPPQHVIDKLCEVAAKPDAHGYSQSKGIPGLRRAQSNYYQRRFGVELDPEREVVVTMGSKEGLSSMATAISAPGDVILAPSPAYPIHTYGFMIAGATIRSVPTTPDENYWRALDNAMAYTVPRPTVLVVNYPSNPTAETVDLDFYERLVAWAKRNEVWVLSDLAYSELYYDGKPTRSILEVPGAIEIAVEFTSMSKTFSMAGWRIGFCVGNQKLIAALTRVKSYLDYGAFTPVQAAACAALNGPQEVVEQNRARYQHRRDVMVESFTRAGWAIPNPPASMFTWARLPPGFENMGSLEFSKRLLQEAEVAVAAGVGFGEEGEGYVRIAMVENEQRIRQAARNIKKFLADYGR

SEQ ID NO: 47906 - protein, 365 aa, Ipomoea batatas
ANEHGSEEVLNYDQVFVRDFVPSALAFLMNGEPDIVKNFLLKTLLLQGWEKKVDRLKLGEGVMPASFKVLHDPVRKTDAIIADFGENAIGRVAPVDSGFWWIILLRAYTKSTGDTSLAERPECQKGMRLILSLCLSEGFDTFPTLLCADGCSMIDRRMGVIGYPIEIQALFFVALRCALAMLKPDTEGKEFIERIVKRLHALSYHMRSYFWLDFQQLNDIYRFKTEEYSHTAVNKFNVIPDSIPDWVFDFMPTRGGYFVGNVSPARVDFRWFALGNCVAILASLATPEQASAIMDLIEARWEELVGEMPLKISYPALENHEWRIVTGCDPKNTRWSYHNGGSWPVLLWLVTAACIKTGRPQIAKR

SEQ ID NO: 47907 - protein, 529 aa, Mycobacterium leprae TN
MADSAGLDQPEPSPRPVLVVDFGAQYAQLIARRVREARVFSEVIPHTTSIEEITARDPLAIVLSGGPASVYTEGAPQLDPALFDLGLPVFGICYGFQAMAQVLGGTVARTKTSEYGRTELKVLGGDLHSGLPGVQPVWMSHGDAVTAAPDGFDVAASSSGAPVAAFENRDRRLAGVQYHPEVMHTPHGQQVLSRFLHDFAGLDADWTAANIAGVLVEQVRAQIGNGHAICGLSGGVDSAVAAALVQRAIGDRLTCIFVDHGLLRDGERGQVQRDFVAATGAKLVTVDAAETFLQALSGVTNPEGKRKIIGRQFIRAFEGAVRDLLGDSTFDSGIEFLVQGTLYPDVVESGGGSGTANIKSHHNVGGLPDNLRFKLVEPLRLLFKDEVRAVGRQLDLPEEIVARQPFPGPGLGIRIVGEVTAERLDTLRRADSIAREELTTAGLDYQIWQCPVVLLADVRSVGVQGDNRSYGHPIVLRPVSSEDAMTADWTWVPYEVLECISTRITNEVAEVNRVVLDITNKPPGTIEWE

SEQ ID NO: 47908 - protein, 396 aa, Oryza sativa Japonica Group
MGAFCSKQNPSGQQPHCCNHSSSSNAAPKGNNRFAKFGDDYHTLEQVTDALAHAGLESSNLIVGIDFTKSNEWTGRVSFNNQSLHSLGHISNPYEQAISIIGQTLSRFDEDNLIPCYGFGDATTHDQKVFSFYPDNKPCDGFEQALDRYREIVPQLRLAGPTSFAPMIETAIGIVDSSGGQYHVLLIIADGQVTRSVDTGNGQLSPQERETIDAIVKASDYPLSIVLVGVGDGPWDMMRQFDDNIPSRAFDNFQFVNFTEIMSRPVPASKKEAEFALSALMEIPEQFKAAINLQLLGKRRGFPHRTVLPPPVRDFQQYYGCSTVKETQSTSYGSLQKKTSAPKQDSDIGDQTCPICWLEAKNLAFGCGHQTCSDCGKDLKVCPICQREISTRIRLY

SEQ ID NO: 47909 - protein, 172 aa, Triticum aestivum
  misc_feature (107)..(107): Xaa can be any naturally occurring amino acid
  misc_feature (141)..(141): Xaa can be any naturally occurring amino acid
PPSKLYTYIVQPWPPPVMASSATSVAPFQGLKSTAGLPVSRRSNGASLGSVSNGGRIRCMQVWPIEGIKKFETLSYLPPLSTEALLKQVDYLIRSKWVPCLDSASRXIFREHNASPGYYDGRYWDMWNCLFRCTDPHSVQXVEESRRIPDAYARHMPCMRHSCLPAARSGRL

SEQ ID NO: 47910 - protein, 755 aa, Bradyrhizobium japonicum
MRSASGGPRVLLRRLRETMAEQVSAQERLDKIVVLIAANMVAEVCSVYVLRIDNTLELYATEGLNREAVHHTVLSAHEGLVGLVASEATPLNLNDAQSHPAFSFRPETGEEIYHSFLGVPILRAGNTLGVLVVQNRAKRTYVEEELEALQTTAMVLAELIASGELSALAQPGLEPAARHSMQKVGAILSEGIALGHVVLHEPRVVIKDYIAEDLPKEIKRLDTALAKLRADLDRMLERGDVAEGGEHREVLEAYRMFANDQGWSHKLHEAVATGLTAEAAVERVQSDTRARMLRSTDPYLRDRLHDLEDLGYRLMRQLVGQDHAPSREQLPDNAIVIARAMGPAALLDYNRKRLRGIVLEEGTANSHVSIVARALGIPAVGEVPNAPGIADPGDAIIVDGTSGSIYVRPSQEIEAAFAERVRFRARRQAQYLALRDRPCVTKDGQKVELMINAGLAIDLPHIEDTGSAGIGLFRTELQFMVGQSLPRTSDQLALYRTVLDAAGTKPVTFRTLDIGGDKALPYMEAVIEENPALGWRAIRLGLDRPGLLRGQIRALLRAGGGRALRIMFPMISEVAEFDAAKALVERELTYLRQHGHTLPERIDIGTMVEVPALLYQLDELLKKVDFISVGSNDLFQFLFAVDRGNAKVSERFDTMSAPILRALRDIARKSHAAQKSLSLCGEMASKPIGALALIAMGYRSLSLSATALGPVKAMVIDLDAKKAEAMLGPLLDAPSGSVSIRQKLTEFAEAEGLAL

SEQ ID NO: 47911 - protein, 280 aa, Aspergillus oryzae
MASPNQSQNAAPSTQPLTPPAEPSNTTTNASSQQQPATGSTTTAPVAQPTQVPSTSLKDSGKSRRPRDVRLIHMLLASLGVTAYQERVPLQLLDFAYRYTSGVLQDAVHLATEGYAGAMGEQAGSSRGPPEVNTVSLPALRLSIASRLHYQFQTGLPKEFLMDVAAERNRVALPGATRGYDQGQAKPTANQSVLMGGMRLPPERFCLTGVGWNMKDEWESEGEEEVEEEEPKETNHAGAGGEEEGDGGEDDEDGKMEDIFGEDAVMGDGDDDGDKDMTDV

SEQ ID NO: 47912 - protein, 335 aa, Oryza sativa Japonica Group
MAAAAESKAGKSPEELLCAAAESGDAEAITGLLAEGADPTHFDASGLTPLMHAATGGHAAVVQLLLDAGAPWNALSPTGISAGDLASDSATFDLLLDHALRSELVLGTVARRQAGPADSPAESYLESRVSFSEERVMDADSKAVMMEWERPLMEAHARAVCSGGKVLNVGFGMGLVDTAIQRYEPEEHTIVEAHPEVYARMLKLGWGEKKNVKVVFGRWQDVLPQLGSYDGIFFDTYGEYYEDMREFHQHLPKLLKPGGIYSYFNGLCGDNAFFHVVYCQLVALELANLGYSTQFIPLPVKDCLSEEIWNGVKQKYWQLDTYHLPVCQAESEPEQ

SEQ ID NO: 47913 - protein, 200 aa, Rickettsia akari str. Hartford
MSVFVGKTAPDFTAKAIMPNNNIDEKFKLSDYAAGDNIVLFFYPLDFTFVCPSEIIAFHNKLGEFTERRTKVVAVSVDSHFSHLAWKNTPHNKGGLGQVQFPMVSDIKKDISSKYNVLNEDCFALRGTFLIDKDFIVRHMLVNDLPIGRDINYTLKVIDALTHHQKHGEVCPAGWHKGEEAITPSHEGIAHYLSSHAEKL

SEQ ID NO: 47914 - protein, 605 aa, Cryptococcus neoformans var. neoformans JEC21
MSAEELVASPKLSKEEKKARKEAKKLKKAEKAAKEAAAQEGVATEEVKEEVRKKDKKDKKEKKDKKRKEVDQEEAESPSTSTAATEEPPKKKKKSKDADSSETPVSTATPTESETPALSKKQQKKLAKASAAAAATSSAAAIPAPTVPTTFTAEHNTFLTSNNITLTPSLFPPLLSIRDLPINSKLQPFLNKFEKPTPIQACSWPALLSKKDVVGIAETGSGKTLAFGVPGINLLSQLPPVTGSKKGRGQVPGQIQMLVLAPTRELAQQSHEHLSAFGEQVGLKSVCIFGGVGKDGQARELSQKDTRVVVGTPGRTLDLADSGELDLSSVSYLVLDEADRMLDAGFENDIRRIIAHTPGHKEGRQTVMFSATWPESVRRLASTFLNNPLRITVGSDELSANKRIEQIVEVLDNPRDKDFRLTHHLKAHLKVHPNSKTSPTRILVFALYKKEAQRLEYTIRRAGYAVGALHGDMTQEARFKALEAFKTGQQNVLVATDVAARGLDIPDVGLVINVTFPLTTEDFVHRCGRTGRAGKTGKAVTFFTGENHEKSLAGEFMRVLRDVGAEIPKEMDRFPTTIKKKEHGSYGAFYKETTNAPAPTKITFD

SEQ ID NO: 47915 - protein, 166 aa, Picea sitchensis
MQHLAAKNNLVESGEMKEMGRPRAAFMREKCEEVVFCPKPRRAGLAINPIPELSKSTRRHRSHSPEYNESEPGVEILDIFLSRSGCGDSLNFGCSPPYFNGSPPSRADNPLVHDINFIHQIVQASPSTLSKPKSFGRSSFGPNAAVRVEGFDCSGRDTRCSIPALA

SEQ ID NO: 47916 - protein, 508 aa, Oryza sativa Japonica Group
METLMAAELPQQKAGGGLARRLVRLLRRKRSTSGSVAGGGEYDESSMDSSINSLSKLKLSAAKLDVLFRSAAQPAASPAVDAAAAHALVASLFAGVSAVKAAYAQLQQAQHPYDSEAIQSADAAMVAELTKLSDHKRRFARDPAAAAKSAAAGPAALAAHADEQRHLLRTYEITAGKLGRELRARDAEAERARAALADDLRAARALEERAHPGRTLAALDGLHLSGLNATHFLTALRHAARSVRSFAKSMLGEMRRAGWDPVAAAAAAHPGVPLRHPGDAKFALESFVALKMFDGFHRRDFGLSALHDRSSYDRRRLFDEFAELKAAPAAEFLDARSSRWGALGEFLRDRYLSVVHERMEAAFFGSTAQRGAAASAGAALPGTPWFAEFAEMARRVWLLHCLFLAFDDGGASTIFQVAAGARFSEVYMESVGDGDGDGDDGGAGTAVAAAAAGDRVVGFTVVPGWADGDAMPRIPLTAGATAMTAVELAGGGRRRWLAGDVVHADYKP

SEQ ID NO: 47917 - protein, 372 aa, Idiomarina baltica OS145
MSLHSTEEIIEDIKQGKMVILMDDEDRENEGDLILAADCVTPEAINFMARYGRGLICLTLSEERCKQLNLPLMVDRNNAPYSTAFTVSIEAAEGVTTGISAADRAQTVKAAVARNAQPEDLVMPGHIFPLKAKQGGVLNRAGHTEAGCDLARLAGYEPAAVIVEVLNEDGTMARRADLEKFAEAHDIKVGTIADLIEYRSVREKTIRRVAQCQLPTSFGKFNMITYQDSIDQQVHHALVHGEINAEKVTNVRVHLQDSLHDTLSTERAAKRSWPIAKAMQYIAENDGVLVLIGRQQTPEDIIAQVKEFEAQDQGQHKPTASASNASRNVGVGSQILADLGIHQMHLLSSPKRYSALSGFGLEVVDFIEDKAD

SEQ ID NO: 47918 - protein, 480 aa, Zea mays
MKLRLRSMQARGGSAAVETHRVDLPPTATLADVKTLLASKLSAAQPVPAESVRLSLNRSEELVSPDPAATLPSLGLASGDLVFFTLSPLTALAPPAQALPRNPSPSSGAAASIAEAADRGKGSKQSGTGDFSSSSLAQAVVVSPSFPVASGTRDVVMEEEAVDATKGWSSFVLRDLKREMDNVGAAEGTAAGRLVAALHAALLDAGFLTAKLTGSHLSLPQGWPSGALKPLTIKYTIPELSSMVSVTEEGKVVVLNYSLMANFVMVYGYVPGAQSEVCRLCLELPGLEPLLYLDGDQLNGVHEKGVHDLWRVLKDEICLPLMISLCQLNGLRLPPCLMALPADLKTKVLGFLPGVDLAKVECTCKEMMNLASDDSIWKKLVSKFENYGEGSRLAGKNAKAIFVEAWQANKRRQKRPNPTFWNYGWGNSPYSRPLRLPLIGGDSDRLPFIGNHGSVGRHFGNQRRNISPNCILDGHRHNFL

SEQ ID NO: 47919 - protein, 387 aa, Synechococcus sp. CC9311
MKEAGGTPQLSGEEKTRYARHITLPEVGVEGQQRLKAASVLCIGAGGLGSPLLLYLAAAGVGRIGVVDDDLVEPSNLQRQVIHGTETVGQAKTSSARSRIEDLNPFCRVEDHCFRLSANNALELFAAYDVVVDGTDNFASRYLINDACVLTKRPFVYGSVQRFEGQVSVFNLGSQSPDYRDLVPEPPPQELVPSCADGGVMGVMPGLIGLIQAAEVIKLITGIGTPLDGRLLLVDGLSMRFRELTLKRRPSRAPIEKLIDYQAFCTVGRSISGGKLKVMKSISVLELKAMLDQGHDLALIDVRNPAEAEVAVIAGSELIPLATLDSEEVIDRIKAIAASKTVYVHCKLGGRSAKAVEFLANHGIDAVNVQGGIDAWSEQIDPSVPRY

SEQ ID NO: 47920 - protein, 473 aa, Vitis vinifera
MDYTTLLLLFSFVWSCVKVLTIGFTNRKSGVARLPPGPRPFPIIGNLLKLGEKPHQSLTILSKTYGPLMSLKLGSTTTIVVSSSEAAQEVLNKNDQAFSSRTVLNAIQVADHHHFSIVFLPASAHWRNLRKICSKQMFSSHRVEAGQAMRENIVQQLLGHAQESCSSGRAVDIGRATFTTTLNLLSNTIFSVNLAHYNSNFSQEFKDLIWSIMEEAGKPNLADFFPVLRLVDPQGILKGMTVCFNKLVEVFDGFIEQRLPLKASSANNDVLDGLLNLDKQHDHELSSNDVRHLLVDLFSAGTDTTSSTVEWAMAELLNNPNLMAKARSELGKVVGKEKMVEESDISKLPYLQAVVKETFRLHPPVPFLVPRKTEMKDSTIWSNPNSFVPERFLECEIDVKGRDFQLIPFGAGRRICPGLLLGHRMVHLMLASLLHSFDWKLEDGLKPEDMDMTEKFGFTLRKAQPLQAVPIKP

SEQ ID NO: 47921 - protein, 442 aa, Vitis vinifera
  misc_feature (238)..(239): Xaa can be any naturally occurring amino acid
  misc_feature (438)..(438): Xaa can be any naturally occurring amino acid
MDYTTLLLLFSFVWSCVKVLTIGFTNRKSGVARLPPGPRPFPIIGNLLKLGEKPHQSLTILSKTYGPLMSLKLGSTTTIVVSSSEAAQEVLNKNDQAFSSRTVLNAIQVADHHHFSIVFLPASAHWRNLRKICSKQMFSSHRVEAGQAMRENIVQQLLGHAQESCSSGRAVDIGRATFTTTLNLLSNTIFSVNLAHYNSNFSQEFKDLIWSIMEEAGKPNLADFFPVLRLVDPQGILXXMTVCFNKLVEVFDGFIEQRLPLKASSANNDVLDGLLNLDKQHDHELSSNDVRHLLVDLFSAGTDTTSSTVEWAMAELLNNPNLMAKARSELGKVVGKEKMVEESDISKLPYLQAVVKETFRFLECEIBVKGRDFQLIPFGAGRRICPGLLLGHRMVHLMLASLLHSFDWKLEDGLKPEDMDMTEKFGFTLRKAQPLQAXPIKP

SEQ ID NO: 47922 - protein, 176 aa, Synechococcus sp. RS9916
MIPGLEPVPLRDLQALGAPRVWEVEGMLEDLESLTPVRGELQAEHRGNVLEVSGELQTIVSLCCDRCLGQFNQSLKVKTEELIWLGDDQSSDAMAEAGFDPDSPDGLIESMDPRSSFEPERWAFEHLSLQRSVVNRCGNDCPGPPQPENTGAAMPSAPIDPRWQALQQLRESSNNA

SEQ ID NO: 47923 - protein, 317 aa, Bacillus licheniformis ATCC 14580
MDVISIGETMALFTPNEDGPLRYARNYQVRIAGAETNTLIGLSKLGKKAGWITRLGKDEFGAMILSSVRGEGVDVSQVKLDDAAPTGLFFKERKSAAKVNVFYYRTLSAASFLKKCDIDEQYIEKAGLLYITGITPALSESASDAVFYAVELAKKHNKCVVFDPNFRKKLWDGERARQTMFELIKRSDIVLPGLSEGRFLFGTADEKKIAEAIRGLGAETAIIKLGSKGAYYAGGNESGYAEGYQIQAAADPVGAGDGFAAGVLSGLIDQIPLSEAVKRGCAVGAMVAAVNGDIEGLPDRESLFAFMEQSDEEDVSR

SEQ ID NO: 47924 - protein, 526 aa, Yarrowia lipolytica CLIB122
MFQLFSILVLAFTTALVAQLAYNQYDYQRKVKKFGCGQLRVAENGLFGWKGLREVLRINKYKLGPAALKDRFEKYGKTHVFHVGPSPLITTMDPENIKAMLATQFKDFCLIARYKALGPMLGDGIFTLDGHGWTHSRALLRPQFAREQVSRLDSIEHHFQILKKCISKEMSDKRDTQRGFDIQNLFFLMTLDTATEFLFGSSVDSLVDFLDDPSIQTGDHGGIDEAARKGFSNAFNRAQELSSLRTRLHKLYWVIGTLAVREPYHRYNREVKTFVDHYAAKAIKARNEKNTDLLDNDKYIFMYELVKETSNPITLRDQMLNILLAGRDTTASMLSWIYFRLARDPKRYAKLRAAVLADFGPGPENITFESLKKCDYLRYVLNESLRVYPVVPINARTASRDTTLPRGGGPDGSQPIFVPKGQTVSYSVWWTHRDPEFWGQDAEEFIPERWDTKNGSIGRGWEYLPFNGGPRICLGQQFALTEVGYVLSRMVQTYETLESGDTKPLPPLYNHALTLCHQEGVWIKTE

SEQ ID NO: 47925 - protein, 314 aa, Rhizobium etli
VMFDGSSIGGWKAINESDMVLMPDTETVHMDPFFAQSTMVILCDILDPVSGEAYNRDPRGTAKKAEAYLKASGIGDTIFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 47926 - protein, 140 aa, Glycine max
  misc_feature (86)..(86): Xaa can be any naturally occurring amino acid
  misc_feature (113)..(113): Xaa can be any naturally occurring amino acid
  misc_feature (129)..(129): Xaa can be any naturally occurring amino acid
VQRESAALKEKEELLAYVNVLKAQLQRQHIDTTQVFEKTESCSDTKHVDPTEENVDKACLSVSRAIPVPAENVVHMATDQVNIQPXGDNEWSDIQATEARIADVREVAPETDXSSLDIPVVSQPGTNHXHEQGANSFHQP

SEQ ID NO: 47927 - protein, 314 aa, Rhizobium tropici
VMFDGSSIAGWKAINESDMVLMPDPDTVHMDPFFAQSTMVILCDILDPISGESYNRDPRGTAKKAEAYLKASGIGDTAFFGPEAEFFVFDDVKYKADPYNTGFKLDSSELPSNDDTDYETGNLGHRPRVKGGYFPVPPIDSCQDMRSEMLTVLTEMGVTVEKHHHEVAAAQHELGIKFDTLVRSADGMQIYKYVVHQVANAYGKTATFMPKPIFGDNGSGMHVHQSVWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 47928 - protein, 314 aa, Rhizobium tropici
VMFDGSSIAGWKAINESDMVLMPDTETVHMDPFFAQSTMVILCDILDPVSGEAYNRDPRGTAKKAEAYLKASGIGDTAFFGPEAEFFVFDDVKYKADPYNTGFKLDSSELPSNDDTDYETGNLGHRPRVKGGYFPVPPVDSAQDMRSEMLTVLAEMGVVVEKHHHEVAAAQHELGIKFDTLVRNADKMQIYKYVVHQVANAYGKTATFMPKPIFGDNGSGMHVHQSIWKSGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 47929 - protein, 425 aa, Shewanella sp. ANA-3
MSTTNDSLMARRQAAVAGGVGQIHPVFTARAENATVWDVEGREFIDFAGGIAVLNTGHLHPKVKAAVAAQLEDFSHTCFMVLGYESYIQVCEKLNQLVPGDFAKKTALFTSGSEAVENAVKVARAYTKRAGVIAFTSGYHGRTMAALALTGKVAPYSKGMGLMSANVFRAEFPCALHGVSDDDAMASIERIFKNDAEPSNIAAIILEPVQGEGGFYAASPEFMQRLRALCDREGIMLIADEVQTGAGRTGTFFAMEQMGVSADITTFAKSIAGGFPLSGITGKAEVMDAIGPGGLGGTYGGNPLACAAALAVLEVFEEEKLLERANAIGERIKSALNTMQVEHPQIADVRGLGAMIAIELMEEGKPAPQYCAQILAEARNRGLILLSCGTYGNVLRILVPLTVPDEQLAAGLGILKSCFDAVLKG

SEQ ID NO: 47930 - protein, 314 aa, Sinorhizobium terangae
VMFDGSSISGWKAINESDMVLMPDPETAHMDPFFAQSTMVILCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPIDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 47931 - protein, 314 aa, Sinorhizobium fredii
VMFDGSSIAGWKAINESDMVLMPDPETAHMDPFFAQSTMVIVCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPVDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 47932 - protein, 314 aa, Sinorhizobium medicae
VMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLTEMGVTVEKHHHEVAAAQHELGIKFDALVRNADKMQIYKYVVHQVANAYGKTATFMPKPIFGDNGSGMHVHLSIWKDGKPTFAGDEYAGLSETCLYFIGGIIKHAKALNAFTNPSTNSYKRLVPGYEAPVLLAYSARNRSASCRIPFGSNPKSKRVEVRFP

SEQ ID NO: 47933 - protein, 322 aa, Schizosaccharomyces pombe 972h-
MATSSAAAAASTPVNANTITETKNSTFFFDFMMGGVSAAVSKTAAAPIERVKLLIQNQDEMIRAGRLSHRYKGIGECFKRTAAEEGVISLWRGNTANVLRYFPTQALNFAFKDKFKKMFGYKKERDGYAKWFAGNLASGGAAGAASLLFVYSLDYARTRLANDAKSAKKGGERQFNGLVDVYRKTYRSDGLRGLYRGFGPSVVGIVVYRGLYFGMYDTLKPVVLVGPLEGNFLASFLLGWAVTTGSGVASYPLDTIRRRMMMTSGEAVKYSSSFECGRQILAKEGARSFFKGAGANILRGVAGAGVLSIYDQVQLLMFGKKF

SEQ ID NO: 47934 - protein, 314 aa, Sinorhizobium saheli
VMFDGSSIAGWKAINESDMVLMPDPETAHMDPFFAQSTMVIFCDILDPVSGEAYNRDPRGTAKKAEAYLKASGIGDAVFVGPEAEFFVFDDVKYKADPYNTGFKLDCSELPSNDDTDYETGNLGHRPRIKGGYFPVPPVDSSQDMRSEMLTVLAEMGVTVEKHHHEVAAAQHELGVKFDALVRNADKMQIYKYVVHQVANAYGKTATFMPKPIFGDNGSGMHVHLSIWKDGRPTFAGDEYAGLSENCLFFIGGIIKHAKALNAFTNPSTNSYKRLVPGYEAPVLLAYSARNRSASCRIPFGSNPKAKRVEVRFP

SEQ ID NO: 47935 - protein, 314 aa, Rhizobium galegae
VMFDGSSIGGWKAINESDMVLMPDPATVHMDPFFAQSTMVIFCDILDPISGEAYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPIFGDNGSGMHVHQSIWKDGKPTFAGDEYAGLSESCLFYIGGIIKHAKAINAFTNPTTNSYKRLVPGYEAPVLLAYSARNRSASCRIPFGTGPKSKRVEVRFP

SEQ ID NO: 47936 - protein, 363 aa, Legionella pneumophila subsp. pneumophila str. Philadelphia 1
MGFKCGIVGLPNVGKSTLFNALTKAGIEAANYPFCTIEPNVGIVTVPDSRLDNLSDIVKPQQVLHATMQFVDIAGLVKGASSGEGLGNQFLANIRETDAIAHVVRCFDNSDVVHVEGRVDPLSDIEVINTELALADMETLEKSLLKVGKNSKSGNKEAIFELKTLEKIKAHLDAGYPVRTLELTPEEEQVSKRLFLLTAKPVLYIANVDDNGYENNPLLDKVQALASQENASIVALCAATEAELVELDEEDRQEFMVDLGLSEPGLNKVIRAGYELLGLQTYFTAGVKEVRAWTIRKGATAPQAAGVIHTDFEKGFIRAEVISYDDFIRFGGEQGAKEAGKLRLEGKEYIVCDGDVMHFRFNV

SEQ ID NO: 47937 - protein, 314 aa, Bradyrhizobium japonicum
TMFDGSSIAGWKAINESDMCLMPDPVTETIDPFFAETTMVIACDVLEPTTGEPYNRDPRGIAKKAEAMVKSMGVGDSVFVGPEAEFFVFDDVRFSSSPYNTGFRLDSSELPTNTDTEYEGGNLGHRIRTKAGYFPVPPQDSVQDMRSEMLGAMAKMGVKVEKHHHEVASAQHELGMKFDTLTLMADHLQIYKYCVHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFP

SEQ ID NO: 47938 - protein, 544 aa, Schizosaccharomyces pombe 972h-
MGSDGSSLSPKVSQPGHTEIVDHVSEKVITNGKNVNKKVNAEVDGKSMVEKVKTHEENAEDYHYGGYHPVYIGEEFHHRRYVVERKLGWGHFSTVWLAYDRAAKRRVALKVVRSAEHYRETSIDEIRILQKIREGDEKHLGKKHIISLLDYFVHRGPNGAHVCMVFEVLGENLLSLIQSYGHRGVPVGIVKQIAYQLLIALDYLHRECGIIHTDLKPENVLICIDQDALQHIEAPATTSSPTSNTSSSKTRNNTGYTAKAPIIKRGQSVDNSAQERKTFAKNPTKNSKPAGQVIPSSPFTSTLSRFPSLEGAVSEISLRDSQKHNSHPNSPFSSGDNSLILDGVNGSQEPVPKITVKIADLGNACWTRKHFTNDVQTRQYRSPEVILGCRWGASADCWSFACIIFELLTGDYLFDPRNGNSYSKEDDHIAQIIELLVNYPKQMALSGKHSRDLFNRRGELRNIHKLKFWPLKDVLEQKYHFSAELAQQISDFLSPMLCFDPAKRTNAGYMSNSPWLREVADPTFKIETTGATGEDVPGWATEIR

SEQ ID NO: 47939 - protein, 267 aa, Triticum aestivum
AYLGDTLEQVCTKKQAGTGPEFPGYRRPTRPRGVVNELVPYEVRDLLFSGMGYLRSHMSSQHTIIIEETEGWANNQLYDAARAYLATRINTDMQRLRVSRVDETKSMMFSMEEGEEMADVHEGTEFKWRLVCRDNSSASSSNANGRGGSGNFKLKVRSFEMSFHRKHKDKALTSYLPHILAVAKKIKEQNRTLKIYMNEGESWFAIDLHHPSTFSTLAMDHKLKQSVMDDLERFVKRKEYYKKIGKAWKRGYLLYGPPGTGKSSMIA

SEQ ID NO: 47940 - protein, 165 aa, Zea mays
MMASAATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 47941 - protein, 211 aa, Triticum aestivum
  misc_feature (135)..(135): Xaa can be any naturally occurring amino acid
RKPQIKRFKGETRKTGGKGKEERKRGGVRGKKNKRVTWGEQKQPAGLNAREKGGANGKSRRANFLKSKSVEAYLVISKVRKRGIASSRINWGNARGFASQELVKQRPSEFKTTHYRANWARRRMLPLAMAEGLAXSRPSTEDLKTGVIDESHCHYMVVFQYGSIVLFNVSDHEEDGYLKIVKRHASGLLPEMSETIVRATRTNHTVLSASF

SEQ ID NO: 47942 - protein, 365 aa, Oryza sativa Japonica Group
MSAAISGASLVLSSPPAPGARPQPRPARVSVAAAAPAARRGVVAAAAVSSPAVSSSAGKDAKQIPKDFLHIDDFDKDTIMKILNRAIEVKAMIKSGDRSFQPFKGKSMAMIFAKPSMRTRVSFETGFFLLGGHAIYLGPDDIQMGKREETRDVARVLSGYNDIIMARVFAHQDILDLAKYAAVPVINGLTDYNHPCQIMADALTMLEHIGRIENTKVVYVGDGNNIVHSWLRLAALFPLHFVCACPKGFEPDAKTVEIARSAGSKIEITDDPMEAVKGADVVYTDVWASMGQKEEAEYRKKVFQGFTVDEAMMEMAGPNAFLMHCLPAERGIEFLPGGRRVEILEKFTMFRCFGLSDNTILYFSW

SEQ ID NO: 47943 - protein, 284 aa, Francisella tularensis subsp. holarctica
MLKTKSLTPHEYDIIINKATEKPFTGRYNDLDQKSVYICRNCGTPLFRADSKFISACGWPSYDIHIDNNVKQLPDADGIRTEILCSNCDGHLGHIFHGEGYTKLNTRYCVNSACVDFIPIEDFGTTEEIIVAAGCFWGVEYYMKKLPGVLFAESGYCGGDQPYPDYKKVCQGDTGYLEVVRVIFDTSKVSLQQVLKYFFEIHDFEQVDGQGPDIGEQYKSAIFYYDDKQKQIAEDLKHILAQKGYKVATEIRAMKPYYVAEDYHLDYYMKKGTLPYCHSHKKIF

SEQ ID NO: 47944 - protein, 222 aa, Mirabilis jalapa
INTIKAALEVECPLTVSCADIIALSARDGAQLLGGPVIEMRTGRRDSKVSYAAMVQDFIPNHNSSMSLVLSRFGSIGIDVEGTVAVLCAHSVGRVHCVNLVGRLYPTVDPTLDPDYATYLKHRCPTPDPDPEAVVYSRNDRETPMILDNMYYKNLLAHKGLLLIDQELVSDTSTLPYVQKMAADNDYFHQQFSRAMIFLSENNPLTGNQGEIRKDCRFVNAN

SEQ ID NO: 47945 - protein, 535 aa, Chlamydomonas reinhardtii
MSVASAHQHAVVLILDYGSQYTQLITRRVRELSMFSVLFPGDASLDRIKGVNPRVVILSGGPNSVHVEGSPRVPDGFFEYCAEKNVPVLGVCYGMQMITHLLGGEVKPAVHGGEYGRMPMDIAPSSQLFDFLSSSTVNVWMSHGDEAVKLPAGFTAVAKSHQGAIVAIENSERRIYGFQFHPEVMHTEHGMEMIKHFLIGIAAVPADWNMGQVLEEQMAKIKAQVGPDDHVICALSGGVDSTVAATLVHKVLGDRLHCVFVDNGLLRYNEQQRVMDTFKNHLHLPVLCVDHSKPMLDRLRGLSDPEAKRKAIGAEFIEVFKNYANELEKTLGRKPKYLVQGTLYPDVIESCPPPGSGQKHSHTIKSHHNVGGLPKDLQFELVEPFRELFKDEVRAIGRLLGVPDQFIKRHPFPGPGLAVRVIGDVTEDGKLDTLREVDEIFINTIREYGLYDEIWQAFAVFLPIKSVGVQGDQRSHAHVVALRAVTSGDGMTADWYSFTPAFLRDVSNRICNKVRSVNRVVYDITSKPPGTIEWE

SEQ ID NO: 47946 - protein, 243 aa, Picea sitchensis
MNFDNEGSRRGRRIQSDVVGRRTFRRSEPYRPYPHDRNGYGPRSSRPVELCNNCKRTGHYARECPNASVCNNCGVSGHIASKCPKEQLCRNCKKPGHLAADCRNEPVCNMCGKTGHLAKECSAHELGLPKSALCKKCYLPGHIMADCPNDKACNNCRQTGHLARDCVNSPVCNGCGEPGHLVRDCPRVQSPPRIMPPRGGFGGGFGGGFDDFKIIICRVCGGRGHLSVDCPSDPLFMRGGFRR

SEQ ID NO: 47947 - protein, 419 aa, Sulfolobus tokodaii str. 7
MLSRKIIEESDIYLATSTRDPELFPLVIDHGEGVWIYDVDGNKYLDFTSGIGVNNLGWPSHPEVIKIGIEQMQKLAHAAANDFYNIPQLELAKKLVTYSPGNFQKKVFFSNSGTEAIEASIKVVKNTGRKYIIAFLGGFHGRTFGSISLTASKAVQRSIVGPFMPGVIHVPYPNPYRNPWHINGYENPSELVNRVIEFIEDYIFVNLVPPEEVAGIFFEPIQGEGGYVIPPKNFFAELQKLAKKYGILLVDDEVQMGLGRTGKLFAIENFNTVPDVITLAKALGGGIMPIGATIFRKDLDFKPGMHSNTFGGNALACAIGSKVIDIVKDLLPHVNEIGKIFAEELQGLADDVRGIGLAWGLEYNEKKVRDRIIGESFKRGLLLLPAGRSAIRVIPPLVISEEEAKQGLDILKKVIKVVK

SEQ ID NO: 47948 - protein, 482 aa, Shewanella sp. ANA-3
MLLKDPSLLRQQCYINGQWCDAQSKETVAIANPATGAVIASVPVMGQAETQAAIAAAEAALPAWRALTAKERGVKLRRWFELLNENSDDLALMMTSEQGKPLAEAKGEVTYAASFIEWFAEEAKRVYGDTIPGHQGDKRIMVIKQPVGVTAAITPWNFPAAMITRKAAPALAAGCTMVVKPAPQTPFTALALAVLAERAGIPAGVFSVITGDAIGIGNEMCSNPVVRKLSFTGSTQVGIKLMEQCAPTLKKLSLELGGNAPFIVFDDANIDAAVEGAMIAKYRNAGQTCVCANRIYVQAGVYDEFARKLSIAVGKLKVGEGIGEGVTTGPLINCAAVEKVQSHLEDALSKGATVVAGGKPHSLGGNFFEPTVLTNVDSSMRVAREETFGPLAPLFKFTDVDDVIKQANDTEFGLAAYFYGRDISLVWKVTEALEYGMVGVNTGLISTEVAPFGGMKSSGLGREGSKFGIEEYLEIKYICMSV

SEQ ID NO: 47949 - protein, 429 aa, Arabidopsis thaliana
MDCKSSDSSGTDDDLPPSHRVPRGGGGGRGGRVAGNGRPLNLPPSYPKMYDDLAADMEAQIHQIEKEAYISVLRAFKAQGDAISWEKESVITELRKELSLSNEEHRELLGRVNSDDTIRRIREWRQSGGMQPSMRNAAQVVHDTLPSPSVSASMKTHKPNQPIPSQPFASSSPSFHPQADPTHPFASSTAKRGPVPIVKGKKHKPVFPGSSSTKHAPYHPSDQPPRGQVMNRLPSVPASSSEPTNGIDPESFLGRRVRTKWPEDNTFYDAIITQYNPVEGRHALVYDIATPSETWEWVRLSEISPGDIEWIGEDPGLGNRYNGQGHGLNRTTGPNCVPQRGSGLEKNTIRKGFRTSQNGTGKKKHLDIRIRQTDVLIREVERVLRSHNPDPYEVERAKRVLEEHEHALVGAIAKLGDISDGENEGAFRR

SEQ ID NO: 47950 - protein, 802 aa, Zea mays
MHLLAALCGILFSLLHTPTCSAATDTLSRGGSLAGDARLVSSNGKYALGFFETNSNNPTHNASNSYLGIWFHKVPKLTPVWSANGDNPVSSPASPELMISDDGNLVIIADDGTKVWWSTQANITANTTVVVAVLLADGNLVLRSSSNSSDVFWQSFDHPTDTLLPGAKLGRNKVTGLDRRFVSRRNSNDQAPGVYSMGLGPGALDESMRLSWRSTEYWSSGEWNGRYFDAIPEMSGPRYCKYMFVTSGPEFYFSYTLVNESTAFQVVLDVSGQWKVRVWDWDRNDWITFSYSPRSKCDVYAVCGAYGICSNNAGPLCSCMKGFSVRSPEDWEMEDRAGGCIRDTPLDCNATSMTDKFYPMPFSRLPSNGMGLQNATSAESCEGSCLSSCSCTAYSYGQGGCSLWHDDLTNVAADDDTGETLYLRLAAKEVQSWQDRHRHGMVTGVSVAVGVSTATVITLVLVSLIVMMIWRRSSSHPADSDQGGIGIIAFRYADIKRATNNFSEKLGTGGFGSVFKGCLGESVAIAVKRLDGAHQGEKQFRSEVSSIGIIQHVNLVKLVGFCCEGDRRLLVYEHMPNRSLDFHLFHQSAHGGGTTGLRWDIRYQIALGVARGIAYLHHSCRDCIIHCDIKPQNILLDASFVPKIADFGMAKFLGRDFSRVLTTMRGTVGYLAPEWISGTAITSKVDVYSYGMVLLDIVSGRRNAGREASTDGDCCHAKCCFPVQVVDKLLNGGVGSLVDASLGGDVNLDDVERVCRVACWCVQDNEYDRPTMVEVVQFLEGLSEPDMPPMPTFLHAIAGGSP

SEQ ID NO: 47951 - protein, 314 aa, Mesorhizobium tianshanense
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRTKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 47952 - protein, 176 aa, Idiomarina baltica OS145
MDLIKSIRDSIRAIPDYPKPGITFRDISPLLQSKDAFKSTIEAFAQRYQELGIDQIAAVEARGFIFGAALAQRLGCGLTLLRKPGKLPGPVVKETYALEYGEDALEIQECAFKEPQRVLLMDDLLATGGTVAAAAKLLSRTQAELLEAAFVITLDDLPGEQKLQDLGISCYTLCRF

SEQ ID NO: 47953 - protein, 512 aa, Thlaspi caerulescens
MSRLENDRPLLIDRIDEEEEETAYDETEKVHIVRDEDDNERDLEYGVGCGGAPPFSWRKLWLFTGPGFLMSIAFLDPGNLEGDLQSGAVAGYSLLWLLMWATAMGLLVQLLSARLGVATGRHLAELCREEYPSWAGMVLWVMAELALIGSDIQEVIGSAIAIKILTNGILPLWAGVIITALDCFFFLFFENYGIRKLEAVFAVLIATMGVSFAWMFGQAKPSGSELLVGILVPKLSSRTIQKAVGVVGCIIMPHNVFLHSALVQSREVDKRQKYRVQEAINYYTIESTLALFVSFLINLFVTTVFAKGFYNTDLADSIGLVNAGQYLQDKYGGGLFPILYIWGIGLLAAGQSSTITGTYAGQFIMGGFLNFRMKKWMRALITRSCAIIPTIIVALVFDSSEATLDVLNEWLNVLQSIQIPFALIPLLCLVSKERIMGSFKIGPLCQTIAWLVAALVIMINGYLLVEFFSSEVSGIVYTGFVIVFTASYGAFIVYLIARGINFTPWRPKAESS

SEQ ID NO: 47954 - protein, 523 aa, Triticum aestivum
  misc_feature (426)..(426): Xaa can be any naturally occurring amino acid
MARGGGNGEVELSVGVGGGGAGAGGADAPAVDISLGRLILAGMVAGGVQYGWALQLSLLTPYVQTLGLSHALTSFMWLCGPIAGLVVQPCVGLYSDKCTSRWGRRRPFILTGCILICIAVVVVGFSADIGAALGDSKEECSLYHGPRWHAAIVYVLGFWLLDFSNNTVQGPARALMADLSAQHGPSAANSIFCSWMALGNILGYSSGSTNNWHKWFPFLRTRACCEACANLKGAFLVAVLFLAFCLVITVIFAKEIPYKAIAPLPTKANGQVEVEPTGPLAVFKGFKNLPPGMPSVLLVTGLTWLSWFPFILYDTDWMGREIYHGDPKGTPDEANAFQAGVRAGAFGLLLNSVVLGFSSFLIEPLCKRLGPRVVWVSSNFLVCLSMAAICIISWWATQDLHGYIQHAITASKEIKIVSLALFAFLXGIPLAILYSVPFAVTAQLAANRGGGQGLCTGVLNIAIVIPQVIIAVGAGPWDELFGKGNIPAFGVASAFALIGGIVGIFLLPKISRRQFRAVSGGGH

SEQ ID NO: 47955 - protein, 500 aa, Salinibacter ruber DSM 13855
MEVGSNEVKGKIVEVLGPVVDAEFPRDGVPDILDALRIEREDSRDLILEVQQHLGERRVRAIAMDSTDGLQRGQAIAATNQPISVPIGEEIRGRLFNVVGQPIDGLPEPDVDERRAIHQDPPEYNELTGSQEVLETGIKVMDLIQPVPKGGKVGLFGGAGVGKTVLIMELINNIAKAHEGLSVFSGVGERTREGNDLLREMIEAGVMTYGEEFRESMESGGWDLDKVDFDEMNSESNISLVFGQMNEPPGARARVGLTGLTIAEYFRDLGGRDVLFFLDNIFRFVQAGQEMSALMGRMPSAVGYQPTLASEMGDLQERITSTQEGSITSFQAVYVPADDLTDPAPATTFAHLDCTTVLSRQLSTQGIYPAIDPLDSTSQMLNERALGTEHYETAQDVKEILQRYEELQDIIAILGMDELSDEDKQAVNRARRVQRFLSQPFFVAEQFTGQPGKYVPIEETIRGFRMILDGELDHLPERAFLLKGTIDEVIEAGEEMAEEA

SEQ ID NO: 47956 - protein, 351 aa, Schizosaccharomyces pombe 972h-
MATSGIQTKVPGIVSGFIGAIGRTPLIRLNTLSNETGCNILAKAEFQNPGGSVKDRAAYYVVRDAEKKGKLSRGGTIVEGTAGNTGIGLAHIARARGYKCVIYMPNTQSQAKIDTLKFLGAEVHPVPVAPFSNPLNYNHQARRHAESTPNASWTDQFDNVANLLSHYETTGPEIWDQTKGTVDGFTCSTGTGGTFAGVTKYLKEKSDGRVASFVADPPGSVLYSHIKTKGKHPDNKGSSFTEGIGQGRITGNVQPVYDLIDDAMKIPDEKSINMFFRLLDQEGLFLGGSSCLNVVAAVEMAKILGPGKTVVTILCDSGHKYATRLFSRSFLESKKLFDVIEPQYKKYIVLP

SEQ ID NO: 47957 - protein, 325 aa, Campylobacter jejuni subsp. jejuni NCTC 11168
MIKSIPEWSEQEYLMLSLPHEKSDWNPYLEEILQSYKEFVKVVSEFQKVLLIAPKQSDFENFKDIKNVEFFKCDTNDTWIRDFGAIDIVENGRLKALDFTFNAWGNKFQSELDNAVNSKLFKEKFKEELKKVDFILEGGSIDFNGEGVMLTSSHCLLNENRNSHLNKTQIDTKLKEIFGLKQIIWLENGFIKGDDTDHHIDTLARFIDKNTIAHCICEDEEDEHYLPLQKMKEELKKTGFDLLELPIPKPLYYEERRLGATYANFVFINNALIVPFYKDKNDEIIAKRLSKALPNHKIIGVDARVFLRQNGSLHCSCQNRFKGLR

SEQ ID NO: 47958 - protein, 345 aa, Corynebacterium efficiens YS-314
MVSMTHVPSGHISPAPVPPVPDPSGEEKENRSAALIVVAFPAFILIGAIVAFMFPATFAPLTNYINLFLTIIMFTMGLTLTVPDFQMVLKRPLPVFIGVVAQFVIMPGLAVLVAKMMGLNPALAVGLLMLGSVPGGTSSNVIAFLCRGDVALSVTMTSVSTMVSPIMTPILMLLLSGTATEVDGAGMAWSLVQTVLLPVVIGLTLRVFLSRWINRIMPVLPWLSILGIGGVVFGAVANNAERLLSVGLIVFAAVIVHNVLGYVLGYYTGRLFRFSEPVNRTMAVEIGTQSAGLASGMAGRFFSPEAALPGAVAAVVHNITGAIYTAIVRNRPVEPVAVPEKVAVG

SEQ ID NO: 47959 - protein, 285 aa, Arabidopsis thaliana
MQSQTVDVVKRLKEITQVLQTPQQVLEAHEVTPQDIEGLLDELQEHVESIDMANDLHSVGGLVPLLGYLKNSNANIRAKSADVVSTIVENNPRSQESVMEANGLESLLLRFTSDTDMHSRTQALGAISSLIRNNKPGITGFRIANGYSGLKDALETDSVRFQRKALNLLHYLLQENDSDSDIAIEFGLHHLMMHLVSSFDADVREAALRGLLELVKARKDCSTCGSSIVKGDERLRQILKDRIKAISRVKAMSLFMSQEDLSAAKEERQLLDSLWTTIFNEPSSL

SEQ ID NO: 47960 - protein, 470 aa, Moritella marina
MKKTKIVCTIGPKTESVEKLTELVNAGMNVMRLNFSHGNFAEHSVRIQNIRQVSENLNKKIAVLLDTKGPEIRTIKLENGDDVMLTAGQSFTFTTDINVVGNKDCVAVTYAGFAKDLNPGAIILVDDGLIEMEVVATTDTEVKCTVLNTGALGENKGVNLPNISVGLPALSEKDKADLAFGCEQEVDFVAASFIRKADDVREIREILFNNGGENIQIISKIENQEGVDNFDEILAESDGIMVARGDLGVEIPVEEVIMAQKMMIKKCNKAGKVVITATQMLDSMISNPRPTRAEAGDVANAVLDGTDAVMLSGETAKGKYPVEAVSIMANICERTDNSMSSDLGANIVAKSMRITEAVCKGAVETTEKLCAPLIVVATRGGKSAKSVRKYFPKANILAITTNEKAAQQLCLTKGVSSCIVEQIDSTDEFYRKGKELALATGLAKEGDIVVMVSGALVPSGTTNTASVHQL

SEQ ID NO: 47961 - protein, 365 aa, Pinus sylvestris
QMGLAENQLSIDMLELWLKEHPEASMSLNQDAGTSVFRELALYQDYHGLPTFRKAIANFMESLRGNKVKFDAESIVLTAGATAANELLMFCLADPGDAFLVPTPYYPGFVRDLRWRTGVEIVPVHCDSSNRFQITKSALERAYLEAQNQKLKVRGLIVTNPSNPLGTTLSVKALRNLLAFVQEKKIHLVCDGIYSGSVFSPPRFHSISEILPNDNHICDNVHIVYSLSKDLGLPGFRIGAIYSYNNTAVKTARRMSSFCMVSSQTQHMLSALLSDFKFMNHFISENQKRLRERHRFLVSGLQKAGITCLKSNAGLFCWVDMRHLLPSPDVNGELMLWQSILDEAGLNISPGSSFHCKEPGWFASR

SEQ ID NO: 47962 - protein, 495 aa, Pseudomonas fluorescens Pf-5
MSVAIDPRVAAFIDSQHGLLIDGHSQPALSGARMAVYNPASGEQLAEVAAAAQADIDLAVNAARRAFEGSWKAQRPADRERLLLKLADLLEANGEELAQLETLNNGQSIHLARALEVGAAAEFTRYMAGWATKIEGKSLDVSIAAVPGAQYRAYTVPEPVGVVGAIVPWNFPLLMAIWKIVPALACGCTVVLKPADETPLTALRLGQLCLEAGIAPGVVNVVTGSGAQAGAALAAHSGIDKLAFTGSTQVGKLIGHAAVDNMTRFSLELGGKSPVIVLDDCDPQTAAAGAAGAIFFNQGQVCTAGSRLYIQRRIYNEVLERLVAIAGSLSIGPGLDEQAQINPLISAKQQKRVLQMVQRGVEEGARLLCGGVAHGERGFYVRPTVVADVHADQQLVREEIFGPVVVATPFDTLDEVVGLANDNQYGLGASIWSNDLGRVMQLIPQIKAGTVWVNTHNMLDPSMPFGGYKQSGIGREMGHAAIEAYTENKSVCIAY

SEQ ID NO: 47963 - protein, 365 aa, Pinus sylvestris
QMGFAENQVSFDLLEAWLDEHPEASICQEGKTTFRDTAPHQDYHGLPAFRESLARFMELVRGGKVRFDPDRIVLTAGATAANELLMFCLANPGEAFLVPTPYYPGFDRDLRWRTGVEIIPVHCNSSNDFQVTSSALEEAYHEAKQKNIRVKGILVTNPSNPLGTTMERKTLKNLLSFASEKNIHLICDEIYSGSVFLPPRFRKYAEVLQASGRPNDSDRVHIVYSLSKDLGLPGFRVGAIYSYNDTVVTTARRMSSFSLVSSQTQHFLACMLSDEDFTKKYIKENKKRLRKRHRIMVSGLQKVGISCLKSNAGLFCWVNLTQLPPSENIDGEIKLWETILYEMGLNVSPGSSCHCIEPGWFSVCF

SEQ ID NO: 47964 - protein, 583 aa, Picrophilus torridus DSM 9790
MAEVSVSYKRDLGLVNLIMLNAMGMIGSGWLFAELYASSYAGSLGSIIAWLLGGFIVLMIALTYMEVSSAFPLAGGSTPIGEMTHGKLVGFIAGWGAWISDIMTPPIEAIAMVTYASAFIPGLVNRHGILLTDGYIFAVAIMIIVLLVNLLSVRVFGNAMSILMIWKWLIPLLVIVTLIPLAFHPANLTTYNPFYAGYHGIFYALVLGGIIFSFEGFRAAVNMAGEARRKDYIWKSVIISLLLVIALYTLLQVAFVGAVRWSVIGIKPGDWGAITSTSLTNGPFARIAYDIGFGWLAVILLVDAVISPGGAGISYAAYPARIFQSMANYGYAPKFFSKLDRKGVPSRALILGFFLGLAFIYEFPGWDLLVGILTSTLVIAYVVGPASINILRRTAPDVERPFTLRGSSVIAPVAFIFTFLVIYWSGWPLSGEVVIVTLAGLLMFFFLYLLSGNEKFSRNESYMFFLSMVVPFLFSLILVLYYTYSWPVYVIYIDIVLFIVSIYSYLRLSGKTDIISGSWYVYMLLAAMILSYIGPAAYGGINIIKFPYDFIADGIIALIFYIVAQATGHRTKSLEDYVNTSNE

SEQ ID NO: 47965 - protein, 464 aa, Burkholderia xenovorans LB400
MSTTALVEGKIVQCIGAVIDVEFPRDHMPKIYDALILEGSELTLEVQQQLGDGVVRTICLGASDGLRRGTTVKNTGKPISVPVGKPTLGRIMDVLGRPIDEAGPINSDVVRGIHQKAPAFDELSPSTELLETGIKVIDLICPFAKGGKVGLFGGAGVGKTVNMMELINNIAKEHGGYSVFAGVGERTREGNDFYHEMKDSNVLDKVALVYGQMNEPPGNRLRVALTGLTMAEHFRDEGLDVLFFVDNIYRFTLAGTEVSALLGRMPSAVGYQPTLAEEMGKLQERITSTKTGSITSVQAVYVPADDLTDPSPATTFGHLDATVVLSRDIASLGIYPAVDPLDSTSRQIDPNVIGEEHYSITRGVQQTLQRYKELRDIIAILGMDELAPEDKLAVARARKIQRFLSQPFHVAEVFTGSPGKYVPLKETIRGFKMIVEGECDHLPEQAFYMVGTIDEAFEKAKKIQ

SEQ ID NO: 47966 - protein, 214 aa, Picrophilus torridus DSM 9790
MVEVSPSIISSDLSHLYDEIKRCEDAGAGSFHLDVMDGHFVNNITMGPDLIKAIRKSTGLRLDAHLMIERPDKYYKSFLDAGADVLLIHYESPVNTMELLKKFHRENIRYGIVINPETNFERVKPLIENAEILLIMSVNPGFSGQKFIDDSLIKVSQAKEFIRANNLKTRIEIDGGINDETGRLAANAGADILVSASFIFKNGVINPIKTLKNF

SEQ ID NO: 47967 - protein, 444 aa, Pseudomonas fluorescens Pf-5
MSEPSRFWHPMLHPNEMKQREPIRIVRGDGCYVYDDKGHQLVDGVAGLWNVNVGHNRKEVKAAITAQLDELEYFQLFDGVSHPRAEELSRVVMNLLEPEDMRRVAFSSGGSDAIESALKLARQYWKLEGQADRTKFISLRQGYHGTHFGGASVNGNTVFRRNYEPLLPGCYHIDTPWLYRNPYSQDPEELGKICADLLEREIQFQSPDTVAAFIAEPIQGAGGVIVPPANYWPLIREVCDKYGVLLIADEVVTGFGRSGSMFGSRLWGVKPDIMCLAKGITSGYIPLGATVVNRRIEEAFEKNANFTGAIMHGYTYSGHPVACAAALACLDIVVKEDLPANAAKMGDYMLDKLLPFVERFDTVGEVRGKGLMLALDLVADKTTREPIDPMSGYANQVAQIARDNGVMVRPVGTKIILSPPLVIQQAQADAIVDALAEGLSKARR

SEQ ID NO: 47968 - protein, 266 aa, Zea mays
  misc_feature (182)..(182): Xaa can be any naturally occurring amino acid
MPPAAAALLRCAPAVPFAARSSAVSRSGMARRLVAASAAAGRLAPAYRGLLLDAGGTLLQVARPVAETYASIGRRYGVTKTKKRIMEGFKRAFSAPWPKTLRYQGDGRPFWRIVVAEATDCTDGDYFEEVYQYYAHGDAWRLPTGADAALRELKDAGVKLAVVSNFDTRLRKLLKDLNVSEXLELFRFDAIVVSSEVGYEKPSPEIFNIALDQIGVEASKAIHVGDDETADMAGANATGLECWLWGKDVTTFSEIQERILTTDGPQ

SEQ ID NO: 47969 - protein, 132 aa, Nicotiana tabacum
PHVIGDAPAYPGVEHVGGDMFASVPKADAIFMKWICHDWSDEHCLKFLKNCYEALPANGKVIIAECILPEAPDTSLATKNTVHVDIVMLAHNPGGKERTEKEFEALAKGAGFTGFARLVALTTLGSWNSTNN

SEQ ID NO: 47970 - protein, 498 aa, Shewanella sp. ANA-3
MSTPKKRSDWESLAASLAINGKAYINGEYRDAAAGSTFDCVSPIDGRVLAKVASCDQMDANIAVANAREVFESGVWSKTAPVKRKQVMIRFAELLEENANELALLETLDMGKPIRFSKAVDIAGAARAIRWSGEAVDKLYDELAPTAHNEIGMITREPVGVVAAIVPWNFPLLMACWKLGPALATGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIAFNQGEVCTAGSRLLVESGVKDQLIELIAEELASWQPGHPLDPATVSGAVVDKQQLDTILSYIKAGQDEGASLVHGGQQVLAETGGVYVQPTIFSQVNNKMKIASEEIFGPVLSVIEFNGMEEAIAIANDTIYGLAAGVWTADISKAHKTAKALRSGMVWINHYDGGDMTAPFGGYKQSGNGRDKSMHSFDKYTEIKATWIAL

SEQ ID NO: 47971 - protein, 446 aa, Shewanella sp. ANA-3
MADSPYNTTHEHPSLEHYWMPFTANRQFKASPRLLAQAEGMYYTDINGNKVLDSTAGLWCCNAGHGRREISEAVSKQIREMDYAPSFQMGHPLAFELAERLTELSPEGLNKVFFTNSGSESVDTALKMALCYHRANGQASRTRFIGRELGYHGVGFGGISVGGLSNNRKAFSGQLLQGVDHLPHTLDIQNSAFSRGLPSLGAEKAEVLEQLVTLHGAENIAAVIVEPMSGSAGVILPPQGYLKRLREITQKYGILLIFDEVITAFGRVGAAFASQRWGVIPDIITTAKAINNGAIPMGAVFVQDFIHDTCMQGPTELIEFFHGYTYSGHPVAAAAALATLSIYENEQLFERSFELERYFEDAVHSLKGLPNVIDIRNTGLVAGFQLAPNSQGAGKRGYSVFEHCFHQGTLVRATGDIIAISPPLIVEKHQIDQIVNSLSDAIHAVG

SEQ ID NO: 47972 - protein, 296 aa, Oryza sativa
RSEFRVDHASRTRGLSSSSDPRNGGAASARAGARGASPEVFRLGFIGPGNLAESIARGVAASGVLPATAIRTAPHRRPERAEAFSSIGAHILETNAQVVDDSDVIVISVKPQIVRQVLVELKPLLSEEKLLVSIAAGIKMEDLQGWSGHRRFIRVMPNTPSAVGQAASVMCLGEMATENDENRVRSLFSAIGKVWTAEEKYLDAVTGLSGSDPAYIFLAIEAMADGGVAAGLPRDLALGLASQTTGKHPGQLKDMVTSPAGTTITGIQELEKGAFRGTLINAVVAATKRCRELSQS

SEQ ID NO: 47973 - protein, 496 aa, Shewanella sp. ANA-3
MLTMTHYVNGEHTAASTRSQEIFEPATGECRGQVSLASRDEVSAAIAIAKSAFDTWSQVTPLNRARVLFKFKALVEQHMDELAQLITLEHGKVLDDARGELIRGLEVVEFACGIPHLLKGEHTEQVGGGVDAWSVNQALGVVAGIAPFNFPVMVPMWMFPIAIACGNTFIMKPSEKDPSAVMRIAELLTQAGLPAGVFNVVNGDKEAVDTLLSHEDIQAVSFVGSTPIAEYIYSTASKHGKRVQALGGAKNHMLLMPDADLDQAVSALMGAAYGSAGERCMAISVVLAVGDVGDKLVDKLLPQIQQLKVGNGLTPEMEMGPLISRQHLAKVTEFVDAGVKEGATLVVDGRQLTVADHQQGYFLGACLFDNVTPEMRIYREEIFGPVLSIVRVKDYASALALINQHEFGNGTAIFTQSGEAARHFCHHVQVGMVGVNVPIPVPMAFHSFGGWKRSLFGPLHMHGPDGVRFYTKRKAITARWPVGKQTQAEFVMPTMK

SEQ ID NO: 47974 - protein, 332 aa, Glycine max
  misc_feature (287)..(287): Xaa can be any naturally occurring amino acid
MAPKGLIFLAVLCFSALSLSRCLAEDNGLVMNFYKESCPQAEDIIKEQVKLLYKRHKNTAFSWLRNIFHDCAVQSCDASLLLDSTRRSLSEKETDRSFGLRNFRYIETIKEALERECPGVVSCADILVLSARDGIVSLGGPHIPLKTGRRDGRRSRADVVEQFLPDHNESISAVLDKFGAMGIDTPGVVALLGAHSVGRTHCVKLVHRLYPEIDPALNPDHVPHILKKCPDAIPDPKAVQYVRNDRGTPMILDNNYYRNILDNKGLLIVDHQLANDKRTKPYVKKMXAKSQDYFFKEFSRAITLLSENNPLTGTKGEIRKQCNAANKHHEEP

SEQ ID NO: 47975 - protein, 479 aa, Coccidioides immitis RS
MGSGTPEKKRKRASEKHDRPSKKPAIESVMPPLKVKFIENDAGPVPVIASTPGIRLPESLSLQAYTKPRAKRASTTATTNSDVISSELLLHSSSHPKLDFTAREGVDQLDSLWNHYVAIYDPKRNALQLVEARKVTVRSSLREAVPDEEEESDEEVKTAFSKRSALAEAFGTKQSRKAIQSIAENALLSNAPGGAPNAAESALLSSMPKDEISTVPAEKTAQQEIQAAKPLPQPNLSAQHPSDVYSLDSLIPGGLSTLHSMPIRDWQNSLAKSEAILTRSRFVSRRVEAVGKSGDKTQLQLLRFILLLIEFAGSLKPTRGADKASPGSKKLPLREDLRRKLSEATNPKNSTAPQFVTDSLIDSLRRKFVPQGAILARNDITFLLTTICALTLHIPPASGAPHAPNELATDPADLRDDLSLENQTALQYFKELGCRIDKPRESEYAKWGIKKGKTEAAMKRIARLRIPVEFPKVSRGGRR

SEQ ID NO: 47976 - protein, 250 aa, Arabidopsis thaliana
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITVITGVFYWIAQLLGSTAACFLLKYVTGGLAVPTHSVAAGLGSIEGVVMEIIITFALVYTVYATAADPKKGSLGTIAPLAIGLIVGANILAAGPFSGGSMNPARSFGPAVAAGDFSGHWVYWVGPLIGGELAGLIYGNVFMGSSEHVPLASADF

SEQ ID NO: 47977 - protein, 468 aa, Coccidioides immitis RS
MFSKALKSFPPRANWAMKPQVLQARFMASVAKGTPKPNSAIFAPERATFTIRDGPVFHGKSFGAKKNISGEAVFTTSLVGYPESLSDPSYRGQILVFTQPLIGNYGVPSAEKDENGLLKYFESPSLQAVGVVVADVAEKYSHWTAVESLSEWCIREGVPAISGVDTRAIVTYLREQGSSLAKISVGEEYDADQDEAFVDPEQINLVAKVSTKAPFHINPGNSNAHVAVIDCGVKENILRSLVHRGASITVFPYDFPIQKVAHHFDGVFISNGPGDPTHCQKTVHNLRKLMEVSQLPIMGICLGHQLLALAAGARTIKLKYGNRAHNIPALDLTTGRCHITSQNHGYAVDASTLPSDWKPYFVNLNDSSNEGMIHKTRPIFSTQFHPEAKGGPLDSSYLFDIYLDSVQKYKQSQAAFQPGRDSRPSPLLADLLGNERVGVQTTIGTQSTPESVAPVLETPISPTMAAAA

SEQ ID NO: 47978 - protein, 399 aa, Candida tropicalis
MMNIDQHHQQLQQQSQAQAQAQAQAQAQAQAQAQAQAQAQAAAAAVAASSQRQVSFNVSDHYQILEIVGEGAYGIVCSAIHKPSNQKVAIKKIEPFERSMLCLRTLRELKLLKHFNHENIISILAIQRPLNFESFNEIYLIQELMETDLHRVIRTQNLTDDHIQYFIYQTLRALKAMHSANVLHRDLKPSNLLLNSNCDLKVCDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFQELFSNKPGINPLALDLLEKLLIFNPAKRITVEDALKHPYLQLYHDPNDEPISDKIPEDFFDFDKKKDSLTIEDLKKMLYEEIMKPL

SEQ ID NO: 47979 - protein, 393 aa, Erythrobacter sp. SD-21
MLDTLSAQAPDALLALIKMHADDSREDKIDLGVGVYRTNEGATPVFRAIKQAERKLLEVQDSKSYLGPEGDGGFVKALMPYIFGDKSPLASRIEGMQTPGGTGAVRLAVALAVKAGVKRIFLGVPSWPNHAQILEDVGVEIVTFNHASDDGTADLDAVLGAIRDAKGDGAVLLHGCCHNPTGIDYTDAQWAAIADAFAQDGVLPILDIAYQGLGQGMEEDVAGVRTVLAKVPEALIAYSCDKNFGLYRDRVGAFYMMAREEGQLAAIASNANALARANWSMPPDHGGAAVRLLLEDEGMTAIWLEELDEMRARMRRVRDRLGAADNEVPGLGLAALAEQNGLFAMLPLTKDQIATLREDHAIYMAGSGRINVAGLHADNIDKFIAALGNVTKG

SEQ ID NO: 47980 - protein, 145 aa, Bacillus halodurans C-125
MKKGSITFENGEKIVIEFYPEAAPGTVENFEKLAKEGFYDGLTFHRVIPGFVAQGGCPIGNGTGGPGYTIKCETEGNPHKHVAGALSMAHAGKDTGGSQFFIVHEPQPHLDGVHTVFGQVIEGMDTVLRIRQGDVMQEVKVWDEE

SEQ ID NO: 47981 - protein, 325 aa, Aspergillus oryzae
MAAPSSKYDNYDFPTTAPVAQPGHPGHTTPEQDAKVEQLRSELEQLGYTERLDTLTLLRFLRARKFDVANAKTMFIECEKWRKEFGTDDLPRTFDYKEKPEVFKFYPQYYHKTDKDGRPVYIEKLGKIDLNAMYKITSAERMLQNLVTEYEKLADPRLPACSRKAGKLLETCCTIMDLKGVGITSIPSVYGYVRQASGISQNYYPERLGKLYLINAPWGFSGAFNAVKGFLDPVTVEKIHILGSNYKKELLAQVPAENLPEDIGGTCKCEGGCELSDQGPWQDPEWAKAPKWATPKEDQNVVKNEDPGLEQKVETQEASQPQPTA

SEQ ID NO: 47982 - protein, 464 aa, Vitis vinifera
MAKRPEPDDDDFSEIYKEYTGPPRSTTSNVQDKAKTSKRSHASSDEEEEPRDPNAVPTDFTSREAKVWEAKSKATERNWKKRKEEEMICKICGESGHFTQGCPSTLGANRKSQDFFERVPAREKHVKALFTEKVIHKIEKDIGCKIKMEEKFIIVSGKDRLILAKGIDAVHKVIKEEGNKKASSTSHMNRSRSPERSPVGPRFGRSESQKSHPSPQNIAQFQQRFGRQERVVEDRIRDDMQKLSRGSPQAYGNDGARGRSSHSKSPAQPPYTGSSYNSYDGHNQSVGVYRNDGWDTERRGSDMQSGRKFEYPAAPQTLEELELEYKREAMDLGRIRDKEEDEENYKHREAVREMRENYMKKLAILRGTHAKQWEEFLQLDAERQHQRARQQMSSSGFGGYKQASYSDYDGSSANPHYAGANIPMDSRGRYPNPVENYPPSRPHDTYSEFQRQRREDFGKAYHRY

SEQ ID NO: 47983 - protein, 371 aa, Picrophilus torridus DSM 9790
MIKIGIVGKPNAGKSTLFSAITQIDVDIADYPFTTIKPNVGISYIKSKCPHTEINVQCNPREGKCIDGTRYIPVEIIDVPGLIEGASEGKGMGNQFLDNIRDSDIIINLFDASSDYKNDISMVRNEIIKWISSKIYDNWQKFSRKEDASGDRLALKLLKKLATFGINEKQVEYLITKVNMPQQLSVWTEDDVIELSNAILKYIKPVFDVGNKADLLNESNIKKLEYPVISAGYELALARAYRNGYIDRYSRDFKISDKCNGQQRAVLNSIHEFYEKNTMFDDVISGIVNSLGYIIVYPVYDETKWTDKNGNVLPDAFIMRDGDTALDLAFKVHSEIGENFIKAINGRTHRIIGKDYKLINNDVVKIVSGSR

SEQ ID NO: 47984 - protein, 140 aa, Vitis vinifera
MRYEHHVSFCGNLIETTATNKASIADDWVHQILSMYRGQHLIIGLDCKRRPHPITSMGGRTATMQLCVGSKCLILQLLYMDYIPKSLKSFLSNPDITFVGVEVEENVLRLWGEYGLWCTDAADVHELASRSFPLGFKDLG

SEQ ID NO: 47985 - protein, 615 aa, Legionella pneumophila subsp. pneumophila str. Philadelphia 1
MKSTDPIKIAVLPGDGIGIEVTEATLPVFEVLDVPVILNYGDIGWEFWKKEGAAIPSRTWQLIASSDTVLLGAITSKPQREAKQELSNALKKSNPYYVSPVIQLRQGLDLFANVRPCFSIDDQSKPFNFCIIRENSEGLYCGFDYFPLPKAIHSLLAESQHWQTIPADEASCALRLQSKSGLTRLFDFAFKHAMQTGMPRVTLADKPNVLRESGEFTRKIFESTAQRYPKIQADILNVDAVALWLIKSPEKFGVIVAENMFGDILSDVGAGVMGGLGLAPSANIGDKGSYFEPVHGSGPRIRKNCANPSAMFLTISMLLNHFGYPDRAKKIVNAVMQVIKEKRFITYDLGGHATTTDMANAVIEHCARLNASCLSKDFNPTPKENLIESDTMPNLLQQLINCNSAEISDALDACGIEGGLLSIKPLSQGMKIIGPAYTIQYLPREKKGTAFHNAANYIDKVPKHSVIVIDNNGQIDCTVWGDLLTHTALRNNIMGTVVHGAVRDVESIRSTNYPVFCTGIYMCSGKNRVYKANEQCPLSINGVTINPGDIIFADDNGVLVIPNDRLQEVVNKTIAIRLTEERIKTAIASGSTLEQAREDYCYEQPWLGINKKRES

SEQ ID NO: 47986 - protein, 509 aa, Mesorhizobium sp. BNC1
MDGTPVHDILVIGGGINGCGIARDAAGRGYSVFLAEMNDLGSGTSSGSTKLIHGGLRYLEFYEFRLVREALLEREVLWRNAPHIIWPMRFVLPHNEGLRPAWLLRLGLFLYDHLGGRKLLPKTRTIDMRIDAAGKPLKPLFSRAFEYSDCWVDDARLVVLNARDAADRGAVIATRTEVVDARREDGRWRATLRDVSSGARSEVRARLVVNAAGPWVDKVLASAMGRNEVHNVRLVKGSHIVVPKVSDDPRAYFFQNRDGRIIFAIPYEDDFTLIGTTDQDYDGEPRDAAISPAETDYLCAAASEYFARPVRREDIVWTYAAVRPLFDDGASKAQEATRDYVLRVEEGDGDAALVNIFGGKITTYRRLSEATLEKIEELLGRKGQAWTADARLPGGDFAVDGFDGQIAGLLRDYPFLNAGHARRLVRRYGTRARAILGQARSTDDLGVHFGADLYEAEVRYLMEQEWARTAEDVLWRRTKRGLRLAPNEVVTLEEFMEDLASRRRHEAAE

SEQ ID NO: 47987 - protein, 577 aa, Magnaporthe grisea 70-15
MDKTELGAAGVHPVTSNAAGSQEKVTIQEDNKRGEDWYTRNGLNLRSFQRRDEDSGTGTAELDRTMKGRHLHMIAIGGSIGAGFFVGSGGALGSGGPGSLLINFLIIGVMMFNVVYALGELSIMYPVSGGFYTYSARFIDPSWGFAMGWNYVFQWAIVLPLELTVCGITISYWNDSISVGVWITVFWLAILIINIFGTLGYAEEEFASSAFKLLATCIFLVIAFVLVLGGGPKDGRYNEYWGARLWVDPGPFQNGFRGFCSVFVTAAFAFSGTELVGLAAAEARNPVKEMPGAIKQVFWRITLFYILGLFFVGLLIDARDPNLLGSSSHDVHASPFVLVGKYAGLKGFDHFMNITILVSVLSIGVSAVYGGSRTLTALSQQGYAPKIFSYIDRSGRPLYSVGIILVFGLLAYVNLNAQGEVVFNWLLSLSSLAALFTWGSICLAHIRFRKAWAHNGHTTDEIPFKAIGGVWGSYLGLTLNILVLAAQIFAAIAPPPKAGEEPTFSDAEGFFSAMLALPIVILFWIIGYLWKREGWLKTEQIDVDSGRRELPWDEINAYRAELAAMPAWKRIVHTVFV

SEQ ID NO: 47988 - protein, 295 aa, Nicotiana tabacum
KGGIRYHPEVDLDEVNALAQLMTWKTAVADIPYGGAKGGIGCKPKDLSRSELEPLTRVFTPKIHELIGINTDVPAPDMGTNAQTMAWILDEYSKFHGHSPAIVTGKPIDLGGSLGREAATGRGVVYATEALLAEYGKNIKDLTFAIQGFGNVGAWAAKLIHERGGKVIAVSDITGAVKNPNGLDIPALLNHKEATGKLIDFCGGDVMNSDEVLTHECDVLIPCALGGVLNRENADNVKAKFIIEAANHPTDPEADEILSKKGIVILPDIYANAGGVTVSYFEWVQNIQGFMWDEE

SEQ ID NO: 47989 - protein, 295 aa, Nicotiana tabacum
KGGIRYHPEVDPDEVNALAQLMTWKTAVANIPYGGAKGGTGCSPSDLSISELERLTRVFTQKIHDLIGIHTDVPAPDMGTNPQTMAWILDEYSKFHGYSPAVVTGKPIDLGGSLGRGAATGRGVLFAAEALLRDHGKSIAGQRFVVQGFGNVGSWAAQLITEQGGKIVAVSDITGAIKNKNGIDIASLLKHVKENRGVKGFHGADSIDPNSILVEDCDVLIPAALGGVINRDNARDIKAKFIVEAANHPTDPEADEILAKKGVVILPDIYANSGGVTVSYFEWVQNIQGFMWDEE

SEQ ID NO: 47990 - protein, 124 aa, Gibberella zeae PH-1
MSESAAWPLADQKLEQELLDLVQSSQHARQLKKGANEATKTLNRGVSELVVLAADTQPLAILLHLPLLCEDKNVPYVYVSSKMHLGRACGVSRAVIAASITSNDASELAGQIRAMRDKVERLAI

SEQ ID NO: 47991 - protein, 182 aa, Picea sitchensis
MLLSRAVRSLGRVVRAGEQASKIRLPAAAPAVLNNHSRGYHERVVDHYNNPRNVGSFNKNDPNVGTGLVGAPACGDVMKLQIKVDEETGQVTDACFKTFGCGSAIASSSVASEWIKGKKIEHVISIKNSDIAKHLSLPPVKLHCSMLAEDAIKAAVKDYEVKKAKREQNSESASNKDVAGTA

SEQ ID NO: 47992 - protein, 309 aa, Yarrowia lipolytica CLIB122
MTSIDFTMNNGKTIPAIGLGTWKSTTEEVAGAVECALTEGGYRHIDTAFNYRNEDAVGLGIKRAMEKGVKREDIFVTTKIWVTYHDRVEENLNMSLERLGLDYVDMLLIHWPVPLNPNGNDPVYPLRPDGSRDIDESGSQPKTWKQMEAVLKTGKTKSIGVSNFSIPYLQELLKEATVVPAVNQVELHPLLPQLELMEFCKKNNIIMTAFSPFGSVGGPLLKNELVLKLADKYETSPGGILTSYHIGNGTVVIPKSVTNSRIIENGKSAVNLSKEDLQALNDLHKTEGIHRTSKPKWGVDLGFPDFDFC

SEQ ID NO: 47993 - protein, 822 aa, Oryza sativa Japonica Group
MTPLNNLCNFRVKKQYYNPRCLIPAVSLLLFVVILTVSNTYFPFPTTKSRTLSYSSFSSSPGGQKAADEACNIFRGEWVPDPDAPYYTNNTCSVIHEHYDCMKYGKPDLGFVQWRWRPDSCDLPRLDPARFLSSMRGKTLAFIGDSLARNHMNSLICLLTRVAEPTTSWPSSEHTVYHYGGGYNFTVLSFWAPFLVQNELVDADGPAHTGLWNLYLDEPDAVWAPHVPAFDYAVVSASSWFYRPSMLYEAGRLVGCHHCLLPNVIDLTLRYALRMATRAALRAVVGGGGGGGVTAVLRTVSPSQYEGGEWNKDGNCVRTRPYRRGEKTLQGVELDFHTLQVEEFEAAKRAASGGGARMMLMDTTEAMILRADAHPSRYRGWTRRKGWMKEYFTISNDCVHWSMMKFHEVIKLPSIAHYGLRYVLPAAAVAACVLVLATVSLPGRVPLPLLLAPEVMTKTADGVGGDTSGCDIFKGEWVPDMAGEPPPYTSESCPVIHGHYDCMRYGRPDLGYVRWRWRPDGGCELLRFDAARFLAAMRGRSVAFVGDSLARNQMHSLVCLLSHAERPAPWTNGSYAYRFERHGLTVTAFWSPFLVRAVETDPDGPTGSGSGLWSLHLDEPDAGWAAHVGAFDYVVVSAGSWFYRPSMFYDRRGRLVGCNTCLSPNVTDLTLRYSLRMAFRSALRAAATGSHRHATRRTVIVRTISPSHYENGTWNGDGDCLRTRPARRGEWELNAMEKDMHRIQVEEFAAAAEETAGKRGKEAARMLLMDATEAMAQRPDGHPSKYRLWQPDKFKVSRDCVHWCLPGAMDACNDMLFHMLIG

SEQ ID NO: 47994 - protein, 428 aa, Streptomyces coelicolor A3(2)
MQTAETSTNPTDAAVDLGPATALSCRECGHRVPLGPVFACEECFGPLEIAYDFSDYDAEELRKRIEAGPANIWRYAPLLPVPADVATKPNINPGWTKLVQADNLARELGVTGGLYVKDDSGNPTHSFKDRVVAQAIEAARAFGFTTLSCSSTGNLAGAVGAAAARAGFRSCVFIPHDLEQGKVVMAAVYGGELVGIEGNYDDVNRFCSELIGDPAGEGWGFVNVNLRPYYAEGSKTLAYEICEQLGWRLPDQIVVPIASGSQLTKIDKGLKELIELGLVEDRPYKIFGAQAEGCSPVSTAYKAGHDVVRPQKPNTIAKSLAIGNPADGPYVLDIARRTGGAVEDVTDEQVVDAIKLLARTEGIFAETAGGVTVGVTRKLIENGVLDPSLTTVVLNTGDGLKTLDAVAGTGLTATIRPNLDSFREAGLA

SEQ ID NO: 47995 - protein, 207 aa, Picea sitchensis
MAPRLVNLLHPLNRMLGRIESSPGLLGSVNPGYCTVGCESNGEEAIEDVKESEQTLRRESQPQGVDPKKGWGFRGVHKAIICGKVGQTPVQKILRNGRTVTIFTVGTAGMFDQRTAGMDKSTRPIQWHRIAVHNEPLGAYVVQQLIKDASVYVEGDIETRVYNDNINGTVKHVPEICVRRDGKVHLINNASGPVSEITLEGLRDSLF

SEQ ID NO: 47996 - protein, 438 aa, Oryza sativa Japonica Group
MKMLLFASRAALSLTASLAVSDVVLLTASSRSRRPSFLRRYEPTVVATSLPSAAPPAYSRSAPPSPTPLAVVARVPRDCDIFRGEWVPAADGDDDGAAPYYTNATCGEIQEHQNCMKYGRPDLGFLRWRWRPERCELPRFDAAAFMEVVRGRSMAFVGDSLARNHMQSLMCLLSKVENPKDVSTTKDPEFRTVRYESHNFTVAAFRSPYLVTANQSSDPAGGMWDLYLDEPDAAWATAVAGFDYVVVSTANWFNRPTMFHEAGRLVGCHHCLVPGVADLKRTYSLRAAFRTALRALTAGAGGAGFDGTVIVRTLSPTSHFEGGEWNKGGDCRRTRPTAARMAGLDLDFHTVQVEEFRRAEAAAAAASGGAARLLLMDTTAVMVARADGHPSRYGHWAHEKVTLYNDCVHWCLPGPIDVWNEMLLQMLLLHHRSGEFSV

SEQ ID NO: 47997 - protein, 338 aa, Yarrowia lipolytica CLIB122
MEANPEVQTDIITLTRFILQEQNKVGASSAIPTGDFTLLLNSLQFAFKFIAHNIRRSTLVNLIGLSGTANSTGDDQKKLDVIGDEIFINAMKASGKVKLVVSEEQEDLIVFEGDGRYAVVCDPIDGSSNLDAGVSVGTIFGVYKLPEGSSGSIKDVLRPGKEMVAAGYTMYGASANLVLSTGNGCNGFTLDDPLGEFILTHPDLKLPDLRSIYSVNEGNSSLWSDNVKDYFKALKFPEDGSKPYSARYIGSMVADVHRTILYGGMFAYPADSKSKKGKLRLLYEGFPMAYIIEQAGGLAINDNGERILDLVPTEIHERSGVWLGSKGEIEKAKKYLLK

SEQ ID NO: 47998 - protein, 661 aa, Arabidopsis thaliana
MDDLKVNLPFHEHPLTPVKMESKCDWCGIKFIHISDGYQCDSCFTPLFHKTCANDKNIAHPSQACGIILYHTVNFDSGKWRCAKCGEKIYDSLFFVCNDCVLKPRRKGSRFGGSSYFHFNCAKYPPSEVIDVPQHHDHKLKLEMVISSFTCAACGKDGDGYSYKCQECNLTFHVNCEKYPAEVTHFSHFLHPLKLFKGEPPAYTDGKCRLCGEKLANFEVFYHCSACNFSLDLQCVFHPPKQNPHDLNIHDHPLTLMPKSISFTCTTCGLNGDRSPYVCLPCDFTSHNDCSGYPWVININRHDHRVSRTSLIGVVNSVCGICRKKMDWSCGGYSCQKCSSYVFHTKCATREDVWDGKEMKDEPEEEEAIQPFTIIDENTIKHVSHKEHNLRLDKSGIFIEERICEACVYPIYHHSFYSCMSCSFILHESCAYLPLWKRHVVSNERHEYKYWDYFIRCSACRLLSNGFRYETTQTSLDLRCASTTEPFFHKTHPHPLFYTSPQGICSICKKDHLHVLRCVEDGCEYIMDYKCALLPYEVKHSVDQHFLSLCYGEENASGKHWCDICEKEMDPKTWFYTSKDCELTLHTDCVLGDFRGLKPESEESMYIDDFEMYVKVVRNNSMSRPLCKQCKSRCIFPVILETWNESCLRNEYYCSEACFYS

SEQ ID NO: 47999 - protein, 193 aa, Escherichia coli
ALAPMVIEQTSRGERSFDIYSRLLKERVIFLTGQVEDHMANLIVAQMLFLEAENPEKDIYLYINSPGGVITAGMSIYDTMQFIKPDVSTICMGQAASMGAFLLTAGAKGKRFCLPNSRVMIHQPLGGYQGQATDIEIHAREILKVKGRMNELMALHTGQSLEQIERDTERDRFLSAPEAVEYGLVDSILTHRN

SEQ ID NO: 48000 - protein, 330 aa, Synechococcus sp. CC9311
MAIHPLIVRGAREGWRWQWLRLMGGLGPADQEGHYRRPNSTPMQTLVLEKKELEARTSKTKPHLIVGRSCPWAHRVWLVFQLRGLSSSIKLLKADASHDEGRWRLEPTWLGCNSLLDLYKRCGAPPSYRATVPVLVDPGASASDHPRLLGNDSTPLSAALCSWPAEKTALNLAPSDLRPAIESWQELIQPSINDGVYRCGFARNQSAFDQASQALFSALEEVEGSLQAKGPWLCGEQVTLADIRLFPTLIRWELVYASLFGCSAKPLWMFPALWSWRQRFFALPGVSESCDSKGWTQDYFGALFPLNPSGIVPDNPDLSRLIGAGVAQPE

SEQ ID NO: 48001 - protein, 528 aa, Erythrobacter sp. SD-21
MLLDRVKPLDAILATAKKKALKRTLGPIQLMLFGIGCIIGTGIFVLTAAGAQKAGPGLMLAFVIAGLVCIVAALCYAEIASMIPVAGSAYTYSYATMGEFLAWTVGWALILEYAIAAAAVSVGWSGYFAGTILNEFLGIELPQWLAAGPLALGGEPGGFINLPALVIALLITWLLMIGTNESARVNAVLVLIKVVALTVFIALTFTSAEFDVDKFNPFLPAGVFGGFGSGVGAVGAAATIFFAYVGFDAVSTAAEETKNPQRNVPIGLVGSLLFCTVFYIFVAAGAIGTIGGQPIMGPDGIPFPAGSEELALQCAMPQYAASLVCSDEALAHVLRQIGFSSVGNMLGIAAFFALPSVILVLLFAQTRIFFVMSRDGLLPEGLSKVHPKWNTPYVVTAITGVIVAFGAAFFPVGQLADIANAGTLYAFLMVAVAVMLLRRSDPGRKRDFRTPALWLVGPATIFGCAFLFLNLPTEAMFVLPIWTLIGLVIYFAYSRRHSHLGRGIVEVHEPEYAEIEPGIPGFDEPNGS

SEQ ID NO: 48002 - protein, 233 aa, Salinibacter ruber DSM 13855
MTERVESIRERIAQACGRAGRSPDEITVVAVSKTFPMQAIASGTGVGLEHFGENRARQLRDKAKARPGAVEGGDVKWHMVGHLQRNKAKFIARHADWFDALDSPRLAEELNKRAAKNDRVLPCLVQVNITGDDQKYGLAPSETHEYLDHCAQYDHLAVEGLMALGSFVDDPEDVRGEFQKMRELFDTYDASGNPQVEMTELSIGMSNDFEVAIEEGSTMIRLGTSIFGPRDYD

SEQ ID NO: 48003 - protein, 287 aa, Glycine max
PPPSEYCEEEVEGKASNSYWESSKRVATLKEQNAPPKTIYVRNLSYRVEQADMENLFKECGKIVDVRLHRNHNGRLNGFGQVEFATAEAAKKALELHNTELLRRPIGVDLAEEKGEYTYSRSNWSNSFQKCERAQSPTVFVTGFDSSLPAEKLKASLEEHFGSCGEIQRISIPTFPDSGAVKGFAHLGFKDVVSVQLGRPPPQNELGGFPLRVEKAKPRRDNWGIGSGRDGRDNWGIGSGRDGGDHQFGGRDGSGYTSRVGWGRSGGGGWHSLHFSDEDSGRKNHSY

SEQ ID NO: 48004 - protein, 572 aa, Wolbachia endosymbiont of Drosophila simulans
MHSGSQHLFDIIILLSAAVFIVIAFWKMNISPVLGYFVAGAVIGSRGFNLIHSAGAMDNLAEFGVVFLLFIIGLELTFERLIAMRIHVFGFGSLQVIVTMVAIWCIALAFGVNTNIATVIGGGLALSSTAIVLQVLQEKGSQASQVGRLSIAVLLMQDFAVVPLIVLVPLLTGNSEHSLISSLAGSLVQAAIALVLIFITGRLLLRPLFSVIAKMESNEIFISTTLLIVLGAAFITEQFHLSLALGAFVAGLLVAETEYRHSVEHAVLPFKDLFLGLFFMTVGMSINTEPLLNKLPLITLLSIILIVLKTSIIYILCRFFGFKSAPAIQAGLLLSQGGEFAFILFRLADELNVLPSEIAQVLMMVTTVTMAFTPLLSGLGDWIANSFSTEKTILDDEAAETDTQDLYNHVIVAGFGRVGYMVTKMLTAEHLSYVVVDIQSKIVKEGKSDSFPIYLGDVTRCEILKSVGIERAQALVISIKNEVTIKKVVSLVAANFPHGNIVIRLPDLSNVEVYRDLGASKIIPETSEIGLQLGGAALSLSGISESGVTSLKSRFRKGNYSMLKDLGSDKDE

SEQ ID NO: 48005 - protein, 138 aa, Schizosaccharomyces pombe 972h-
MGFPLEKSEDEWKKELGPEKYRIMRQKGTEHPGAGRFTHQFPKQGVFVCAACKELLYKASTKFESHCGWPAFFDNLPGKVKRIEDNSYGMHRVEAVCANCGGHLGHIFKGEGYSNPTDERHCINSASLEFHNEATNDN

SEQ ID NO: 48006 - protein, 267 aa, Staphylococcus epidermidis ATCC 12228
MHLYYLGPKGTFSYLAAKQFESHEQYDFIPLSNLHEVIQSVSKDKQAVGIVPIENSIEGTINIVADSLAHHDVYAHGEIQLDIDFSLYGHHSNSLDDIHKVYSIAPAISQTINYIHRQQFDYDYVDSTIQSLNMIKDGIGAIAPLGSGETYGYHTLDQHIQDYPHNVTRFLVVKNHTHFIEHPNTTIFLITPKYDKPGLLASVLNTFTLFNINLSWIESRPLKTQLGMYHFYVQADTAINNDVNKIISILETLDFQVKIIGAFNKKN

SEQ ID NO: 48007 - protein, 729 aa, Shigella flexneri 2a str. 2457T
MLYKGDTLYLDWLEDGIAELVFDAPGSVNKLDTATVASLGEAIGVLEQQSDLKGLLLRSNKAAFIVGADITEFLSLFLVPEEQLSQWLHFANSVFNRLEDLPVPTIAAVNGYALGGGCECVLATDYRLATPDLRIGLPETKLGIMPGFGGSVRMPRMLGADSALEIIAAGKDVGADQALKIGLVDGVVKAEKLIEGAMAILRQAINGDLDWKAKRQPKQEPLKLSKIEATMSFTIAKGMVAQTAGKHYPAPITAVKTIEAAARFGREEALNLENKSFVPLAHTNEARALVGIFLNDQYVKGKAKKLTKDVETPKQAAVLGAGIMGGGIAYQSAWKGVPVVMKDINDKSLTLGMTEAAKLLNKQLERGKIDGLKLAGVISTIHPTLDYAGFDRVDIVVEAVVENPKVKKAVLAETEQKVRQDTVLASNTSTIPISELANALERPENFCGMHFFNPVHRMPLVEIIRGEKSSDETIAKVVAWASKMGKTPIVVNDCPGFFVNRVLFPYFAGFSQLLRDGADFRKIDKVMEKQFGWPMGPAYLLDVVGIDTAHHAQAVMAAGFPQRMQKDYRDAIDALFDANRFGQKNGLGFWRYKEDSKGKPKKEEDAAVEDLLAEVSQPKRDFSEEEIIARMMIPMVNEVVRCLEEGIIATPAEADMALVYGLGFPPFHGGAFRWLDTLGSAKYLDMAQQYQHLGPLYEVPEGLRNKARHNEPYYPPVEPARPVGDLKTA

SEQ ID NO: 48008 - protein, 404 aa, Bacillus halodurans C-125
MDKKLFDPIEEAIYELMQGRVVIVCDDEDRENEGDFVALAEKATPEVINFMITHGRGLVCTPITEERAKELDLVPMVDHNTDPHGTAFTVSIDHQMTTTGISAHERAMTIQALIDKKTKKHHFKRPGHIFPLIAKNGGVLRRAGHTEAAVDLARLSGAEPAGVICEIIKEDGSMARVPDLRKIADQFELKMITIKDLIEYRHRKDKLVKREVDISLPTDFGSFRAIGYTDVIDGKESVALVKGQIVEGEPTLVRVHSECLTGDVFGSHRCDCGPQLQAALTQIEQQGKGILLYMRQEGRGIGLMNKLKAYKLQEEGYDTVEANEKLGFPADLRDYGMGAQILRDLGVSKMRLLTNNPRKITGLKGYGLEVVERVPLQLPHNKDNERYLKTKHEKLGHLLNFTHS

SEQ ID NO: 48009 - protein, 446 aa, Mycobacterium leprae TN
MTSVEQSRQLVTEIPGPVSLELAKRLNAAVPRGVGVTLPVFVTRAAGGVIEDVDGNRLIDLGSGIAVTTIGNSSPRVVDAVRAQVADFTHTCFIITPYEEYVAVTEQLNRITPGSGEKRSVLFNSGAEAVENSIKVARSYTRKPAVVAFDHAYHGRTNLTMALTAKSMPYKSGFGPFAPEIYRAPLSYPYRDGLLNKDLATDGKLAGARAINVIEKQVGADDLAAVIIEPIQGEGGFIVPAEGFLATLLDWCRKNNVMFIADEVQTGFARTGAMFACEHDGIVPDLICTAKGIADGLPLAAVTGRAEIMNAPHVSGLGGTFGGNPVACAAALATITTIENDGLIQRAQQIERLITDRLLRLQDADDRIGDVRGRGAMIAVELVKSGTAEPDPELTEKVATAAHATGVIILTCGMFGNIIRLLPPLTISDELLAEGLDILSRILGDF

SEQ ID NO: 48010 - protein, 375 aa, Brevibacillus choshinensis
MKRDYYEVLGVGKGADADEIKKAYRKLARQYHPDVNKAADAEEKFKEVKEAYDVLSEPQKRAQYDRFGHQDPNQGFGGGGFDASGMGGFGDIFDMFFGGGGRRANPNAPRKGSDLQFGLSIEFTETVFGKETDVEIPKEAECDTCHGSGAKPGTGVETCKTCSGTGQQEVAANTPFGRIVNRRVCTTCEGKGKVFKEKCSSCRGSGRVKVRRKIHLNIPAGVDDGAQLRVTGEGEPGVNGGPPGDLYVVLRVKSHEFFEREGNDIYCEVPLTYAQAALGDEIEVPTVDGRVKLKIPSGTQTETFFRLRGKGVPHLRGNGRGDQHVKVRVITPTKLSDKQKELLRELAELSGEKPGQHGGEDEGFFEKMKRAFRGE

SEQ ID NO: 48011 - protein, 578 aa, Mycobacterium avium subsp. paratuberculosis K-10
MAAGPVRGGGRGAARRRPRDPDHRITERIPPRAHRRPRRPVAAHRRGVRSPRPAGADRAGRRQPDGDLRRHRCGAPGRRDRHRLGGAVRPHLPAAVGTARAGAARRAVGRPQRRPARRDAAPRTARADRRAGAVGLPRGAGGDGMSTEPLVGVVGVGYVGLTTAVCVAAAGRKTVAVDINPDRVGRLRAGVAVIDEPGLSELLGDGLAGGVLRFSADFAELADRDVVFVCVPTPSAPDGHADLAAVESVIDRLGRVLRRGAVVALKSTVPVGTTSTMAQRLCHKGIRVVSTPEFLREGRAVDDFRNPDRLVIGSHDELAAQLVHQAYGLAGHRVLRMSPESAELAKYASNAFLAVKLSYTNSLAALCARVGADIDDVTCCMGADRRIGAEFLRPGPGWGGSCLPKDTAALLDIAHRHRVSFAEVEAARQTNTAQARRIVTALRHTLGRPLSGCRITALGLTFKAATSDTRESPALAACRELAAAGAQVAGHDPQLPNIDPAVLQQNRVTAVDDPYRAAKAADAVVVLTEWPQFRSLDWRAVAQDAPLAVVLDARNSLDPATVREAGLRYLGNGVPQGF

SEQ ID NO: 48012 - protein, 496 aa, Anaplasma phagocytophilum HZ
MSGSNVVLCILDGWGNGSGGRYDAIHAAYTPFWDTAVSCCPMSSLSASGTDVGLPSGQVGNSEVGHISIGCGRIVLQDLLRINLEINEVHKNPKLLDFVRDIQAKGGVCHMIGLLSDGGVHSLQAHMETIIEVITGFGIKVFIHVILDGRDVPPRSAEKYIGMLNAKIEHLNAEIATVAGRYYAMDRDNRLDRTCKAYDAIAYATGPRSGSAMEALEKSYNSGVTDEFMVPTVIGDYDGMGAEDGVLFTNFRNDRVLQLLGMLLHRFPEVSNVLGMRQYSEKMRIASLFPPREIHRSLGEVISERGLKQLRIAETEKFAHVTFFFNGGREEPFTGEDRIIIPSPDVSTYDLKPEMSAVEITDSLVERINSQQYALTVVNYANADMVGHTGNMEAAKKAVTTVDSCLQRVFYAAVNAGAVMLITADHGNAEKMFDVQNDSPFTAHTSSMVPFVVCNADGDISLSDGRLCDVAPTVLDLMNIPQPSDMTGCSLITRNS

SEQ ID NO: 48013 - protein, 365 aa, Triticum aestivum
  misc_feature (167)..(167): Xaa can be any naturally occurring amino acid
MGPATQQRHRTRAGRPAARRPRAAAGADDGGVRCEACGSGRHADELLLCDGCDRGLHIFCLRPILPRVPAGDWFCPSCAAATTTTAHSAKSAAVVQTKMPKQFPLIQTKIVDFFKIQRRPAFAAPEPPEGRKRKRKAASALVVSKKKSRKLLPFTPSEDPVRGTHRXMASLATALTATGAVFSNDLTYVPGMAPRSANQSALEAGGMQVLPREDAETLSLCKRMMEQGEWPPLLVVFDPVEGFTVEADRHIKDLTIITEYVGDVDYLRNREHDDGDSIMTLLSAAPPSKSLVICPDKRSNIARYINGINNHTPEGRKKQNLKCVRFAIDGECHCLLVANRDISKGERLYYDYNGDEHEYPTHHFV

SEQ ID NO: 48014 - protein, 470 aa, Oryza sativa Indica Group
MKDMSICTVAFACAGKWDSNMSLMVIGKANGGEYACKSIAKRKLLTDEDVEDVRREIQIMHHLAGHPNIISIRGAYEDAVAVHVVMELCAGGELFDRIVRKGHYTERQAAGLARVIVAVVESCHSLGVMHRDLKPENFLFVGNEEDAPLKTIDFGLSMFFRPGEVFTDVVGSPYYVAPEVLKKSYGQEADVWSAGVIIYILLCGVPPFWAETEQGIFEQVLHGTLDFESDPWPNVSDGAKDLLRKVLVRDPKKRLTAHEVLCHPWLQMSGSAPDKPLDSAVLSRLRQFSAMNKLKKMALRVIAENLSEEEIAGLKEMFKMMDTDNSGQINYEELKAGLERVGANMKESEIYQLMQAADIDNSGTIDYGEFIAATLHLNKVEREDHLYAAFQYFDKDGSGYITSDELQQACDEFGIEDVRLEDMIGEVDQDNDGRIDYNEFVAMMQKTTTGFGKKGGHNFSSFRDALKSHS

SEQ ID NO: 48015 - protein, 284 aa, Ipomoea trifida
MAASSLQLPGSKRLEGKVAIITGAANGIGATTARLFAQHGCKVIIADIDDKNGHSVAEEIGPEYALFIHCDVRIESDVQNAVDTTVSRYGKLDIMFSNAGVAGSRDTSILEASPENINLVFETNVFGAFFCAKHAARVMIPARKGSVIFSASAASEVFGITSDTYTASKCAVVGLCKSLCVEMGKYGIKANCVSPYVILTKLGMSIMPTQDRKLAEEIVAEASNFKGKTLTTEDVAEAALYLAGDESKFVSGLNLLIDGGFTTTNIAFQVAVEKVLGGGEETTA

SEQ ID NO: 48016 - protein, 512 aa, Burkholderia xenovorans LB400
MSETYQDEAVRSTKSASALTHFINGKTVEGTSGRFGDVFNPAQGSVSARVPLASVAEVDAAVAAAKDAFAAWSETAPIKRARVLFRFKELLDRHHDELAELITREHGKVFSDAKGEVMRGIEIVEFACGIPNLLKTDFTDQIGGGIDNWNLRQPLGVVAGITPFNFPMMVPCWMFPVAIACGNTFVLKPSERDPSCSNRLAELLKEAGLPDGVFNVVHGDKVAVDALLVHPDVSALSFVGSTPIAEYIYTEGTKHGKRVQALGGAKNHLVVMPDANLDQAVDALIGAAYGSAGERCMAISVAVAVGHIADELVERLTPRVKSLKILNGMESDAEMGPLVTAVHREKVVGYIDSGVAAGATLVVDGRGHQVSGHEKGFFLGGTLFDNVSTDMKIYREEIFGPVLCVVRVPDFASAVELINANEFANGVSLFTSDGGVARAFSRQIQIGMVGINVPIPVPMAWHSFGGWKKSLFGDHHAYGEEGVRFYTRYKSIMQRWPDSIAKGAEFTMPVAR

SEQ ID NO: 48017 - protein, 254 aa, Triticum aestivum
GTRKSLAKSVLEEGGWSNFMCSREDTQKSIDVAVVFIGSKLQSSDISKDKQDDLTLADTLKLSFTDSEFSMAFPYVSTSDDEKLENSLLSSFAENCNSGFGRNRITYTDTCTVSGQDVKKYTSMDAIDDLVRYGVGSRRINPSEQTDIIVFCSGGFQNFFTPKSEGEVLSQLVLLLEQSGAKYTILYASQPSGLLENPSSLPLGRYLAEKTKGTKTGEGKCDGECLVKSTLLEGTFVGIVLLIILISGLMCMMG

SEQ ID NO: 48018 - protein, 277 aa, Ipomoea trifida
MAASSLQLPVFKRLEGKVAIITGAANGIGATTARLFAQHGCKVIIADIDDKNGHSVAEEIGPEYALFIHCDVRIESHVQHAVDTTVSRYGKLDIMFSNAGVAGSRDTSILEASPENINLVFETNVFGAFFCAKHAARVMIPARKGSVIFSASAASEVFGITSDTYTASKCAVVGLCKSLCVEMGKYGIKANCVSPYVILTKLGMSIMPTQDRKLAEEIVAEASNFKGKTLTTEDVAEAALYLAGDESKFVSGLNLLIDGGFTTTNTAFQVAVDKILG

SEQ ID NO: 48019 - protein, 671 aa, Oryza sativa Japonica Group
MEPPFFLLLLLLVVSSSSPSAALLSAKGVNNEVQALIVIKNLLKDPHGVLKSWDQNSVDPCSWAMITCSPDFLVTGLEAPSQHLSGLLSPSIGNLTNLETVLLQNNNITGPIPAEIGRLENLKTLDLSSNSFYGEIPSSVGHLESLQYLRLNNNTLSGPFPSASANLSHLVFLDLSYNNLSGPIPESLARTYNIVGNPLICDANREQDCYGTAPMPMSYSLNGSRGGALPPAARDRGHKFAVAFGSTAGCMGLLLLAAGFLFWWRHRRNRQILFDVDEQQIENVNLGNVKRFSFRELQAATEGFSGKNILGKGGFGNVYRGQLPDGTLVAVKRLKDGNAAGGEAQFQTEVEMISLALHRNLLRLYGFCMTATERLLVYPFMSNGSVASRLKAKPALEWGTRRRIAVGAARGLVYLHEQCDPKIIHRDVKAANVLLDEACEAVVGDFGLAKLLDHRESHVTTAVRGTVGHIAPEYLSTGQSSDRTDVFGFGILLLELVTGPDGARVRQVVQPQGRHAGLGKFVKIIFTEIFHNYSNNPHVNRSITKLRSAVKKMQSEKKVEVLVDKGLGGGYDRVEVEEMVQVALLCTQYLPAHRPRMSDVVRMLEGDGLADRWEKASGHSTAAADSLSHSHRTSDPAPPAADFAAAFGRCFSDLTDDSSLLVQAVELSGPR

SEQ ID NO: 48020 - protein, 171 aa, Zea mays
MEHKEAGCQQPEGPILCINNCGFFGSAATMNMCSKCHKEMITKQEQAQLAASSIDSIVNGGDNGKGPAIAATVGVAVPQVEEMTIAVQPMHVAETSEAAAVIAKAKEGPNRCAACRKRVGLTGFNCRCGNTYCSMHRYSDKHDCQFDYRTAARDAIAKANPVVKAEKLDKI

SEQ ID NO: 48021 - protein, 599 aa, Triticum aestivum
  misc_feature (256)..(256): Xaa can be any naturally occurring amino acid
MDKGALMTPDSDQGGPDGGSFSSLRSYGRALSQTPRRLARRACAATAPGEEMSRVRARSGAPMARALRWPDLVGLGLGGMVGAGVFVTTGRATRLHAGPGVVVSYAIAGLCALLSAFCYTEFAVDMPVAGGAFSYLRVTFGEFAAFLTGANLIMEYVFSNAAVARSFTAYMGTAVGVDAPSKWRIAVPGLPNGFNQVDLVAVGVILLISVCICYSTKESSKVNMVLTAVHVAFILFIIVMGFWRGDARNLTHPADXPNPGGFFPNGVGGVFSGAAMVYLSYIGYDAVSTMAEELERPARDIPIGVSGSVIIVTVLYCLMAASMSMLLPYDAIDTEAPFSGAFRGSDGWGWVSNVIGAGASLGILTSLMVAMLGQARYLCVIGRSGVMPAWLAKVHPKTATPVNASAFLGLLTAALALFTELDILLNLVCIGTLFVFYMVSNAVVYRRYVVGPTGSGTESGDRQPSAWPTLAFLLAFSLIALSFTLVWKLAPEGGRTRVGLLSACGAAAVAMVGAFQALVPQAHTPELWGVPGMPWVPAASVFLNVFLLGSLDRPSYVRFGFFSAAAVLVYVLYSVHASYDAEESATLDGAKVQDEACRV

SEQ ID NO: 48022 - protein, 419 aa, Gonyaulax polyedra
FLAPLCLAAVVLGAWQLLPTSFVAPSPRLRGVTSESAQVSTAAPLERSNASQSSAWLATGAACALILSGAAARALSMGRQSSSVAMRATGIAINGFGRIGRQVARIAMKDPEVELKLINASYDADYLAYMMKYDTIHGKYDGTVEVDGDALVIDGLKVALSHTRDPAEIPFTEHGAEYVCESTGVFLTTEKVEPHLKAGAKKIVFSAPAKDDSHTIVMGVNQDTYDPSMTCVSCASCTTNGLAPAVKAVNDAFGIKRGLMTTIHAMTASQPTVDSASKKDWRGGRAASGNIIPSSTGAAKAVAKVVPEVKGKLTGMAFRVPTIDVSVVDLTCELEKATTYEEICAEIKRRSEGDMKGFLGYTDEPLVSTDFETNTISCTFDAKAGIMLDPTFVKLVMWYDNEWGYSCRVVRPDKAHGEG

SEQ ID NO: 48023 - protein, 358 aa, Streptomyces avermitilis MA-4680
MRAAVLHEIGQDKLEVLDDVESVGFGPGRVRIRVRATGLCHSDLSAMSGVLPQPAPFVPGHEGAGEIVEVGEGVSHLKPGDRVVVCWLPACGVCPACKRGQSQLCLAGFMNAGTPNFRRPGGDVFGFAGTGTFAEEVVVDAGSAVPIPDDVPFDIAALIGCGVTTGLGAALNTADVAAGSSVAVIGCGGVGISAVQGARLKGAAEIVAVDPVASRRESALRFGATQAVSPDELAAAKQAVTGGEGFDYVFEVVGRSATARTAYENTRRGGTLVVVGAGALDDFLQLNMFELFFDEKRILPSMYGGGDVLRSYERTIALWRAGRIDLEGLITHRVPLAEINEALDQMRTGTALRTCIEI

SEQ ID NO: 48024 - protein, 219 aa, Triticum aestivum
  misc_feature (8)..(8): Xaa can be any naturally occurring amino acid
  misc_feature (17)..(17): Xaa can be any naturally occurring amino acid
  misc_feature (73)..(73): Xaa can be any naturally occurring amino acid
EFGRGRPXSSFDSVAAXAGDDEALAHSPFGISDGYNAEGSRGHGMHRGHRFATSYSSFGTALSEDDLVGIAGXGLAGGYGAYTMAPDSNGSGYIGVEEVLMGSLLQGGIGGSIDDDLFVRAVDDRAVLPPPEAMRDEGTLRREWRRQNRLRLEEKERKERERRAEIIAEAEEFKKSFLEKRKLNCQRRRTHNRDKEKVFMANQEKFHKEADQQYWRAIA

SEQ ID NO: 48025 - protein, 429 aa, Gonyaulax polyedra
MARGSFLAPLCLAAVVLGVWQLLPISFVAPSPRLRGVTSESAQVATAAPLERSHGSQSSAWLATGAACALILSGAAARALSMGRQSSSVAMRATGIAINGFGRIGRQVARIAMKDPEVELKLINASYDADYLAYMMKYDTIHGKYDGTVEVDGDALVIDGLKVALSHTRDPAEIPFTEHGAEYVCESTGVFLTTEKVEPHLKAGAKKIVFSAPAKDDSHTIVMGVNQDTYDPSMTCVFCASCTTNGLAPAVKAVNDALGIKRGLMTTIHAMTASQPTVDSASKKDWRGGRAASGNIIPSSTGAAKAVAKVVPEVKGKLTGMAFRVPTIDVSVVDLTCELEKATTYEEICAEIKRRSEGDMKGFLGYTDEPLVSTDFETNTISCTFDAKAGIMLDPTFVKLVMWYDNEWGYSCRVVDLIKHMAKVDAAAA

SEQ ID NO: 48026 - protein, 167 aa, Symbiodinium sp. C3
MPCGSAQRRLLRDFKKMTADAPKGIQASPVGDDLFNWSAIVLGPQDTAWEGGVWKLKMSFNEEYPEKPPSVRFENEVFHPNIFPDGQICLDLLKGSGWSPAYDVCTILLAIQSLLADPDTHATPEGGANPEAESLFVRDRQGYYAKVKSLVDKQLEEDDMGCLSAVP

SEQ ID NO: 48027 - protein, 156 aa, Bacillus halodurans C-125
MGQTFEGHLVAEGLKVGIVVGRFNEFITSKLLGGAEDALRRHGASEADVDVAWVPGAFEIPFAAKKMAESGKYDAIITLGTVIRGSTPHFDYVCNEVAKGVGALNMSTGIPVIFGVLTTDTIEQAVERAGTKAGNKGWEAAAAAIEMANLSKELSK

SEQ ID NO: 48028 - protein, 280 aa, Thermus thermophilus HB8
MAAKKDYYAILGVPRNATQEEIKRAYKRLARQYHPDVNKSPEAEEKFKEINEAYAVLSDPEKRRIYDTYGTTEAPPPPPPGGYDFSGFDVEDFSEFFQELFGPGLFGGFGRRSRKGRDLRAELPLTLEEAFHGGERVVEVAGRRVSVRIPPGVREGSVIRVPGMGGQGNPPGDLLLVVRLLPHPVFRLEGQDLYATLDVPAPIAVVGGKVRAMTLEGPVEVAVPPRTQAGRKLRLKGKGFPGPAGRGDLYLEVRITIPERLTPEEEALWKKLAEAYYARA

SEQ ID NO: 48029 - protein, 459 aa, Staphylococcus epidermidis ATCC 12228
MTIIRDKFNNSKAFFNTHKTKNLKFRKQQLKLLSKNIKNHENELLDALYKDLGKSKVEAYATEIGMLLKSIKLMRKELKNWSKTKQTDTPLYLFPTKSYIKKEPYGTVLIIGPFNYPVQLVFEPLIGAIAAGNTAIVKPSELTPHVAIVIKDIIEDTFDEAYVSVVEGGIEETQTLLSLPFDYMFFTGSEKVGKIVYEAAARKLIPVTLELGGKSPVIVDDTANIKVASERISFGKFTNAGQTCVAPDYILVQRKVKNDLIKALKKTITEFYGENIEKSPDFGRIVNQKHFNRLNDLIQIHKDNVVFGGNSSKEDLYIEPTLLDNITNDNKIMKEEIFGPILPIITYDNFDEVLEIIQSKSKPLSLYLFSEDENMAHRVVEELSFGGGAINDTLMHLANPNLPFGGVGSSGIGQYHGKYSFDTFSHMKSYTFKSTRLESSLFFPPYKGKFKYIKTFFKN

SEQ ID NO: 48030 - protein, 342 aa, Gonyaulax polyedra
MPPTMGINGFGRIGRLVFRAALANPDIEVKAVNDPFMDVKYMVYQLKYDSVHKRFPGTISTKEVDGKEFLVVDGKDVQVFHEKDPASIPWGAAGANYICESTGVFTAQEKAELHIKGDAKKVIISAPPKDAVPIYVVGVNHEDYKTDRHSWSNASCTTNCLAPLTKVVHEKFGLLEGLMTTVHAMTATQLTVDGPSVAARTGVVAAAHPQNIIPSSTGAAKAVGKVIPAVNGKLTGMAFRVPTPDVSVVDLTCRIEKAAKYDDIVAAIKEAAAGPMSGVLDWTDEEVVSTDFVSCKSSSIFDVGAGISLNDNFVKLVSWYDNEWGYSNRLVDLAIYMAKKDG

SEQ ID NO: 48031 - protein, 460 aa, Schizosaccharomyces pombe 972h-
MSLANRIEEIRCLCQYKLWNDLPSYGEDENVPQNIRRCYQLLDMTSRSFAVVIKELPNGIREAVMIFYLVLRGLDTVEDDMTLPLDKKLPILRDFYKTIEVEGWTFNESGPNEKDRQLLVEFDVVIKEYLNLSEGYRNVISNITKEMGDGMAYYASLAEKNDGFSVETIEDFNKYCHYVAGLVGIGLSRLFAQSKLEDPDLAHSQAISNSLGLFLQKVNIIRDYREDFDDNRHFWPREIWSKYTSSFGDLCLPDNSEKALECLSDMTANALTHATDALVYLSQLKTQEIFNFCAIPQVMAIATLAAVFRNPDVFQTNVKIRKGQAVQIILHSVNLKNVCDLFLRYTRDIHYKNTPKDPNFLKISIECGKIEQVSESLFPRRFREMYEKAYVSKLSEQKKGNGTQKAILNDEQKELYRKDLQKLGISILFVFFIILVCLAVIFYVFNIRIHWSDFKELNLF

SEQ ID NO: 48032 - protein, 241 aa, Erythrobacter sp. SD-21
MIDLFGSEAHGTPNAFGGRFTRDPITGALVPTVVEQSSRGERAFDIFSRLLRERIVFVTGQVEDTMASLIVAQLLFLESENPSKPISMYINSPGGVVTAGMAIHDTMQYIKPRVSTVCIGQAASMGSFLLAAGEPGMRIALPNARIMVHQPSGGARGMASDIEIQAREILRIRKRMNDLYVQYTGKSLTEIEKAMDRDTFLEAEEAMKFGIVDKVFEARPENEGDDEPVKDEDKGSGGAPE

SEQ ID NO: 48033 - protein, 2602 aa, Crocosphaera watsonii WH 8501
MDCRFPGNANSPEAYWELLRNGIDAITDIPSDRWDVESYYDSDPEIPGKMYSRYGGFIEGVDQFDPQFFGISPREALSLDPQQRLLLEVSYRALERAGQPLDSLQGSKTGVFMGICFDDYSRFTLNSGDPTLIDAYSSLGNTRSIAVGRIAYVLGLTGPVIQLDTTCSSSLLAVHLAAQSLRTGESNLALAGGVNLMLSPEVSIGFSKLKALAPDGRCKTFDEKADGYVRGEGCGIVVLKRLSDAIADGDKILGTVFGSAVNHDGQSNGLTAPNGSAQETVIRQAIENAKVDPTQIQYVEAHGTGTSLGDPIEVLALSKVLGKNREQDNPINIGSVKTNFGHLESAAGVASLIKVILSLQHQEIPPHLHFKNPNPYIPWEKLPINVPTKLTPWPAKKGRRLAGVSSFGMSGTNVHLILGESPKVEENIETQNVESSLHLLTLSAKTETALQAQIEQYKTYLNTHQNIPFADICYSANKRRSHHNYRFSIVASSTLEAAEKLNNSLYPNSPPLTRGSSGGSPFYSPPLTRGGWGGSSPPIAFLFTGQGSQYVGMGQQLYQTQPTFKTTVDHCCDILQSYLGWDLKEVIFSEQGTGNGEQETGRLGDGETCYNLDSTINTQPALFVIEYALAKLWLSWGIQPNIMMGHSIGEYVAATLAGVFSLEDALKLITARGRLMQKLPQNGSMIAVFTDLETVEKKISNYKNQVSIAAINHHKNIIISGNNTAIKEIIGKLESQGIKSQVLNVSHAFHSPMIEPMLREFEAIAKQINYSPPKLKLVSTVTGTVMSDEIATPKYWCRQIVEAVKFSQGMEYLVEQDIKIFLEIGAKPTLSNIGQIVIENSNKDQDFSFLASLHPKQENWQTILFTLGQLYVNGFSINWEEFYKYSQINYINNLPTYPFQKQRFWLEKKVNRSFLNQQKQQHPLLGQKINLAGSKNIYFENQISENIPIFLREHRVFDTAILPLAGFLEIALTAGINIFKTQECYLEDVVIQQGLILPPDTIKTIQINLVSETTNNYSFEIYSLNNEQDQDNDWILHSSGQLKQKQIVTSTINLEEEKERFSQGLQIDDYYQKCQERGINYGKRFQGIKHIYKLEREALAYIELPLEIINSSAYQIHPILLDNCLQVTGIVLIEENSLETYLPVALESFVSDNKQDINSSKIYTYAKLNTEKNSIDLKLLSENGEAIADIKGLKLRKASPETLLGKEENDSLENWLYGVKWNKQPLTANILLNPQKIESYLEPKLQNLKDKSDVIEYQELLSELETISFNYILEAFLKLGFKFELETRFTNSQLQEKLGILPTYKRLCDRLLNILAEEGILRKIGEEWQVIKVFEGTGNRERGTGKSPDSSAELTLLQRCGSQLAEVLRGDCDPVQLLFPDGDLTLTTQLYQESTGAKMMNNLVKQVILTALSNKTPESPLKILEIGAGTGGTTAYVLPELDQLSTEYVFTDVSSLFTEKARQQFQAYSFVDYRVLDIEKDPTTQGFLLQHYDIILAANVVHATQDLQQTLTHIRQLLTSQGMLVLLEGTRPLRWLDLIFGLTEGWWRFTDTDLRPTYPLISPSQWQQLLEKNGFVESIVLSPDSNPDSFLSQQGVMVARNAEDINTEAKNWLILGDRQGIASHLVQTLESKGENCIVAYSDSHYQQIGAKDYQVNPQNEQDISRLLEKKQFDQIIYLWGLDDPSEEDLTIDTLETGSENHCRSILQLIQNSYNKPPRFWLVTKGVMATDKNDPVVSITQSSLWGLGKAISLEHPEFNSVCVDLEINTELKQQVKVLLEEINANSPENQIAFSKNTRHVARLVPQKLSTATTQPRQLTISQRGTLENLQWQPLNRHSLKSGEVEIRVKATGLNFRDVLNALDLYPGDAGPLGCECVGEVISKGEDVELMNIGQEVMAIASGSFRDYVIVDAGMVTPKPDSLTIEEAATIPVTFLTAYYTLHHLAKIKKGDRVLIHAAAGGVGQAAIQIAQKVGAEVFATASVGKWNTLRQLGVSHIMNSRTLDFAEEILTITEDEGVDIVLNSLSGEFISKSFAILKDNGRFVEIGKSLKLEGKYPTQPSQEEIPPTPLGKGSQLPTQLSQEGKAEGLDIHSQLKPDAAYFQVDMFKVCQEEPELVQSMLCHLREQLQTGNFQPLSYQVFPREDAISAFRYMQQAKHTGKVIVSYSDRELGDWETGRLGDWETGRLGESETEGNDQSSLKFSEDGTYLITGGLGDLGLLVAQWMIEKGAKNIVLMGRNEPKLEQKQKIKALETLGGNITIAQGDVSNKEQLATILKAISPSPHLPVPPSPRPPLSPSPLSPLKGIIHAAGVLDDGVLKQLTWERFNKVMSPKVQGAWNLHNLTKDKPLDFFVLFSSAASLLGSPGQANHVTANTFLDTLAHYRRSQGLPALSINWGLWSDIGAAAKRQVKRQGVGAIAPDEGITILEMLMKDSLAQVGVVPIKWDEFLQIEQNIPFFSNFKQQKATSTNSSSNFLQQLEDIPPEEKENYLREHIRAEISQVLGFNPSDVDMEIGFFDLGMDSLTAMEFKNRLQNTFACTFPSTIAFDYPTGDALVSYIATEVLQLTEETIEPLEEDDTENLSQDDIADLLAQELSEIQGGDE

SEQ ID NO: 48034 - protein, 452 aa, Erythrobacter sp. SD-21
MEFDPRIFLFVVFGLGLMLAVTLEKWLARFWLSLPIVYVAAGFALYSLPLDLPNINPTYDGFDALALEYVTEFIVIASLMAAGIAIDRPVSWKNWSQIWPLLVFAMPLTIAAVALLGWWIVGLAPASALLLGAALAPTDPVLARSVQVGPPGENKRHDVRFSLTVEAGLNDGLAFPFTYLAIAAVGMTSLGNWTLEWAARDLVWRVAAGIAVGWAVGRAGAWYVFEREADAPMEEIDEASESADQPKYSTSEGLVVLGTLLLAYGLAELAEGYGFLAVFAGAVTARQRENRSRYHKLSHHFIDQIEQIVLVLVLFGFGAMLASGVLASLTWEGALLGLALIFVIRPVAGFISEYPSRLPMLGTLAVAFLGVRGMGSIYYLAYGQNHGNFYNFDQLWAIASFTILVSIVVHGILAGPMILAVEKKGRHIHTGEEEGLESHSPHGTVAPRTEKP

SEQ ID NO: 48035 - protein, 1292 aa, Crocosphaera watsonii WH 8501
MGWKFTENQSLSKQSLTIAKKYQRLTDYLLKNLTEAGILNKIDDHWQVIKTSNSATIERQKQELLKEYPFAEIELTLLHRCASQLAQVLQGKCDPVQLLFPQGDLSTATQLYQDSPGAKMMNTLVQETLSVALETLPQGKKVRILEIGAGTGVTTAYLLPYLDSAQTEYCFSDISPIFSEKAKQKFSDYSFISYQTLDIEQDPQKQGFSAESYDIIVAANVLHATENLEETINHVHQLLAPKGMLLLLENTSALLWLDLIFGLTEGWWRFNDEVRNDYPLISAQKWQKLLIDREFEHTAILKPEQKQGETVSQQSIILGQKKASAPKNWLILGDKDVFAENLVNYLQEKGQYAILSQEIDNLDEFQHIIYLGSLDSPEPSNLTTQDLETASEIGCTNVLTLVQTLANSSTPPTLSIVTRGAVSTETEDILPGLTEASLWGIGKVINLEHTQLNCRCIDLDTKIAPEKQIQALLSVIESTEKETQVALRDDQLQVSRLVRHGKIEPYKLEIPQNEAFKLDISQKGTLSNLELVPTSRISPEQGEVEIKVGATGLNFIDVLDGLGLLPFEREWFGVECVGEVVRVGEGVNELKKGDRVLALAPGSFSQYVTITTQLVSHCPKNLTIEEAATIPANFLTAYYALHRLGKIKKGDRILIHSAAGGTGMAALQIAQQVGAEVFATASPNKWEFLKSLGVKNVMNSRTLDFAAEILTITEGKGVDVVFNSLSGEFITKSFSVLADEGRFLEIGKRDIWTREQVHKVKPNASYFAIDLLTIAQQQPQLIQSMLTELKQKFEEDRLKPLPRNVFPIEQTIQAFRYMQKGKHIGKIVVSYNPELKNISSSEQLNNISVGANGRSPIQKMPLGFSEDGTYLITGGLGGLGLLVARWMIEKGAKNLVLMARSKANSQQKQEIQALEALGGNITVAQGDVSNKEQLANILENIQTTTPVPPSPQPPLSPSPPLPVPPSPQPPLKGIIHAAGVLDDGVLLQMNWERFNKVMAPKVQGAWNLHNLTRDKPLDFFILFSSAASLLGSPGQGNHVAANTFLDSLAHYRRSQGLPALSINWGVWSDIGAAAKRQVDAQMKARGIGAIAPQQGLDILEKLFTEESTQVGVVPINWPQFLSSGATSPYFEDFAQTKETKQREASELRQQLTDILPQNRLSFLVNHLQEEVAPILGLKTNPNPQQGFFDLGMDSLMAVEMKNRLETGLSVTLPSTVIFEYPTINALAEYLVEEMFPSQWESTGVKTKINNEETSLSQTLEEDINASQTLEEDSAIAQELEELENLLKNRNND

SEQ ID NO: 48036 - protein, 318 aa, Populus sieboldii x Populus grandidentata
MSSVLATVICVVMLFWGISDAQLSPTFYASTCPNVSSIVRGVVEQAAQNDVRLGAKLIRMHFHDCFVDGCDGSILLVDATGINSEQDEAPNTSVEGYGVVDDIKTAVENVCPGIVSCADILALASEILVTLAGGPTWQVPLGRRDSTTANAARTSDIPSPFETFENLSLKFSNKELDSTDLVALSGAHTFGRSQCQFFSQRLNDTNPDPTLNPTYLQTLRQACPQGGNPSRLNNLDPTTPDDFDNNYFTNLQNNSGLLATDQMLFSTSGADTVAIVNRFANSQTAFFDSFAQSMIKMGNLSPLTGSNGEIRADCKRVN

SEQ ID NO: 48037 - protein, 415 aa, Cryptococcus neoformans var. neoformans JEC21
MPGPAVTPNKPSHRRRSSVTNALNQIPLNHEQGSSIQPVEEVKPLTSRPRPKSKGTRDALPEIYKSNGFWDDVKTGRWMLIPSSSFKLMLIAPILYFNHRLLVHYGILGPDTPNIFEHLIFPSNRLPDGRYGKSWWDLVFLANYIIFWSFVRQFMTLKVFRPMAMSLGIKGGKIMRFTEQGYACFYFSILGSLGVYVMRGLPTWWYKTEHFWLEYPHREMSWELKTYYLVQAAYWLQQTILLAAKIEKPRKDFKELVAHHIVTLWLVGWSYNVYLTYIGVSIFVTMDVSDVFLALAKCVNYVSDFWSVPVFAWFIFVWSYFRHYLNIWILWSVWAQFDLIRPSERSAFDPLNDKWLSWWMKWQIFTPIFLLQLINLFWYFLIWRILVRAVFYRDLKDERSEDEEEEEEEVKVKAE

SEQ ID NO: 48038 - protein, 248 aa, Aspergillus oryzae
MPPKSKSKKDIAPPKQQQQRQQTPKPNWPPLRPLIPSSDLTLDPLLPDQIYLIPNFFTANLCKTYVSFLSSLPLTTTPGKPKKGDAVRVNDRFQIQDERFAESLWSGTALKDLVMNGDGEGERSMKEIWGGEPLGLNANIRIYRYSKGQFFAQHYDDSNTLTFSSPSHPSQPARTTWTLLIYLTTCSGGETIFYPESTRGNRNPEPVSVAPVTGMALLHRHGDRCLLHEGSEVSDGEKWVLRSDLVVR

SEQ ID NO: 48039 - protein, 277 aa, Ipomoea trifida
MAASSLQLPVFKRLEGKVAIITGAANGIGATTARLFAQHGCKVIIADIDDKNGLSVAEEIGPEYALFIHCDVRIESDVQNAVDTTVSRYGKLDIMFSNAGVAGSRDTSILEASPENINLVFETNVFGAFFCAKHAARVMIPARKGSVIFSASAASEVFGITSDTYTASKCAVVGLCKSLCVEMGKYGIKANCVSPYVILTKLGMSIMPTQDRKLAEEIVAEASNFKGKTLTTEDVAEAALYLAGDESKFVSGLNLLIDGGFTTTNTAFQVAVEKILG

SEQ ID NO: 48040 - protein, 393 aa, Mycobacterium avium subsp. paratuberculosis K-10
MKAVTWHGKRDVRVDSVPDPKIEQPTDAIIEVTSTNICGSDLHLYEILGAFMKPGDILGHEPMGVVREVGTETGDLRVGDRVVIPFQICCGSCYMCGQQLYTQCETTQVRDQGMGAALFGYSELYGEVPGGQAELLRVPQAQFTHIKVPVGPPDSRFVYLSDVLPTAWQAVAYADIPDGGTVAVLGLGPIGDMAARIADHLGYRVIAVDLVPERLGRAAQRGIHTIDLARLDAGLGDAIRDLTDGRGADSVIDAVGMEAHGSPAAKLAQQVAGVLPDALGKRLMQTAGVDRLSALYSAIDAVRRGGTISLIGVYGGMADPLPMLTLFDKQVTLRMGQANVKRWVDDIMPLLTDDDPLGVDDFATHVLPLERAPHAYEIFQKKQDGAVKVILKP

SEQ ID NO: 48041 - protein, 600 aa, Debaryomyces hansenii CBS767
MRIKKKGTSGNAKNFITRTQAVKKLQVSLADFRRLCIFKGIYPREPRNKKKANKGSTAPVTFYYTKDIQYLLHEPVLGKFREHKTFAKKLQRALGRGEVSDAQKLEGNRPKYTLEHIIKERYPTFLDALRDIDDPLNMLFLFANMPATDKVSHRITKEAEKLTNQWLAYVAKERLIKKVFVSIKGVYYQANVKGQEVRWLVPFKFPTNIPTDVDFRIMLTFLEFYSTLLHFVLFRLYNDANLIYPPTIDTEKLKGIGGLSSYVLQSKDQGVKALLPNAKKAADSKDESKKVKETKLSKEEISKAVAADKSLNENAEDNVSENVEDVELDEFSSTNKTAGDLLSQPSKFASPTSTLLSKFIFYVGREVPLDILEFCILSCGGSIISEIALDELQLNQPEEYKKLDLSNITHQIVDRPTVASKVAGRTYVQPQWVFDCLNKSELLPVSQYAPGETLPPHLSPWGDAGGYNPDAEVKPTEQGEEEEEEEEEIEGDEIEEDVEEEDEEEDEDLQAQKELELEAAGVKSADAQKKDKKSSKGKKRSAEDEEKDLKKIMMSNKQRKLYKKMQYGIDKKEARQDDLTKKRRKLEKTKAELGKLNKKN

SEQ ID NO: 48042 - protein, 284 aa, Ipomoea trifida
MAASSLQLPVFKRLEGKVAIITGAANGIGATTARLFAQHGCKVIIADIDDKNGHSVAEEIGPEYALFIHCDVRIESHVQHAVDTTVSRYGKLDIMFSNAGVAGSRDTSILEASPENINLVFETNVFGAFFCAKHAARVMIPARKGSVIFSASAASEVFGITSDTYTASKCAVVGLCKSLCVEMGKYGIKANCVSPYVILTKLGMSIMPTQDRKLAEEIVAEASNFKGKTLTTEDVAEAALYLAGDESKFVSGLNLLIDGGFTTTNIAFQVAVEKVLGGGEGTTA

SEQ ID NO: 48043 - protein, 395 aa, Ustilago maydis 521
MLDDLAETEAVEAITSAFLSAPTAKQQLLTKLMKSTDNRFQEFCLHLTRRDCPHGKTCHKLHFKPVLYPQTEPSYGHCSYLNTCHRTTSCKYLHFQLDTDPPHPAFVFQTTDPRHAYAPDSEEAQHIGLIHPSRTLQEHGLDQWIRPSSPSACLQEAQWIDCDLKNFDYSMLGKFDIILADPPWDIHMSLPYGTMSDDDMRSMPVPVLQDEGLIFLWTTGRAMELGRELLAHWGYTRIDELIWVKVGQTQRLIRTGRTGHHLNHTKEHCLVGAKIRPTTQAATETARSSNPIAGSTQRYIGSRAAGVPPPLPEWVHCGINADVIVSEVRDTSRKPDELYSIIERLCPGGRKVELFGRKHNVRKGWLTLGNQLKSDRVLDADLQKRLNDFRARGAQ

SEQ ID NO: 48044 - protein, 293 aa, Nostoc sp. PCC 7120
MQINKVRKAVIPAAGFGTRLFPATKVVKKELFPIIDQDGRAKPVILAIVEEAISAGITEVGIVVQPDDIGIFADLFKNPPAPELLQKLSPQNQEYSQYLQDLGQKVVLLTQSEQEGYGHAVFCAKDWVGNEPFLLMLGDHVYKSDIKKSCAQQVVEIYAQVHQSVVGLTTMPAAIINKAGCIAGVWQEFNSILELTQLAEKPNLDYAREHLRVEGMAEDEFLCVFGLYVLTPKIFDFLADSINQNLRDRGEFQLTNCLDKLCQAEGMTGYVVKGKCFDTGLPNTYRQSLIDFI

SEQ ID NO: 48045 - protein, 195 aa, Thermotoga maritima MSB8
MIIRDVELVKVARTPGDYPPPLKGEVAFVGRSNVGKSSLLNALFNRKIAFVSKTPGKTRSINFYLVNSKYYFVDLPGYGYAKVSKKERMLWKRLVEDYFKNRWSLQMVFLLVDGRIPPQDSDLMMVEWMKSLNIPFTIVLTKMDKVKMSERAKKLEEHRKVFSKYGEYTIIPTSSVTGEGISELLDLISTLLKEN

SEQ ID NO: 48046 - protein, 369 aa, Oryza sativa Japonica Group
MEQGQGDRYWCHHCEEVIEPVEPDMKCPSCDSGFVEEMGSAGFEPSTNLRSDRISLWAPLLLGMMGGSSRRARRLRRQIMEDDDDDDDDEDDEDDSDHELEDLFRRQRRGSSLVRLLQTLRDDLRGLDDIGRDSDRDRERERRERERLRERERERERMRERERERRRERTESLILINSNNEAIILQGTFGPDDNQDDSSNTSSGVSLGDYFLGPGLDILLQHLAESDLNRSGTPPAKKEAVEALPTVNIQEVLGCSVCLEDFEMGTEAKEMPCQHKFHSQCILPWLELHSSCPICRFQLPTEESKNPCESAGGIVSVNDDGDDAGTSSDVDSANQPGSPIFSALSALFSNPSSSSSSSSDDNAPHSSES

SEQ ID NO: 48047 - protein, 284 aa, Triticum aestivum
  misc_feature (84)..(84): Xaa can be any naturally occurring amino acid
  misc_feature (93)..(93): Xaa can be any naturally occurring amino acid
MATSAMTLAMAAATDASLFHPTFLAQHKLAPASASLPLIFSRAPLLRSTRPRVPLTPLVASSDAAEAGLDWADAEEADETVTEXEEPAVAASXGDAGYAAEPPEEAKVYVGNLPYDVDSERLAQLFDQAGVVEVAEVIYNRESGQSRGFGFVTMSTIEEADKAIETFNRYDISGRLLNVNRAAQRGSRVERPPRQFASSFRAYVGNLPWQAEDSRLVQLFSEHGEVVNATVVYDRETGRSRGFGFVTMASKEDLDSAISALDGQEMDGRPLRVNVAAERPQRGF

SEQ ID NO: 48048 - protein, 146 aa, Symbiodinium sp. C3
MALKRIQKELADLGNDPPANCSAGPVGDDHFNWQATIMGPPDSAYQGGVFFLNINFPSDYPFKPPKVHFTTKIYHCNVNSNGAICLDLKDQWSPALTISKVLLSISSLLTDPNPNDPLVPEIAQVYLKDRAKHDATAREWVQKYAT

SEQ ID NO: 48049 - protein, 242 aa, Zea mays
  misc_feature (35)..(35): Xaa can be any naturally occurring amino acid
  misc_feature (52)..(52): Xaa can be any naturally occurring amino acid
  misc_feature (71)..(71): Xaa can be any naturally occurring amino acid
  misc_feature (88)..(88): Xaa can be any naturally occurring amino acid
  misc_feature (168)..(168): Xaa can be any naturally occurring amino acid
MITMAETTTGGEPLSEDNLVNTIEASDRALNLDAXKKMILEFLKGRMGYVAXNLAAIVGSAVASKLSRAAXAGGLVTLAKMPACNALXLLLLGAKKTNLSGFSTASLQSRIGYLEQTEVLFESTPPSLRFQSSRLIAAKSTLAARIDCIRLSSGVYSFSSLILIYTLXNSAFYSAKQCFTCSCARSAGHSLRDDPTRTAGQNLLEEISKKIENWQQLPPARLPKPIPIPDFMPKKKTFSCPN

SEQ ID NO: 48050 - protein, 438 aa, Streptomyces avermitilis MA-4680
MVREFIVEADGGSRGNPGPAGYGAVVIDAATGETLAETAEYIGVATNNVAEYRGLLAGLKAARALDPAARIRVRMDSKLVVEQMSGRWKIKHPDMKPLAREAAAVFPPSQVTYEWIPRERNKHADRLANEAMDAGKRGERWSPSTSTAELSARTPAPAAPEPTGPPGDAAAGAARARAALAGGRVATSPAVPEPGGTAADTGARAARDVASVPADADVRAARNVASPPADLGAPATFVLLRHGETPLTPQKRFSGSGGSDPALSDVGRRQAELVGAALAARGTIQAVVSSPLARCRETAGIVAARLGIEVSVEEGLRETDFGAWEGLTFGEVRERHPEDMNAWLADPEAEPTGGGESFAAVARRVATTRDKLLAAYAGRTVLLVSHVTPIKTLVRLALDAPPQSLFRMELSAASVSAVAYYADGNASVRLLNDTSHLR

SEQ ID NO: 48051 - protein, 257 aa, uncultured archaeon GZfos9D1
MGLEIVNDVRTDYVCDLVKNGKREDGRGFREYREISVERDVIKRAEGSARVKIGDTEVLVGVKVELGTPFPDTPDKGVIITNAELVPLASPKFESGPPNENSIQLARVVDRGIRGSETIDLDKLCIEKGEKVWMVFIDIHVLDDNGNLADAAALGAIASLLNLRIPNERYGLTGENTLPMRDTPVAVTTVEIEGNILVDPSFDEGNAAASSVTVISNADGTLSGMQKSGSGGLKEAQIAEMVEIGIEKAGEIRGKYL

SEQ ID NO: 48052 - protein, 245 aa, uncultured archaeon GZfos9D1
MKEEIELIKDGKRLDGRGFDELRPIKIEVGVLKRADGSCYLELGNNKVIAAVYGPREMHPRHAQDAKMAVVKFRYNMAPFSTDDRKRPGPDRRSVEISKVCREAFDPVIMRELYPKMGIDVYVELLQSDAGTRTAGINAASIALADAGIPMKDLVSSIAVGKIGGEMVLDLNAAEDNNGEADMPIAMIARTNTITALQMDGRMTQEEFGRGLKLAMGACHQIYELQRAALVTRYNQNYESKREEE

SEQ ID NO: 48053 - protein, 427 aa, Vitis vinifera
MSYGFSAKATDEYESARRKVAAFINASEPGEIIFTRNATEAINLVAYSWGLSNLKPEDEIVLTVAEHHSAIVPWQLVAQKTGAILKFVNLTEDEVPDVEKLKEMISRKTKLLVVHHISNVLASALPIYDIVHWAHAVGAKVLVDACQSVPHMAVDVQRLDADFLVASSHKMCGPTGIGFLYGKSDLLFAMPPFLGGGEMISDVFLDHSTFAEPPSRFEAGTPAIGEAIGLGAAIDYLSAIGMQKIHDYESRATPKESLPFLSGGECDLLILCVFDKGNICSLEPILSFEVDPREHRHKVNGHTRQSTPNQSDPTSFENVDLANYLYESLRSVPGVHVYGPAPSQTVFRAALCSFNVENIHPTDIATFLDQQHGVAIRSGHHCAQPLHRHLGVSASARASLHFYNTKEDVDAFIHALVDTINFFSSFK

SEQ ID NO: 48054 - protein, 281 aa, Triticum aestivum
  misc_feature (211)..(211): Xaa can be any naturally occurring amino acid
YNKFVQKSRLVPARNPVDIVDPRVRNYTSPRIVLAASGVDHNELVSIAEPLLSDIPTATGTGKPKSVYVGGEYRRAADSSNTDLALAFELPGGWLKEKEFATASVLQALLGGGGVFTWGRPGKGLHSRLNPLVNEFDQIKSISAFKNVHSNTGIFGIHTSTEAAFVPKVMDLAARELTPLATPGQGDQPQLDRAKASAKSAILKNLEFKGXSTTEDMGRPALAFGEREPVEQLLRAVDAITLADVSTVAEKIISSPLTMASHGNVLNVPAYETVRGKFSSK

SEQ ID NO: 48055 - protein, 141 aa, Symbiodinium sp. C3
MSDEWCTIESDPGVFTQLCEEIGVKGVQFEEIYSLGPEAFADLEAEKIYGLIFLFKWQREADPRPTLEASELGIFFAQQVIHNACATQAILSALLNAEKLDVGPNLTSFKEFTIGLDPQMKGLAIGNSEPIRKAHNSFRQQ

SEQ ID NO: 48056 - protein, 548 aa, Picrophilus torridus DSM 9790
MSITEEIRKQAIKNAYLHDGRADVKSVVSKLMAEFPEARKNPGDLINDVKKCVDEINSMGKDRIIEIINNEYPEFKIKEKKEEKHELPELPNAKNGVVMRMAPSPSGPLHIGHSRMAILNDEYVKRYGGDLILRIEDTNPGNIDIDAYDMIPEDLKWLDVNVTKTVIQTSRMDLYYREAKKLIENGYMYIAETDQKRFKELKLKSMALPDRSMDPGVHLDRFDKMLNREYREGEAVAVLKTDLNHPNPSIRDWIAFRISYKRHPLTGDEYCVYPMMNFSVAIDDHYLGLTHVIRGMDHLVNTEKQKYIFNYNNWKLPYYYHYGIIKIPGSVLKTSIIKNGIKSGKYTGWDDVRLGTIRALRKRGYRPETFRRYWINSGMKETGATFSWEIFDSINRQLIDRDAMRFFFVNDPVLLDLNNDIDLESHARYHPDIDLGYRKYIIKSHSRIYLSRRDLDDIKPDEIFRLKDLCVVKRTEDGIAYIDDDSNKRLKIIQWCPENSHEFTVQKPDGTVDSGMLEPLAYNYNGVSQFERYGYVNIINRNGYFLHR

SEQ ID NO: 48057 - protein, 333 aa, Francisella tularensis subsp. holarctica
MRVAINGFGRIGRLAFRQMFGKDNIEIVAINDLTNPEMLAHLLKYDSAQGRFSKAAVTVAKESSIVVDGKEIKIYAEKDAANLPWGELNVDVVLECTGFYVSKAKSQAHIDAGAKKVVISAPAGNDLPTVVFSVNHDILSADDKIISAASCTTNCLAPMAKALHDLANIESGFMTTIHAYTGDQNTLDAPHAKNDFRRARAAAVNIVPNSTGAAKAIGLVIPELAGKLDGAAQRVPVATGSLTELVAVVSKKVTAEDVNAAMKAAANKSFGYTEEELVSSDIIGISEGSLFDATQTKVTSLGDKSLVKVVSWYDNEMSYTNQMVRVVEYFGAL

SEQ ID NO: 48058 - protein, 265 aa, Picrophilus torridus DSM 9790
MRIGDKNLPSIGFGTYRLGGSSTPVYENDEYDVNIIKYALSRGLSVIDTAEYYGNGHTEELVSKAIKDFNRNNIYIISKVWHNHLHYEDVIKSLKNSLRRLNTNYIDLYLIHWPNKSIPLNETLSAMEYLKDSGYIRDIGVSNFNESLLDEALSSMKKYEIVANEIEYNLNNASVVENDVIKYCIKNRISVIAYSPLNRGYLNRSIDSIAKKNNMSNVQLTLAYLKRLSLPIPMSRNIKHIDEIASAMKIDLSDDVYNEVRNSIL

SEQ ID NO: 48059 - protein, 452 aa, Pediococcus pentosaceus ATCC 25745
MIKAKNVYIGFGKAAKTLAFRQAQRGESVVVIEESDQMYGGTCINIACIPSKLLYELSDKPQVGGLKDNYKMAITKKRSVIGKLRYSNFHKLADQKTVKVLNGSASFIDQHTLNVKYLNGATEEVVGERIFINTGATSTIPDIPGLKESSRTVTSTDLLDQDHFPQSLAIIGGGYIGMEFATTYSQFGSKVTMINRNAEFMRGMDQDVSQAVKQNFDKAGIEVLQSAEVIRVQDQGSHAVLTVASDGSESQIMVDMILVATGRKPNIQGLNLEQAGIRYTEAGVAVDDHLRTNVQNIWAMGDVRGGAQFTFLSLDDYRIVYNQLYASGTKTTEEQVIVPKTIFLMPPLSQIGMSEREALDKKIEYRTGKVAVAGMPKAHILGHPNGFYKVLIDKEDHILGATIYAPEAHEIINIISLAMHANLPYQMLRDQIYSHPTMAEGLNDLFETIGMN

SEQ ID NO: 48060 - protein, 310 aa, Crocosphaera watsonii WH 8501
MQTIDKQNLKPNNNISSLSSTSIGEQKKEKIGKKVAIIGCGYVGKAVASYWYQQGYIVTGTTTREEKISDLENITHNPVVVRGDNLEAIEKVVEDQETILVSIAPISDRQVSAEVYAQTYIPTAKNLVTVLNNNSTVKQVIYLTSGSVYGDKKGEWVDETSPLDTESDYGKVLVEAENIILGLKREDIKVCLLRLGGIYGPGRKLNKRLGRMAGKTLPGNGENYVAWIHLEDIVKGIEFVQEKGCHGVYNLVNDMKLNSKELCDLICDRQQLERVYWDDSKPSFSSLNARVDNSKIKQEGYQFIYADTLI

SEQ ID NO: 48061 - protein, 392 aa, Francisella tularensis subsp. holarctica
MSFLTLKDVDLKDKKVLVRVDFNVPVKDGKVTSKVRIEAAIPTIQYILDQGGAVILMSHLGRPTEGEYDSQFSLEPVAKALSEIINKPVKFAKDWLDGVDVKAGEIVMCENVRFNIGEKKSTDDLSKKIASLGDVFVMDAFATAHRAQASTYGVAKYIPVACAGILLTNEIQALEKALKSPKKPMAAIVGGSKVSTKLSVLNNLLDKVEILIVGGGIANTFIKAEGFDVGNSLYEQDLVAEATEILAKAKALGVNIPVPVDVRVAKEFSENAQAIIKKVSYVVADEMILDIGPESQKIIAELLKSANTILWNGPVGVFEFDNFAEGTKALSLAIAQSHAFSVAGGGDTIAAIEKFGIKDQVSYISTAGGAFLEFLEGKKLPAIEILKEKAIR

SEQ ID NO: 48062 - protein, 478 aa, Francisella tularensis subsp. holarctica
MRRTKILATLGPASESREALTEMIKAGVNAVRCNFSHGSAEDHRKRVDLIRQIAKEQDTHVGILADLQGPKIRLSKFKNGSVEIKKGQKFTLDADLGINDGDENTVGIDYKELIQDVKKGDILLVDDGKIVLEVDSVKGNKAVTKVVVGGKVSNNKGINKKGGGLTAPALTEKDKEDIKIAAMLQVDFLAVSFVRDGKDMEYARQLVHEAGWRPAMVAKIERAEAVLEDNLKSIVDASDLVMVARGDLAVEIGDENVPTIQKLIINTARRNEKGSITATQMMESMIENSSPTRAEASDVANAVFDGTDAVMLSAETAVGKYPVETVSAMSRICKSAEKSKYTHISKKQKIADCDRIDHAVSVAAVKIANDIGAKGLIVLTEGGNTSRWMSRINTDLPIYALSRNATTLGAMTLFRGVVPIYFDSTRMSKLYVNRSACMELESRNLAKDGDIFVLTSGDSMGVHGSTNKIKVIIAGQVR

SEQ ID NO: 48063 - protein, 408 aa, Mesorhizobium sp. BNC1
MNAPFEKDRRNRRVAVVVVAAGRGERAGQAQNGPKQYRLIGGKPVIRHTLEVLAKSKRVGTIAVAVHPEDSSLFNQAREGLDGDIRAVHGGASRQESTRLALAALEEVKPDIVLIHDGVRPFIDEALIERVIEAVGEDSGALPALPVSDTLKRSGVNGIITGTVPRDGLFAAQTPQGFPFRPIYEAHQKAWQSGRSDFTDDAAIAEWAGISVRLVSGSPDNVKLTWAKDIALADQRLGPAMTELPDIRVGNGYDVHGFGPGGHVTLCGVQIPHGKTLMGHSDADVGLHALTDALLATCGAGDIGTHFPPSDPQWKGAKSRIFVEHAVNLLRARGGRIANADVTLICEAPRIGPYREAMLAELSDMLQISPERVSVKATTNEGLGFIGRAEGIAAIATATVAYPGSLGN

SEQ ID NO: 48064 - protein, 622 aa, Saccharomyces cerevisiae YJM789
MLFYSFVWSVLAASVALAKTHKLNYTASWVTANPDGLHEKRMIGFNGEWPLPDIHVEKGDRVELYLTNGFQDNTATSLHFHGLFQNTSLGNQLQMDGPSMVTQCPIVPGQTYLYNFTVPEQVGTFWYHAHMGAQYGDGMRGAFIIHDPEEPFEYDHERVITLSDHYHENYKTVTKEFLSRYNPTGAEPIPQNILFNNTMNVTLDFTPGETYLFRFLNVGLFVSQYIILEDHEMSIVEVDGVYVKPNFTDSIYLSAGQRMSVLIKAKDKMPTRNYAMMQIMDETMLDVVPPELQLNQTIQMRYGHSLPEARALNIEDCDLDRATNDFYLEPLIERDLLAHYDHQIVMDVRMVNLGDGVKYAFFNNITYVTPKVPTLTTLLTSGKLASDPRIYGDNINAQLLKHNDIIEVVLNNYDSGRHPFHLHGHNFQIVQKSPGFHVDEAYDESEQDEMTVPYNESAPLQPFPERPMVRDTVVLEPSGHVVLRFRADNPGVWYFHCHVDWHLQQGLASVFIEAPALLQEREKLNENYLDICKAADIPVVGNAAGHSNDWFDLKGLPRQPEPLPKGFTTEGYLALIISTIIGVWGLYSIAQYGIGEVIPNDEKVYHTLREILAENEIEVSRG

SEQ ID NO: 48065 - protein, 263 aa, Aspergillus oryzae
MDSLTTHPSTAQQARAFTSPASLSFPGGAGDLTPPSDKDGNMAMNLQGVNGHVNGQQQGGNATNGNGVTPATPVATPGANTPGSGIVPTLQNIVATVNLDCRLDLKTIALHARNAEYNPKRFAAVIMRIREPKTTALIFASGKMVVTGAKSEDDSKLASRKYARIIQKLGFNAKFTDFKIQNIVGSCDIKFPIRLEGLASRHHNFSSYEPELFPGLIYRMMKPKIVLLIFVSGKIVLTGAKVREEIYQAFELIYPVLSDFRKV

SEQ ID NO: 48066 - protein, 307 aa, Nostoc sp. PCC 7120
MTKQLVLMDHDGGVDDYLATMLLLTMDNVQLMGVVVTPADCYVQPAVSATRKIIDLMGFSHIPVAESTVRGINPFPRLYRRDSFIVDHLPILNQTELIHTPLVEETGQDFMVRVLQEALEPVTLMVTGPLTTVAVALDQAPDIEAKIDKIVWMGGALNVPGNVEKSLEAGQDGSAEWNVYWDAVSAARVWQREIKIIMCPLDLTNDVPVTSELVYKMGRQRHYPVSDLAGQCYALVIPQDYYFWDVLATAYLGHPEFYQLREWETEIITSGLSQGRTKVVTGGRKILAMDKVDKDAFYAYILQQWAR

SEQ ID NO: 48067 - protein, 446 aa, Picrophilus torridus DSM 9790
MKEYDVVTIGAGGAAYPAAFKLKRSGYNVIMIDKKGVMSGNCLSEGCVPSKAIIESVHKYNTLKGIFDFKVDYKKIVDHKDSVQRLRYSDHDRELGEADLKIIKGTGRLVDENTVEVDTGTGIERYHADNIIIATGADTFIPNIKGSELAVTSRDFYSMDPKIKSVPESITIIGGGYIGVETGSFLSILGSRVTIIEMLDRILESMETDIIDKLIPLLPRMDVKTSSEVKSIEKFNDKLKVLLNDGEVVSDMVMMAAGRHPVLPEGLDDLGIKYTKHGINVNMSMQTNIKNIYATGDVNGITPLFHAAKRQSIIAANNIMSGNVPVDYFDPISVPFTLYTIPQLAYVGILPAQAERLGIEHYEATYDMKKDSLAEINNEVYGEITLVFDKRMKIIGGYVIGNDAGNIINEIALCVSRGLSLRDLAEMSHQHPMSFEGLDSAARKFY

SEQ ID NO: 48068 - protein, 487 aa, Mesorhizobium sp. BNC1
MAESYDVIIIGSGPGGYVTAVRSAQLGLKTAIVEREHLGGICLNWGCIPTKALLRSAEILHYAQHAKDYGLKLDGSIAPDTAAVVDRSRKVSARLNTGVGFLMKKNKVDVIWGEAKISKAAKANEPGEIVVSKPSKKAMEPQHPAPKNTLGEGTYKAKHIILATGARPRVLPGIEPDGKLIWTYFEAMVPKEMPKSLIVMGSGAIGIEFASFYRTMGADVTVIELLPQILPVEDAEVSKFARRQLEKQGMKFHVEAKVTKVEKGANQITAHVEMKDGKVEKITADRLISAVGVQGNVENLGLEALGVKVERGTVAVDGYGRTNVPGIYAIGDVAGPPMLAHKAEHEGVICVEKIAGVPGVHALDKSKIPGCTYCQPQVASVGLTEEKAKEAGRDIRVGRFQFGANGKAIALGEDQGFIKTILDKKTGELLGAHMVGAEVTELIQGFVVAMNLETTEEELMHTIFPHPTLSEMMKESVLDAYGRSLNA

SEQ ID NO: 48069 - protein, 392 aa, Mycobacterium avium subsp. paratuberculosis K-10
MQNERVQGFGFHTLALLTAVGFAGPLLASAKRFRIPVVIGELIAGLAIGRTGFGVVDVADPTFQLLANIGFALVMFVVGTHVPLRARLMRSALPAALARATLAGGIAAVLGVALAVQFDTGHAALYAVLMASSSAALALPVIDSLRLRGPRVLSVTTQIAIADAACIVLLPLVIDIRRAPTATLGSLAVAGCAAALFVLLRAVDRKGWRRRLHAYSEQHRFALELRTSLLVLFALAALAVATQVSIMLAGFAVGLVVGAVGEPHRLARQLFGITEGFFSPLFFVWLGASLQVRELGAHPQLILLGAGLGCGAVLAHCAGRLLGQPLTLAVLSAAQLGVPVAAATIGTQQHLLAPGEASALMFGALLTIAAASIATGLAARRQGAPEPGEPAK

SEQ ID NO: 48070 - protein, 250 aa, Thermotoga maritima MSB8
MIRIKTPSEIEKMKKAGKAVAVALREVRKVIVPGKTAWDVETLVLEIFKKLRVKPAFKGYGGYKYATCVSVNEEVVHGLPLKEKVFKEGDIVSVDVGAVYQGLYGDAAVTYIVGETDERGKELVRVTREVLEKAIKMIKPGIRLGDVSHCIQETVESVGFNVIRDYVGHGVGRELHEDPQIPNYGTPGTGVVLRKGMTLAIEPMVSEGDWRVVVKEDGWTAVTVDGSRCAHFEHTILITENGAEILTKEG

SEQ ID NO: 48071 - protein, 172 aa, Zea mays
  misc_feature (162)..(162): Xaa can be any naturally occurring amino acid
MEHKEAGCQQPEGPILCINNCGFFGSAATMNMCSKCHKEMITKQEQAQLAASSIDSIVNGGDGGKGPVIAASVNAAVPQVEQKTIVVQPMLVAETSEAAAVIPKAKEGPDRCAACRKRVGLTGFSCRCGNMYCSVHRYSDKHDCQFDYRTAARDAIAKANPXVVRAEKLDKI

SEQ ID NO: 48072 - protein, 560 aa, Ralstonia metallidurans CH34
MYQYDQYDQRIVQERVAQFRDQVRRRLSDELTEEEFLPLRLQNGLYMQRHAYMLRVAIPYGLLASKQMRMLAHIARTYDRDYGHFSTRQNIQYNWMDLERVPDVLDDLASVEMHGIQTSGNCVRNITTDQFAGVAPDETVDPRVLAELLRQWSTFQPEFAFLPRKFKIAISSSADDRAVVQMHDIGIYAYKNAAGETRLRILAGGGLGRTPILGTIIKEDLPWQHMLTYVESAIRVYNRYGRRDNKYKARIKILVKAIGAEKFAAEVEEEWKFSKDGPGTLTQAEFDRVAQYFQPPAYEKLPDTDASFEKHLLENKAFARWVNRNVHAHKVPGYASVTLSTKPGPVSPPGDATSAQMDTVADFADRYGYGELRVAHEQNLVLPDVKKRDLFALWEDAKKAGLATANIGLLTDIIACPGGDFCSLANAKSIPIALAIQERFDNLDYVYDLGDISLNISGCINACGHHHVGNIGVLGVDKDGAEWYQVTIGGAQGNDTALGKVIGPSFSAHEMPDVVSRIIETFVANRVGDERFIETVGRIGIAPFKERVYADKQREERAEA

SEQ ID NO: 48073 - protein, 618 aa, Synechococcus sp. CC9311
MEAASLVSKDLSLDSVNEGLTTTSGTQEAGRDRMLDGPSTPTESIDTALSKAEKRKLYSGHLREPLLTELSNEEIRFSEDAVQLLKFHGSYQQNHRELRKIDKIKCWQMMLRLRNPGGRVPAQLFSALDDLSNQYGNGTLRITTRQAFQMHGIPKADLKTVIGTIIKNLGSTLAACGDINRNVMAPAAPFENNGYPAARKLADEIADLLSPKAAEGSYLDMWVNGDLSYRFKPAKPVKQARKRQFEEGVFSGSQDEPIYGDTYLPRKFKVAVTVPGDNSVDLLTQDIGLVLFTNKNGTMRGCNVYVGGGLGRTHNQEDTFARIADPLGYVDAENIFDLLQSIMALQRDHGDREVRKHARMKYLLHNRGIQWFRETLINHYFKRDIKSLIKESPAKLMDYLGWHRQKPGLWFVGLPFMCGRLEGSVKAGIRTIVERYQLEIRLTPNQDLLLCNIGSNQKSSIKSELTELGFELPAEVAPLVRHALACPALPTCGLAVTESERVLPDVLERLDSQLNHLEIKKSILVRMTGCPNGCARPYMAELGLVGSGVNQYQLWLGGSANLQRLARPFLQKMPLEDLETTIEPLLLSWKDAGGRRGFGEHISKLGDATVQEMLKVPS

SEQ ID NO: 48074 - protein, 361 aa, Bordetella pertussis Tohama I
MDDSLQDKLRPLRDRIDAIDAQILDLLSQRARTAQEVGSVKHAAHADGPVLRPEREAEVIRRLQYSNPGPFPKAAVAAVWTEIMSACRGLERGMTVAYLGPQGSFSEQAALEHFGHSVQQLPCPSFDEVFRAVEAGQADVGMVPVENSTEGAVNRSLDLLLNTPLTILGERSLVIRHCLMSQSGTMDGIKTISAHPQALAQCQGWLTRHYPDLNRVAAASNSEAARVAAEDPTVAAIAGEVAAPAWNLRVVAAGIQDDPQNRTRFLAVGHIEPLSSGKDKTSLILAVPNRAGAVYDMLAPMAANGVSMTRFESRPARTGQWEYYFYVDVLGHRDDANVARALAALQAQVAFFKVLGSYPAQ

SEQ ID NO: 48075 - protein, 432 aa, Vibrio campbellii AND4
MSLSSPPKPFQRKPSQLNLSPFNPNPLSVSIDKLREQFPALQCQNMGHTPIYFDGPGGAQQPISVIESYGNYLKQGNTNLGGHFSVSRKTGELVDTCRMKAAALFGADKKEEIVFGANMTSMTFHFSRAISQDWNEGDEIILSTADHGSNRSSWVMAARDKGVKVHYIPILDNTCKLDLEAYAGLLNDKTRLVAVTAASNLTGTIVDIDKVTRLAKANGSVVFIDAVHLLPHKIMDVASLGADFVAGSAYKFFGPHLGVFYGRHAALEHYSPYKVEPAPSCSPNCWETGTLNFEALSAFSSTIDYLASLGSGTGLREKLISGYNNIGQYENQLAEKFLTHLNAFPSIELFGEPNVNNRTATFALRFGKLHPADVASYLGEQEIYTWSGHLYADKLTDALKITQQGGVLRVGLMHYNTEKEIERFFSALETIL

SEQ ID NO: 48076 - protein, 349 aa, Yarrowia lipolytica CLIB122
MTTIPKTQKAVIFETSGGPLMYKDVPVPVPADDEILVNVKYSGVCHTDLHAWKGDWPLDTKLPLIGGHEGAGVVVAKGKNVTTFEIGDYAGIKWINKACYTCEFCQVAAEPNCPKATMSGYTHDGSFQQYATANAVQAAHIPKNCDLAQVAPILCAGITVYKALKTAGLKAGEWAAVTGAGGGLGSLAVQYAKAMGYRVLAIDTGADKEKMCKELGAEVFIDFAKSKDLVKDVQEATKGGPHAVINVSVSEFAVNQSVEYVRTLGTVVLVGLPAGAVCKSPIFQQVARSIQIKGSYVGNRADSQEAIEFFARGLVKSPIIIVGLSELESVYKLMEEGKIAGRYVLDCSK

SEQ ID NO: 48077 - protein, 545 aa, Shewanella sp. ANA-3
MTILTQSTTWQALAAHSQQIPHMRELFASDPARFSNMSLSTCGLFLDYSKNRATPETLNLLLTLAQEAKLDAKIKAMFAGDIINTTEKRAVLHTALRSTAEQTIIAEGQDIVPEVQQTLNKMQQFVTSVTSGQWKGFTGKTITDIVSIGIGGSFLGPKIVSQALRPYWMTGLNCHFVANVDGTSISEKLKLLDPETTLFIMSSKSFGTQETLTNTLTAKAWFLAKGGSQSDVAKHFVAVTSNVAKATDFGIDADNIFPMWDWVGGRYSLWSAIGLPIALLIGMDNFRSLLKGAHQMDTHFANAPLAENMPVIMGLFSLWYGNFFNAQSHVVLTYDHYLRGLPAYFQQLDMESNGKSVTLNGTHVDYSTGPVIWGGEGTNGQHAYHQLLHQGTALIPADFIMPLQSHNPIGEHHDQLASNCFGQTQALMQGRTLDEALAELSKSNLSDEEKLLIAKHKVMPGNKPSNTLLMDKLTPETLGALIALYEHRTFVQGAIWDINSFDQWGVELGKSLGNDVLARIGAEQDATALDASSNGLINLYRQGKI

SEQ ID NO: 48078 - protein, 368 aa, Triticum aestivum
MASRNPPLVIHVDPDGPPGRKAPDIGNRSMMGTSCVDDTDLEDVKASKDRDMPSHLLRFPNIQNQSLLSGFAYCIASCSMILVNKFVLSGYGFNAGIFLMIYQNIVSVTIVSALSLSGVIPTEPLTWKLIKVWLPVNIIFVGMLITSMFSLKYINVAMLTILKNVANVLTASGETYFFKKQHDRQVWISLMLMIISAIAGGITDLSFHAVGYTWQILNCFLTASYSLTLRHVMDSAKQATKSGNLNELSMVLLNNILSLPLGIILVLGFNEVEYLLETPLLRMPMFWLVITASGVLGLAISFTSMWFLRQTSATTYSLVGSLNKIPLSIAGILLFKVRTSMENSISILLGLLAGVFFARAKLRNNSQS

SEQ ID NO: 48079 - protein, 422 aa, Synechococcus sp. CC9311
MTTLNRNAAVTLAERVRADFPIFDQVSSSGQPLIYLDHAATSQKPRVVLDAIQHYYACDNANVHRGAHQLSARATESFEAARATTAGLIGASSSKEIVFTRNATEAINLVARSWGDAQLKAGDEVLLTVMEHHSNLVPWQLLADRTGCVLRHVGVTPDGTLDLADLREQLSEKTRLVSLVHISNTLGCCNPIEEIAVLAHAVGAKVLVDACQSLAHKSIAVKTLGADFLVGSSHKLCGPTGMGFLWASEEILMAMPPFLGGGEMIQEVFLDHSTWAELPHKFEAGTPAIGEAIGMGAAITYLQTLGLDAIQAWEAELTTHLFSRLQSINGLRILGPTPEQQPERGALATFVVEGVHANDIAAMLDLAGVCIRSGHHCCQPLHRLYGVTGSARASLSFCTTHAEIDRFADELVSVIDFFRENG

SEQ ID NO: 48080 - protein, 390 aa, Thermus thermophilus HB8
MALPLYLVGLSHKTAPLEVRERAALDPVVALPAALSALGKGVVLSTCNRTELYGVGSPEKARAFLLSRGVAPRHLYVKEGVEALRHLYRVAAGLDSLVVGEAQILGQVREALFLARRQGATESLLEKAFQSAIALGKRARSETGIGMGAVSVAYAALDLALAVYGDLSGLSVAVLGAGEMAELFLTHLKAHGVGRILVVNRTEEKAQALAERFGGEAFGLPALPQVLRQADLVVASAAAPHYLVGPEDLPKRAKPLFLIDIALPRNIDPRVGDLPHAYLYNLDDLKRVVDRNLRARAGEIPKVEALIEKALGDYMEWYAGHRVREAIRALEAWARVQAAKAQPEAGPVELEKAAGRLAHPFILGLKRRALDRVGGPPCPEDCLLYRLSRT

SEQ ID NO: 48081 - protein, 457 aa, Haemophilus influenzae R2846
MSAGKIVQIIGAVIDVEFPQDAVPKVYDALKVESGLTLEVQQQLGGGVVRCIALGTSDGLKRGLKVENTNNPIQVPVGTKTLGRIMNVLGEPIDEQGAIGEEERWAIHRSAPSYEEQSNSTELLETGIKVIDLICPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLDSTSRQLDPLVVGQEHYDVARGVQGILQRYKELKDIIAILGMDELSEEDKLVVARARKIERFLSQPFFVAEVFTGSPGKYVTLKDTIRGFKGILEGEYDHIPEQAFYMVGSIDEVLEKAKNM

SEQ ID NO: 48082 - protein, 221 aa, Aspergillus nidulans FGSC A4
MSKFGVLVMGPAGAGKTTFCNALIQHCQTTRRSCFYVNLDPAAESFQYDPDLDIRELVTLEDVMEELGLGPNGGLIYCFEFLLQNQDFLTEALDPLSEEYLIIFDMPGQIELYTHVPLLPSLVQFLSRAGPLNINLCAAYLLESTFVVDKAKFFAGTLSAMSAMLMLEMPHVNILTKMDQLDVQDEDSVAAVLSHIDDAIQFHEAQEPKEPNDAQDVDYED

SEQ ID NO: 48083 - protein, 435 aa, Schizosaccharomyces pombe 972h-
MNSQTSVVGVHYRVGRKIGEGSFGVIFDGMNLLNNQLIAIKFEPKKSEAPQLRDEYRTYKLLVGNAGIPNVYYFGQEGLHNILVIDLLGPSLEDLFEWCGRRFSVKTVAMTAKQMLSRVQTIHEKNLVYRDIKPDNFLIGRPSSRNANMVYMVDFGMAKYYRDPKTKQHIPYSERKSLSGTARYMSINTHLGREQSRRDDLESLGHVFMYFLRGSLPWQGLKAANNKHKYEKISEKKQSTSISELCAGFPNEFSKYMTYVRSLEFDEEPDYAFLQELFDDVLRANGDTNDGVYDWMLLNDGKGWESSSSHFSVVAMKRRKNYLGLNVVQNDDSRKKNSTLQTQNMRFKSSYGVRGPRNYSSFDALPSKNAPLVRQEQSASKKTIYAHSSRGYDRVRPMYVSQPSNNAVGVNHPNDNSDSEAKGGFFDMICCRCFS

SEQ ID NO: 48084 - protein, 464 aa, Sulfitobacter sp. EE-36
MAAKSFDLIVIGAGPGGYVAAIRGAQLGLSVAIVEREHLGGICLNWGCIPTKALLRSSEVFHLMQRASEFGLKAENIGYDLEAVVKRSRKVAGQLSGGIGHLMKKNKVSVFMGAATLAGKGKVSVKSKDGEETLTAKNIVLATGARARNLPGLEADGKRVWMYKDALQPPHMPKKLLVIGSGAIGIEFASFYNTLGADTTVVEVMDRILPVEDEEISKFAKKQFEKQGMKIMQKAVVKQLDRADDKVTAHIETGGKVTKHDFDTVISAVGIVGNVEDLGLEDLGVKIDRTHVVTDEYCRTGVEGLYAIGDIAGAPWLAHKASHEGVMVAELIAGQHAHPVKPESIAGCTYCHPQVASVGYTEAKAKELGFDVKVGRFPFIGNGKAIALGEPEGMIKTVFDAKTGELLGAHMVGAEVTELIQGYVVGRQLETTEEDLMNTVFPHPTLSEMMHESVLDAYGRVIHM

SEQ ID NO: 48085 - protein, 375 aa, Mycobacterium leprae TN
MSKALLVLEDGRVFTGMPFGAIGQTLGEAVFSTGMSGYQETLTDPSYHRQIVVATAPQIGNTGWNDQDGESRDDRIWVAGYAVRDPSPCASNWRATGTLEDELVRQRIVGIAGIDTRAVVRHLRRYGSMKAGVFSGKAMIEPLNIEALVQHVRTQQSMLGADLVGEASTLDAYVVEPKGKERFTVAALDLGIKTNTPRNFARRGIRSYVLPASATFNQIADIKPHGLFLSNGPGDPATADHVVALTREVLNAGIPLFGICFGNQILGRALGLSTYKMVFGHRGINIPVIDHATGRVAVTAQNHGFALEGEAGQSFDTPFGSAVVSHTCANDGVVEGVKLADGRAFSVQYHPEAAAGPHDAEYLFDSFVELMAAQR

SEQ ID NO: 48086 - protein, 410 aa, Crocosphaera watsonii WH 8501
MNQENAFLPHVIAPKLLKIIESQTPIGKFYKKATYMSLKNEPGSLDFTIGDSHEMPLHGFVEALQKNAIPQKIGWYGYKVSLPETKKIVSEALKKHRGISIVPDDIFMTNGTIVGLAICLKMLAEEDDEVILNLPPWFGYRKMIQSVGANPIGIPVKPQTFDLDLEKIADSITEKTRAILINSPHNPTGKIFSASTFEKLANILTEASKRYGKPIYLISDETFSRIIFDNQECLSPTQFYPYSFLVYGYSKTWMAPGQRIGYIALPETMPNRPEIRSLIGQLQGLYFGWCFPSALMQYALEDLEKLDLNLDKLQAKRDRMVTELQNMGYEVNIPQGTFFLLVKSPWEDDGAFAELLATNYQVFVFPGTPQEIPGYFRLSLTANDEMITQALPKFKAAREEALKIESKTGS

SEQ ID NO: 48087 - protein, 172 aa, Crocosphaera watsonii WH 8501
MMKLIKALFFRFLTLIALVLVATIWILLDARPVIAQDNTVNYTYGELQQQDFSHKDLEKGVFAAADMREANFEGSNLSYAIFTEATLLKANLKGANLTSSLLDRVTLDFADLTDAILIDAIATRTRFYDAVITGADFTDAVIDRYQVSLMCERAEGVNPVTGVSTRDSLGCR

SEQ ID NO: 48088 - protein, 471 aa, Anaplasma phagocytophilum HZ
MDKYEVVIIGSGPGGYIAAIRAAQLGYNVAIVEREDNLGGVCLNWGCIPTKALLKSAQLYKKILSASSFGIKITGDVEVDIQSIVAHSRDAVAKLSCGVSMLMKKNGVKVYKGCARIAGKGEIHVDNDGVKSALSAKHIILATGGRPRIATNLDTKLLWSSKDAMLPETLPKSLLIIGSGAIGIEFASFYSTIGSKVTIVEMQDRILPLEDRDISLSMHEILKNQGVDIFTACSVMDLVQSASSITAQIVNSGTKDTVTSSFERVICAIGILPNSGNLGLEDTKVQLDKGGFIITDGMCQTSEPGIYAIGDVAGPPCLAHKASHEAVICVEGIAKKDGRISTAPSTLHKNNIPSCIYSIPQIASVGLTEDAAKAQGLEIKVGISRASCNGKAIASGESEGFVKVILCSKTGELLGAHMLGSEVTEMINGYIVGRQLEATDLDIAHTIFPHPTLSEMMHSAILSAWNEPLDS

SEQ ID NO: 48089 - protein, 406 aa, Cryptococcus neoformans var. neoformans JEC21
MESPSRPPTPPLPTLAPSSSKGQKRDESILELNSLLDRETAKSKLRRLAISTSCLPPLFNPLCPSTTLAACKQVRHECTKAHFDPIQRPWTDSTLGFCSYLNLCYGDPMFTKNPSLGDGSGPRGGTKDCRYQHFQVTPSTIRCTQPLPEGYPSVMPGYLKKRVLGDEDVERQDKEADVAQWVNCDLRRFDYSLLGQFQVIVADPAWDIHMTLPYGTITDDEMRNMPIRSLQPDWGILCLWVTGRAMELGRVVFAHWGYKRVDELVWVKTNQLQRLIRTGRTGHWLNHTCEHLLVGLKLPQNFPRDAPIPWDTEPALRHLRKCVDTDVVVAEVRETSRKPEEVYGVIERLAPKGRKLELFGRKHNTRPGWVTLGNQLGDSQIAEPDLYDRLVKAYPKQKFTFVPSKQ

SEQ ID NO: 48090 - protein, 424 aa, Mesorhizobium sp. BNC1
MTAIVDIVGREILDSRGNPTVEVDVVLEDGSIGRAAVPSGASTGAHEAVELRDGGPRYLGKGVARAVEAVNGEIFEAIGGLEAEDQIHIDRTMIELDGTPNKSRLGANAILGVSLAVAKATAAASGLPLYRYVGGASAHILPVPMMNILNGGAHADNPIDFQEFMIMPVGAPTLRDAVRWGSEIFHTLKSGLKAAGHNTNVGDEGGFAPNLKDANAALDFIMASIEKAGFKPGDEVAIALDCAATEFFKDGKYVYEGEGQTRDAQAQAEYLSKLAGEYPIISIEDGMAEDDFEGWKALTDLAGSKVQLVGDDLFVTNAARLKDGINMGIANSILVKVNQIGSLTETLEAVETAHKAAYTAVMSHRSGETEDSTIADLAVATNCGQIKTGSLARSDRLAKYNQLIRIEEQLGRAARYAGRTVVRG

SEQ ID NO: 48091 - protein, 325 aa, Populus trichocarpa
MGRIGYFGMLIFGLLAFMGSTEAQLKMGFYNTSCPKAEKIVQGFVNQHIHNAPSLAATLIRMHFHDCFVRGCDASVLLNTTSGEQPEKAATPNLTLRGFDFIDRVKRLVEAECPGIVSCADILTLVARDSIVATGGPFWRVPTGRRDGLISRSSEALSNVPSPMINFTTLQTLFANQGLDLKDLVLLSGAHTIGIAHCQSFSNRLYNFTGTGDEDPALDSEYAANLKARKCRSISDNTTIVEMDPGSRKTFDLSYYKLLLKRRGLFQSDAALTTNSNTLSMIRQILQGSIDFRSEFSKSMEKMGRIRVKTGSNGEIRRQCALVNS

SEQ ID NO: 48092 - protein, 434 aa, Nostoc sp. PCC 7120
MTQATSTPTQTTNATLSALKCKECGAEYELKATHVCEYCFGPLEVKYDYNALRLSVTREKIQAGPNSIWRYRPFLPVTTDNVIDVGTGMTPLVRSHRLARRLGLNKLYIKNDAVNMPTLSFKDRVVSVALSRARELGFTTVSCASTGNLANSTAAIAAHAGLDCCVFIPADLEAGKILGSLIYSPTLMAVKGNYDQVNRLCSEVANTHGWGFVNINLRPYYSEGSKTLGFEVAEQLGWELPDHIVAPLASGSLFTKIYKGFQEFVEVGLVEGKKVRFSGAQAEGCSPIAQAFKEDRDFIKPVKPNTIAKSIAIGNPADGVYAVDIAKKTGGNIESVNDAEIIEGIKLLAETEGIFTETAGGTTVAVLKKLVEAGKIDPDETTVVYITGNGLKTQEAVQGYVGEPLTIDAKLDSFERALERSRTLDRLEWQQVLV

SEQ ID NO: 48093 - protein, 335 aa, Anaplasma phagocytophilum HZ
MIRVGINGLGRIGRCLFRLLCSLDSSSKIELAAVNGSSSIDLHRHLLKNDSVHGVYEHAIEKIGEDFFSVNGKKIKFFCERDPENVPWDSCGVDVVFECTGKFNKKPLAAKHIRGTVKKVIVSAPVDGADLQVIYGINEGSITNDHKVISVGSCTTNCAAHVVGAIDREFGIDGGFITTVHAYTNDQNHVDGSHKDFRRARACGLSMIPTSTGASKALSLLFPHLDGKISVAAVRVPTPNVSMVDFTFVPSVKVPRSSINDALSKAADIRKDVLLATEEMLVSVDFNHTTYSAIFDLCETHVNDANFSRVVAWYDNEWAFANRMLDVALIAQKFL

SEQ ID NO: 48094 - protein, 254 aa, Mesorhizobium sp. BNC1
MTPTIRPLIAGNWKMHGTESSLGELKAIGSGFVEAAGAGADGVICVPATLLARASDILAKTPVATGGQDCHPATSGAHTGDIAAEMLADCGASYVIVGHSERRTDHHEADEDVAAKAEAAWRAGLTAIICIGETKIQREAGETLSVLSRQIAGSVPPGATAKNSVIAYEPVWAIGTGLTPTVEDVAQAHAHLRAELGMKLGIEADGMRLLYGGSVKPSNAGELLSILNVDGALIGGASLKAADFLAISAAVKGK

SEQ ID NO: 48095 - protein, 62 aa, Glycine max
MLGCFSGKCSGSIRSIVKHPELPVIASCGLDSYLRLWDTKTRQLLSAVGFIPLFLCPWQHAI

SEQ ID NO: 48096 - protein, 401 aa, Photobacterium sp. SKA34
MTIEILVPDLPESVADATVATWHKQPGDAVSRDEVLVDIETDKVVLEVPAPEDGVLEAIFEGEGTTVLTKQLIGKIKVGAVAGEPTKDVPTEAEASPNKRNTASLTEETSEALSPAVRRLLSEHGIDAGAVKGSGVGGRITREDVEAYLKNQSAPAVTKAPVVDVAIAHRSEKRVPMTRLRKRVAERLLEAKNSTAMLTTFNEVNMKPIMDLRKQYKDIFEERHGIRLGFMSFYVKAVVEALKRYPEVNASIDGDDIVYHNFFDVSIAVSTPRGLVTPVLRDCDKLSLAEIEKGIRELAIKGRDGKLTVEDLTGGNFTITNGGVFGSLMSTPIINPPQAAILGMHKIQDRPMAVNGQVEILPMMYLALSYDHRLVDGRESVGYLVTIKELLEDPTRLLLDV

SEQ ID NO: 48097 - protein, 388 aa, Photobacterium sp. SKA34
MNLHEYQAKQLFAEYGLPVPEGYACDTPQEAAEAAGKIGGSKWVVKCQVHAGGRGKAGGVELHETKDGIKQFAQNWLGKNLVTYQTDANGQPVTKILVEEASNIANELYLGAVVDRGSRRIVFMASTEGGVEIEKVAEETPELIHKAAIDPLVGPQPYQGRELAFKLGLKGDQIKQFTKIFMGLANMFAEYDLALLEINPLVITGDNNLLCLDGKINIDSNAMYRQPKLREMHDPSQEDEREAHAAQWELNYVALDGNIGCMVNGAGLAMGTMDIVNLHGGQPANFLDVGGGATKERVTEAFKIILSDSNVKAVLVNIFGGIVRCDLIADGIIGAIAEVGVKVPVVVRLEGNNAEVGAAKLADSGLNIIAATSLTEAAEKVVAAAEGK

SEQ ID NO: 48098 - protein, 425 aa, Mesorhizobium loti MAFF303099
METMVDFPIEAVRGQFPALSLTDKGRRRIYLDNPAGTQVPQAVADAVSRCLLTTNANLGGYFETTIAAQSVVDDAHRAMADFLGAASPEEIIIGANMTTLTYHMSRTLGRTLKPGDEIILTRMDHEGNVSPWLQLAEDLSLVVRWLPFDEKSWQVEEAALTGLLSDKTRLVALNYASNLTGSINRVKALTAIAKRAGALVYVDAVQFAPHGLIDVQDLGCDLLICSAYKFFGPHMGILWGRREIIDGLKPYKCRCSSNGLPERFELGTPQIELMAGLMAAVDYFAGLGVAAGEGGSRRQKIARAFEVSIAYENPLAQRLIDGLSDIPGLTIHGITDRKRLADRVPTVSFTVDGIVPETIVRQMNAENIFLWSGHNYAWEIVHQLGIPAEQGVVRIGIAHYNTAAEIDETLESVHRVIAMLRQQRS

SEQ ID NO: 48099 - protein, 590 aa, Shewanella sp. ANA-3
MDPHVSHSAHLFSLRIAHALSEACVKDKYSVKRFGQDLLAGLTVGIIAIPLAMALAIASGVAPQYGLYTAIVGGFIIAMTGGSRYSVSGPTAAFVVLLYPIAQQFGLAGLLIATVMSGMMLVAMAMLRLGRLILYIPESVTLGFTAGIGVVIATLQLKDFFGLHIEHMPEQYFSKIMALGQALPSLHLPSLLVAAATLATMLLWPKLKLPVPAHLPAIALGSILALVLNAMGADIETIGTRFHYQLSDGSVGTGIPAVLPHFEWPWLQTGANGQTFEFNLATFQALLPAAFAIAMLGAIESLLCAVVLDGMTGKRHSANSELLGQGIGNIITPFFGGIPATAAIARSAANVKAGAQSPIASMIHAIVVLVGLVALAGVLAYLPMSAMAALLLVVAWNMSEAPKAVHLLKTAPTSDILVFLTCFSLTVIFDMVIAISVGIILAALLFMKEIAEMTKLYDISSNKRYVDHPLPADWAVIKINGPLFFAAADRIFAEIASLTQDKQVIVLYLDGVSILDAGGLAALNKLIDKCKLNHTKLIIADLQFQPIRTLARAKVQPIEGVLKFYPTLREALAEAPVPEQIIESSTTVTH

SEQ ID NO: 48100 - protein, 230 aa, Zea mays
  misc_feature (136)..(136): Xaa can be any naturally occurring amino acid
MAGRDDLKLLGTWPSPFVTRVKLALALKGLSYEDVEEDLYKKSELLLKSNPVHKKIPVLIHNGAPVCESMIILQYIDEVFAGTGPSLLPADPYERAIARFWMAYVDDKLVAPWRQWLRGKTEEEKSEGKKQAFAAXEILEGALRECSKGGGFFGGDGLGLVDVALGGVLSWMKVTEVLSGDKIFDAAKTPLLAAWVERFSELDAAKVSLPDVGRLLEFAKAREAAAAPSN

SEQ ID NO: 48101 - protein, 303 aa, Bordetella pertussis Tohama I
MSTPTYPTIEQTVGNTPLVRLQRIPGAAGQARGNVILAKLEGNNPAGSVKDRPALSMILRAEERGEIHPGDTLIEATSGNTGIALAMTAAMRGYRMVLIMPDNLSLERRAAMTAYGAELILTPAAKGGMEYARDLATAMQAEGKGKVLDQFGNPDNPRAHIEGTGPEIWNQTDGRVTHFVSAMGTTGTIMGVSTYLKSRNAAVQVVGAQPAEGSQIPGIRKWPEAYMPKIFDRALVDAYESIAQAEGETMARRLAAEEGIFAGISSAGALVAALRVAERVENATIVFIVCDRGDRYLSTGVFN

SEQ ID NO: 48102 - protein, 461 aa, Mesorhizobium loti MAFF303099
MSKTQTADQITEARRESHLFYLSSLRRPLIDRAEGIYMWTQDGRRFIDGSSGPMVANIGHSNRNVLDAMKRQMDRATFAYRLHFENEPAEELARELAKKLPEGMDRIFFVSGGSEATESCIKLARQWAVATGQASRWKVITRFPSYHGGTLGSLSITGDDALAETFEPMMRVMPTVPAPTAWRDRDNLSMEQRGVRYADMLEEKILAEGPESVVAFIMEPIGGAATAALVAPDSYYARTREICDHYGILLIHDEVMCGAGRTGKFLGGDHWNCKPDIVALSKGLGSGYAPLGALAAPMRLVQPLLASGGFQHGHTYAGNPLACAAGLAVLGEMDRLDLIANAAAMGDVLMDGLKGLAKRFPFIADVRGKGLLTGAEMVADPETLRPIEQGKKATQRLLDLAYERGLIIYGRRVKGGVDGDNFMVAPPMIVTSEQVGEIISIIGDSLEVLASELDLPVEGRG

SEQ ID NO: 48103 - protein, 323 aa, Haemophilus influenzae R2846
MSHCVERKNITIQDKIMRKTLTVLGSINADHVISVPYFSKPGETLTGDNYQLVYGGKGGNQAVAAARLGANVEFIGCVGSDVIGETMKNAFAQEGIDTTHINTVSQEMTGMAFIQVAQSGENSIVLASGANAHLGEMVVRQSEAQIAQSDCLLMQLETPLSGVELAAQIAKKNGVKVVLNPAPAQILSDELLSLIDIITPNETEAEILTGIAVTDDEQSAVKAASVFHDKGIQTVMITLGAKGVFVSRKGKSRIIKGFCVQAIDTTAAGDTFNGGFVTALLEEKAFDEAIRFGQAAAAISVTKKGAQSSIPTRQETLEFLEHA

SEQ ID NO: 48104 - protein, 485 aa, Staphylococcus epidermidis ATCC 12228
MVEFMKKFNIKHSFMLTGFAFMVTTSLFSHQAHAEGNHPIDINFSKDQIDRNTAKSNIINRVNDTSRTGISMNSDNDLDTDIVSNSDSENDTYLDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGTSSGKGSHTGKKPGNPKGNTNRPSQRHTNQPQRPKYNQTNQNNINNINHNINHTRTSGDGAPFKRQQNIINSNSGHRNQNNINQFIWNKNGFFKSQNNTEHRMNSSDNTNSLISRFRQLATGAYKYNPFLINQVKNLNQLDGKVTDSDIYSLFRKQSFRGNEYLNSLQKGTSYFRFQYFNPLNSSKYYENLDDQVLALITGEIGSMPELKKPTDKEDKNHSAFKNHSADEITTNNDGHSKDYDKKKKIHRSLLSLSIAIIGIFLGVTGLYIFRRKK

SEQ ID NO: 48105 - protein, 467 aa, Musa acuminata
MEAKSTGRFTLGKQSSLAPDRDDGELQALRSGDLDGLQVLEEVDANIRLMYLANEGDLAGIEETLASGVDVNFRDIDDRTALHVAACQGFADVVQLLLDRGALVDPEDRWGSTSNFITIAPAKQPLADAVHYKNHEVIKLFEKHGAKLQVTPMRVENAREVPEYEIDPSELDFTNSVNITKGTFIIAKWRGIQVAVKKFSDDVMADEDKLWDFFIFCRSAFRDELALLQQIRHPNVVQFLGAVTQSSPMMIVTEYLRKGDLRAYLNRKRTLRPSSAVLFALDIARGMNYLHEHKPEAIIHRDLEPSNILRDDSGHLKVADFGVSKLLKVAKTVKEERPLTCLDTSCRYVAPEVFLNEEYDTKVDVFSFALILQEMIEGCPPFSYKQDNEVPKAYVSKQRPPFRAPPKQYGHGLKELIEHCWSENPADRPTFREIIDRLSKIQNHIAQKRRWKVSLFNFYLGLQLFSL

SEQ ID NO: 48106 - protein, 930 aa, Brucella melitensis 16M
MSRPDFFGWPSASDRISNASRFRECLQQLQVFREPCPVSREAGMAKWVYTFGDGKAEGAASDRNLLGGKGANLAEMSSLGLPVPPGFTITTEVCTYYYNNDRVYPSELDAQVQAALAHIATLTGRNFGDAEKPLLVSVRSGARASMPGMMDTVLNLGLNDETVQAIARESGDERFAYDSYRRFIQMYSDVVLGVDHGFFEEILEDTKADLGVEVDTALSADDWKNVIGLYKAKVEEELGQPFPQDPREQLWGAIGAVFSSWMNARAITYRRLHNIPAAWGTAVNVQAMVFGNMGETSATGVAFTRNPSTGENKLYGEFLVNAQGEDVVAGIRTPQNITEEARIAAGSDKPSLEKVMPEAFAEFLKVANRLEQHYRDMQDLEFTIERGKLWMLQTRSGKRTARAALKMAVEMAAEGLISEEEAVLRIDPAALDQLLHPTIDPRAERQVVGMGLPASPGAATGEIVFSSEEAEQAKAEGRNVILVRIETSPEDIHGMHAAEGILTTRGGMTSHAAVVARGMGKPCVSGAGSLRVDYRNGTMLAAGQTFRKGDVITIDGASGQVLKGSVAMLQPELSGDFGKLMEWADRARRMKVRANAETPADARTARSFGAEGIGLCRTEHMFFDGSRIVAMREMILSDTEEGRRLALGKLLPMQRSDFAELFEIMKGLPVTIRLLDPPLHEFLPHTDEEVDEVARSMGVDAAKLRDRADALHEFNPMLGHRGCRLAVSYPEIAEMQARAIFEAAVEAGKKTGEPVVPEVMVPLVSLKAELDFVKARIDAVAKEVMSEAGIKIDYMVGTMIELPRAALRAAEIAESAEFFSFGTNDLTQTTFGISRDDAAGFLTTYQNRVVIEQDPFVSLDVDGVGELVQIAAERGRKTREKIKLGICGEHGGDPASIAFCEKTGLDYVSCSPFRVPIARLAAAQAAVRKV

SEQ ID NO: 48107 - protein, 447 aa, Musa acuminata
MAEHFNKKSGLSGTVPLGSFNSMFSFTGSWKVDAAATKALAMDGFYFPLYKAKLISDDLLLRDDVKRAVPHSWDPPLLASFIENFGTHIITSVTIGGKDELYIKQHHSSQLSESEIEKYVKDIGDQRFLNMEHQTLNAPLNYKEKDVTVIFRRRGGDDLVQNHAEWVHTISSAPDVINMTFLPIVSLLNGQPGIQNLSRAVDLYLELQRVWAPAPVNIPGHQRKEPVCPSLQFSLMGPKLYISAEQVSVGRKPVTGLRLSLEGSKQNRLAIHLQHLATLPKIFLPHWDSHVAIGPPKWHGPEEQDCRWFEPIKWKNFAHVSTAPIESTETNIGDLSGVYIVTGAQLGVWDFGAKSVLHLKLLFSKVPGCTIRRSVWDHNPCPTFAQKLDDTSSSTSGDNSKLAKIVDMTEMLKGPQDVPGHWLVTGAKLGVEKGKIVVRVKYSLLNY

SEQ ID NO: 48108 - protein, 499 aa, Sulfitobacter sp. EE-36
MQELTHYLNGAHVKGTSGRFADVYNPATGEVQAKVPLANESEMDQAVKYAMAAQPAWAAVNPQRRARVMMKFVDLLNRDMDKLAEALSREHGKTLPDAAGDVQRGLEVVEYCIGAPELLKGDFTDSAGPGIDMYSMRQPLGVSAGITPFNFPAMIPMWMFAPAIVCGNAFILKPSERDPSVPLMLAELLEEAGLPKGIIQVVNGDKEAVDAILHHPVIQSVGFVGSTPIAEYIYGTGCANGKRVQCFGGAKNHMIIMPDADLDQAADALIGAGYGAAGERCMAISVAVPVGEETADRLIEKLVPRIEKLKVGPYTSGNDVDYGPVVTAAAKANIERLVQTGVDQGATLVVDGRDFKLQGYEEGFFVGPHLFDNVTPDMDIYKHEIFGPVLSTVRAKTYEEALGLAMDHEMGNGTAIFTRDGDAARDFAARVNVGMIGINVPIPVPLAYHTFGGWKKSVFGDLNQHGPDAFKFYTRTKTVTSRWPSGIKEGGEFNFKPME

SEQ ID NO: 48109 - protein, 105 aa, Oryza sativa Indica Group
SSSVGRRRRRRRRRRATGRSKQEEEEEASKEKKMQDWGPVLISWVLFILLSPGLLFQIPGKCRLIEFGKFQTSVVSILVHTILFFALDAIFLVAIGVQINLGSSP

SEQ ID NO: 48110 - protein, 144 aa, Sulfitobacter sp. EE-36
MLVSQILKTKADDSVTTVKPGTRISQAAAMLSEKRIGTLVVSADGKTPDGILSERDIVRTLGREGGGCLDDTVEALMTRDLITCAKDETADDILAKMTQGRFRHMPVLEDGVLIGLISLGDVVKARLMELSMEKDALEGMIRGH

SEQ ID NO: 48111 - protein, 319 aa, Staphylococcus epidermidis ATCC 12228
MRRLFAIGEALIDFIPNVTHSKLKDVEQFSRQVGGAPCNVAATVSKLGGKSEMITQLGNDAFGDIIVETIEQLGVGTQYIKRTNKANTALAFVSLQDDGQRDFSFYRKPSADMLYQPENIDDIQVFQDDILHFCSVDLIESDMKYAHEKMIEKFESVDGTIVFDPNVRLPLWEDKLECQRTINAFIPKAHIVKISDEELLFITGKRNEDEAIQSLFRGRVNVVIYTQGAQGATIYTKDDYRIHHEGYQVQAIDTTGAGDAFIGAIIYCILESRYSECKDLFKEKGKDILAFSNRVAALTTTKHGAIESLPTKEDIKDYN

SEQ ID NO: 48112 - protein, 333 aa, Sulfitobacter sp. EE-36
MATKLAINGFGRIGRNVLRALMERGDDDLQVVAINDLAPLETNAHLFEFDSVHGRFGRPVTLGDNTMDVGQGPIRVTAERDPAALPWGDVDIVLECTGIFTTREAAAKHLANGSKRVVISAPGKDAMKTIVYGVNHDLITAEDTVLSNASCTTNCMAPLAKTLHDAFGIKHGHMTTIHSYTGDQPVHDTAHSDLYRARAAALSMIPTTTGAAKTLGKVLPELDGLIGGTAIRVPTPNVSCVDLVVELSKEATVEEVNATLRTAAEGPLKGILGLVDRPLVSIDLNHDSHSCVVALDQTSVQSGTQLRVLGWYDNEWGFSNRMLDTSREVAKTL

SEQ ID NO: 48113 - protein, 347 aa, Picrophilus torridus DSM 9790
MYRYLILEDGTVYKGTAYGYEGETHGELVFTTSMSGYLETITDPSYAGQILIFAYPEIANYPLSYESMESDRIQVSGLITRDAHAEMPAGNLGISFDEFMRMNKVPGIDGIDTRHLVEKIRRKGVMKAWIRNTEKMPDDFPDTMSENLVGLVSRKRASFVKSGSKRILFIDVGTKNSLINNLAKIASLHIVPYNYDFDSIKDDYDMIFIPNGPGDPAHESLDELRDFIKRSFGSIPVTGVCLGNQIIALAAGARTEKMKFGHRGVNHAVTNGDKIYITSHNHGYAVSRDSLNGTGLRLAGWDINDGTVEMLEGDELKTFSVQFHPEAHPGPYDGEWFFGRLREMLGD

SEQ ID NO: 48114 - protein, 333 aa, Sulfitobacter sp. EE-36
MTIKVGINGFGRIGRCTLSHIAASGRDDIEVVRINATGPLETAAHLIKYDSVHGRFPNDVKVGNGTLDLGRGEMEVMSTYQMNELNWEGCDVVLECTGKFNDGLLAKVHLDQGAKRVLLSAPGKNVDRTVVYGVNDGELQASDTMVSNGSCTTNCLAPMAKALHDAFGIESGIMTTVHSYTGDQPTLDRRHEDLYRARAAAMAIIPTSTGAAKALGEVLPALKGKLDGTAMRVPTPNVSAVDLTFMAGRDVTVEEVNEAMRAAANGPTSRVFAYDAEQKVSVDFNHTEHSSIFAPDQTKVVGNRLVRVLAWYDNEWAFSVRMADVAVAMGKLG

SEQ ID NO: 48115 - protein, 194 aa, Triticum aestivum
MASEYSFARGVSLPAHRPPLAFTSYRLRHGAAVARANRRVVAARAARPVSVGAARRMPGSVRYGGAGVAALRVEEAGVAVPPSVPVRVAYELQLAGHRYLDVRTEGEFAGGHPAGAVNVPYMYSTGSGMAKNSHFVEQVSAIFRKDDEIIVGCQSGKRSLMAAAELCSAGFTAVTDIAGGYSTWRENGLPVNGR

SEQ ID NO: 48116 - protein, 325 aa, Populus trichocarpa
MGGGGAMRAAAKVAGIGVVNSGIRGGISCVPPSVEQSVRNASRPVSAIISSTPSGGEVAATVQRPSWELDEWEFAGGLEEETVVHSAEPVARVVFGGAPPSLQEAEAATFELNDAFQKVYLSSPNSGTGSSVGGSQLSGLPLLRKSESLETKDCIPCDPTGAPVPKYAMQAFSLLNESPKIQTVVAAVASDPNVWNAVWENEALQDFLQSQNTYTQSSEAKEFVRDTDFQDAVSSKNLAELSDDESEAGSSQTELVDIINNVKLTVVDLVTNLSAYFQKIFSFSSAEHTPAANESAGAATIEKTIGASLMGLAVIVIMVVVLRRP

SEQ ID NO: 48117 - protein, 499 aa, Saccharomyces cerevisiae YJM789
MLRIRSLLNNKRAFSSTVRTLTINKSHDVVIIGGGPAGYVAAIKAAQLGFNTACVEKRGKLGGTCLNVGCIPSKALLNNSHLYHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 48118 - protein, 503 aa, Sinorhizobium meliloti 1021
MSEQTIFDVFVIGGGINGCGIARDAAGRGYSVALAEMSDFASGTSSGSTKLIHGGLRYLEHYEFRLVREALMEREVLWAMAPHVIWPMRFVLPFHKGGPRPAWLIRLGLFLYDHIGGRKLLPATKTLDMTRDPAGAPLKGLFTKAFEYSDGWVDDARLVVLNARDAADRGARIMARTRVVSARREGGRWAIEIESTETGARETMRARMLVNAAGPWVDRVLSEAVGNNDVRNVRLVQGSHIVVKKKFDDPRAYFFQNPDGRIMFAIPYQDEFTLIGTTDRDFTGNPADVRISDAEIDYLCRAASEYFSDPVGREDIVWTYSAVRPLFDDGASKAQEATRDYVLRVENGDAPLLNVFGGKLTTYRRLAESALEKIGETIGEKGRKWTAVSHLPGGDFPAAGYDDEVAKLRTRYPFLTASHARRLVRLYGTRAAQLLGNAASEADLGKHFGADLYAAEVDWLIVQEWALRAEDVLWRRTKLGLKFSRAQTAELEEYMRGAVNAAA

SEQ ID NO: 48119 - protein, 534 aa, Cryptococcus neoformans var. neoformans JEC21
MPDPAPFWLCHECGAQMRPVTIDGTPHCASCNGEFIEILDPEVNPDPDYELPPPPPTRPGQQTPSRFDPHFLSNFPPPQSEGSSSPARQRDTNNTGNFLSSLFSMLGTGSRQGSEETPRRPPPSFHGEPSASQRNGQSQNTDRPGMRTYAFNFGNARGSVTIGSFGSNLGRQGYRMNNDPTSPSGNLFNDPDPFRADPFDARFRPPGDGNRDINGDMPLPLGANEALQLIAALLDGNPPPNMGNLGDFATSDADFMRILQETFMEAAGPQGPVPANETVIEGLPRFTFDSGSLAKSQFRDCPVCKDDFEIGNEVMLIPCGHIYHPDCLVPWLRQNGTCPVCRFSLVSEDEQPNNQRTPNVGTEHTRNAEEERPATPTIPAAVSNFFRNLFGGSESQPSTPRAAAGGGHGSNASQDPHSSVNVVSESTISADASSRHSPTIHGATRREQVQPCDEVASEGSSNDSLVRVYPEHSSGETHGDGATDGEAGRIAEQEQQVASRDRLADRVNRDFNERWQRLRREREEDDTVYHPDLD

SEQ ID NO: 48120 - protein, 531 aa, Aspergillus oryzae
MSTTPQELVPQTENIAEVYATDDASVTSVSPEHQTRFNGLISKFSQLYNHRPDFVARSPGRVNIIGEHIDYNLYDVLPTAVSVDVIMAVKVVPSSGEPFVKIANVQPEKFPSREFTVPRDTDIEIDPKQHEWVNYFRAGLLGALKFLRKTKQDGSFVPASVEVLVDGNVPPGGGISSSAAFVCSSALAVMKANNHNVSKQDLLDLAVVSERAVGVYSGGMDQAASIFSRRGYLLYTQFFPNFSVQHVPIPKASEEITFLMAQSFVTSNKAETAPRHYNLRVAECTLASVVLAAQHGLTLPKDNSSLGYSLRNFHEELMRKEGRLGDPLEYQIDSVIQTTMELLTQEQGYTREEIAKLLGITVADLEAKYLSSFPVQAERFLLRQRALHCFTEARRVLDFKACLAKATTLDERRIEYLGQLLNESQASCRTQYECSAPEVDDICAIARRAGTWGSRLTGAGWGGCTVHMLPQSKVDAVIKALKEYYLKKFPDISEEKLAQAMVISKPSNGSFVYVSSPWLRYVVDHHDCASC

SEQ ID NO: 48121 - protein, 307 aa, Francisella tularensis subsp. holarctica
MLSLIGKTPIIKLKNTINNHNLYAKCEWLNPTGSIKDRVAKYILENLIKNKKIKPQQAIIEASSGNMGTSLAAIGKLYKHPVYITCPEKTGQIKREMIKSFGANLTICKNTSDHTDPDFYVNKAKQLTEDLDGILVNQYDNLLNTECHYKTTGQEIVDYFLTQNVDIDYFITVGGSGGTITGCAKKIKEFFPKTQVIMPDPYGSVYYDIFYHGAPIKENIHSYKVEGPGNPVFCKSMDLAYIDEIIQFSDNQAIQACHELASEQGIYAGHSSGANYFIAKKLLEKLPQHQSYNILIMVLDSGMKYAF

SEQ ID NO: 48122 - protein, 288 aa, Picrophilus torridus DSM 9790
MYIIVPSSSSMKLTSSLASKLNAEIANVTRKRFPDGEMYVRIETDLKDRDVIVLGNTSHDSDLIEYLLLLNAAYEEKPATLNAVIPYFGYARQHMRYNPGEPVSSKVFTKAIENFADSIMAVEIHDEETLKFSAKPFTNVKVYDSIADYHKNHDIDYVISPDDGGYERAKSIAKYLKVDAYYIEKKRIDSRTVEMKMPDIDSRNRNILIVDDMISTGGTVIKASRILKDSGAKKIYVSAVHGVFSLNSAANIMENVDDLSVSDTIETGYSRITVSNDIKNALEKKIKV

SEQ ID NO: 48123 - protein, 377 aa, Frankia sp. CcI3
MTTTSSTPLADEPAVPVLSAAPDRPHRPWQGIIEEYRDRLPIAHDTPVITLREGGTPLLPAAHLSDLTECEVHLKIEGANPTGSFKDRGMTVAISRAVGAGSQAVICASTGNTSASAAAYAARAGITCAVLVPSGKIALGKLAQALVHGARLLQLDGSFDDCLRVARELADTSPVTLVNSVNPFRLEGQKTASFEIVEALGRAPDVHCLPVGNAGNITAYWRGYLEENNRIASGRPRMCGFQAAGAAPIVRGEVVTSPQTIATAIRIGNPASWDLAVEAREASGGLIDAVNDREILAAYRLLARREGVFVEPSSAASVAGLLKARAAGRIEPGEQVVCTVTGNGLKDPDWAISGAARPETIRPTVAGAAEALGLQRS

SEQ ID NO: 48124 - protein, 306 aa, Serratia marcescens
MANPLYHKHIISINDLSRDDLELVLATAAGLKANPQPELLKHKVIASCFFEASTRTRLSFETSMHRLGASVVGFADGSNTSLGKKGETLADTISVISTYVDAIVMRHPQEGARMASEFSGNVPVLNAGDGNQHPTQTLLDLFTIQETQGRLSNLSIAMVGDLKYGRTVHSLTQALAKFEGNRFYFIAPDALAMPAYILKMLEEKGIEYSSHGSIEEVVPELDILYMTRVQKERLDPSEYANVKAQFVLAADLAGAANLKVLHPLPRIDEIATDVDKTPHAYYFQQAGNGIFARSALALVVNADLAL

SEQ ID NO: 48125 - protein, 111 aa, Glycine max
  misc_feature (68)..(68): Xaa can be any naturally occurring amino acid
  misc_feature (88)..(88): Xaa can be any naturally occurring amino acid
  misc_feature (101)..(101): Xaa can be any naturally occurring amino acid
RGTVAPGSFFGSPIALSMRGQIDPWRKPKKLGGTWMFSEYMLAYGRDLLAMHAGTVEPWARALGVDNXTATGGSLWAALCLLKRRGSXVMACRSAIDLPYXKGRRRLDGNP

SEQ ID NO: 48126 - protein, 616 aa, Ostreococcus tauri
MGLACVACETARGTAEHGWDLSRASFNPEFDARAVFIDGSDANANDDGRGVSGECAGDVCAMWLERARGLDANAIERILSQCETTESGMVRAVDVLRRSGALDEGNFPFAPTETDESEMTSEMSAYFVNSSHNTYLDGDQLFSRASVAAIAGALDRGCRVIELDVYDGKKRGDKPRPIVTHGGTAVRPMYFEDAIKVIAERAHVASEYPVIVTLENHASKETRAEMSRILRSTLGDKLWAPKSAVAGNQLKRWPSPLELKGRVIVRDKIKHKQDELQRRRDQRRGLCGLCGTKKQSKQRKVLPKSLNVRKNDKVCAMQSIIEFPRSSTGVFDEGAVSSSSSDSEGEQDDEDLKRIVSVPNVKFRSFHEARDVPRFSCSWSERKLKLKIEKESSKDIIEFTNAHLLRTYPAGHRIFSNNYDPSEAWDVGASFVALNFQALDRYVWANRAKFRVNGNCGYVKKPAYLLDPTIERPSKPRRLQVKVFAGIGWDNFKDADRFSPPDSLIRITTLGCLADRTKPGKSNRTSVYSKARAGPEAQPVWNDTFELAIFEPELALMQIQALDKDGNGDELLAHYDFPISKLREGVRIVPMLNRDDEFIHDKISCAGVLMSFKWLD

SEQ ID NO: 48127 - protein, 385 aa, Gibberella moniliformis
MSGPTNFDPERVNLTEFQSVTDQGLITCFLTTAGNQYDGPLGIRIGSLFVILVVSTAVTFFPVVATRIPRLKIPLYVYLFARYFGSGVIIATAFVHLLDPAYSEIGPASCVGMTGGWSTYSWPPAIALSAAMFTFLFDFSADYYVQSRYGLQHNDTGVEETITTSGADGHQHHSDDGSNSRRLVINGEHDTEAATSEKLRGGYADFKELQHLDGDSEETELAFKTQIAAFLILEFGVLFHSVFIGLNLGVADTSDFDTLFPVLVFHQSFEGLGIGARLSAIPFPNRLRSMPWLLCLAYGLTTPIAIAIGLGIRKTYDNSSFTANTVNGIFDSISAGILIYTGFVEMIARDFLFNRERTNDKVRLGFMIVCLFLGAGIMALVGKWA

SEQ ID NO: 48128 - protein, 489 aa, Zygnema circumcarinatum
MNNTHITLVASTVATKNVGRITQIIGPVLDASFPPGKMPNIYNALIIKGQNPAGQEINITCEVQQLLGDNKVRAVAMSATDGLMRGMEVTDTGAPLSVPVGESTLGRIFNVLGEPIDNLGPVDAATTLPIHRSAPAFTQLDTKLSIFETGIKVVDLLAPYRRGGKIGLFGGAGVGKTVLIMELINNIAKAHGGVSVFGGVGERTREGNDLYMEMKESKVINEENISESKVALVYGQMNEPPGARMRVGLTALTMAEYFRDINKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPWIVGTEHYDTAQGVKQTLQRYKELQDIIAILGLDELSEEDRLVVARARKVERFLSQPFFVAEVFTGSPGKYVSLAETIKGFQMILAGELDHLPEQAFYLVGNINEATAKAATLS

SEQ ID NO: 48129 - protein, 125 aa, Nanoarchaeum equitans Kin4-M
MAEKPPYVKFEVPEELANKVYELVRKARETGKIRKGTNETTKAVERGQAKLVIIAENVNPPEIVMHLPALCEEKGVPYVYVPSKEELGKAAGINVSAASAAIIDAGEAKDLLEEIIRSVQELKAK

SEQ ID NO: 48130 - protein, 490 aa, Zea mays
MEKESKQGFFSALKGEVVRGLSPGRSRGKSLLLPRSRKTAAAEEVAPPEKLAQYAPDPLVTHSGSLRLAGEVLAPLMEGPDVAEDDTFAEDSGRRDGFGQWVRGHLTRAPLIAGGGDGSFRRSDLRLLLGVMGAPLAPVSVSTAEPLPLAPVKGAPIESSSAQYILQQYLAASGGAKVLRSARNAYAMGKVRMVASEFETATRVVKNRGAAAAAAVEQGGFVLWRMSPDMWYVELAVGGSKVRAGCNGRLVWRHTPWLGAHAAKGPVRPLRRALQGLDPLSTAGLFAEARCVGEKKVGDEECFILKLSADAETLRQRSEGPAEIIRHVVFGYFSQRTGLLVQVEDSHLTRIQPHAGGDAVYWETTISSFLEDYRAVDGVAIAHAGRSAVTLFRFGETAMSHTKTRMEEAWTIQEAAFDVPGLSTDCFIPPADVRRDSDSVGEPCELPPRGAKAGAVHPACDAVHSRRRRDVAPADGELATRSTGRWRCDF

SEQ ID NO: 48131 - protein, 956 aa, Musa acuminata
MLTTEMMGVAALRVIASKLAKKWDFSVDPCSQTNGWVVPGRSDMPVFTDNVTCDCNRTSNVCHVTSIKLKGLNLTGTLPAEFSKLPFLTDIDLTWNYLNGTIPAAWASLPLVHLSLLGNRVSGPIPEEFAKMITLEELVLEGNQLQGPIPAALGKLANLKRFLANGNNLSGELPESLGNLKNLIMFLIDGNPISGKIPSFIGNWTQLQRLDMQGTAMEGPFPPRFLALKNLKELRVSDLKGGIGSFPQLQNMRNMTKLVLRNLSISGELPDYIGEMKALNSLDVSFNNLSGPIPGTYAALTSSLNFMYLSNNNLNGKIPDWILNSAQKFDISYNSFTGSPAPAICQRGKGCWCNLTAPFYRTLSCLRRNLPCSGESRNYNLFINCGGPKMRIDDIEYEGDILDLGTSEFYDSESGKWAYSSTGDFVDNQNPKFITANTTALDITKPELYMTARLSPLSLKYYGRCLYKGNYTVNLHFAEIMFTDDETYSSNGRRLFDVSIQGRKVLKDFNIAKEANGTGKEIIKSFTVMVDGTLEIHFYWAGKGTNSVPLRGVYGPLISAISVTPNFKIDTGENKLTVGTILAIVAAACIIVLLILCLIFLYIRRKNSKNNELRGLELQTGQFSLRHIKAATKNFHPANKIGEGGFGPVYKGVLPDGSEIAVKQLSSKSKQGNREFVNEIGVISALQHPNLVKLYGCCIEGNQLLLVYEYMENNSLARGLHGRWKICLGIARGLAYLHEESRLKIVHRDIKATNILLDKDLNAKISDFGLAKLNEEENTHISTRIAGTLGYMAPEYAMRGYLTDKADVYSFGVVALEIVSGMSNTKYRPEEDCVYLLDWAYVCHEKGNLLELVDPALDSSFSTEEALQMLKLALLCTNISPTLRPNMSAVVSMLEGKTPIELLSVQSSITKGDDLRFKAFEKLSRDSQTEINSTDWPWPDSSVSAQSTKGDTSLLH

SEQ ID NO: 48132 - protein, 119 aa, Carboxydothermus hydrogenoformans Z-2901
MDKIVIKGVEFYAFHGVLPEEKALGQKFILDLELGIDLRDAGRSDDLSKTVSYKEVLDFTEEIVTKNRFDLIEALAEEVAGGILNKFSLIKEVMVRVHKPGAPLRQKLSDVYVEVKRGR

SEQ ID NO: 48133 - protein, 256 aa, Streptococcus pyogenes M1 GAS
MKIGIIGVGKMASAIIKGLKQTPHELIISGSSLERSKEIAEQLALPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLMELERLGLTATVSSAIDKTIDKAKSL

SEQ ID NO: 48134 - protein, 338 aa, Coccidioides immitis RS
MTQYLGQPLSESITEHIGATPLVRLNRLPASFGIKAKVCAKLEYFNAGGSVKDRIAKRMVEQAEQDGLIKPGDTLIEASSGNTGIAIALMAAIKGYKCIITLSEKMSLEKEQILHALGARVVRTPAGVPIEHPESILSVAKRLKEEIPNSWILDQYNNPENPRAHEFGTAEEIWHQTQGKVNAVVAGAGTGGTITGMARAFKKKNRGVFVVGVDPVGSVLAQPAALNGKKSEYKIEGIGYDFVPGVLDQAAPDLWVKTTDKESFQMARQLVSQEGILCGGSSGAAFAGLRQFLEIHPEFNVEDKTIVLVLADNLRNYLTKFGDDAWMESNGYGLDLTP

SEQ ID NO: 48135 - protein, 644 aa, Staphylococcus epidermidis ATCC 12228
MILLQLNDISKSFDGEDIFTDVNFEVKTGERIGVVGRNGAGKSTLMKIIAGVENYDSGRISKIKNLTMSYLTQQMTLNSEATVFEEMSKPFEHIKKIENLIKDETDWLARNGQDYESDEYQSHIEKYETLTNRYEQLDGYQYESKIKTVLHGLNFTESDFNKPINDFSGGQKTRLSLAQMLLKEPDLLLLDEPTNHLDMETTKWLEDYLKYFKGAIVIISHDRYFLDKIVTQVYDVALGNVKHYVGNYEQFIKQRNQYYEKRMQEFEKQQEEIKRLETFVEKNITRASTSGMAKSRRKTLEKMERIDKPMIDARSANIQFGFDRNTGNDVMHIHDLKIGYDSPITLPINLEIFKGDHIAIIGPNGVGKTTLIKTIAEKQHKLGGQIIFGANLQIGYYDQKQAEFKSNKTILDYVWDQYPHMNEKDVRAVLGRFLFVQEDVKKIINDLSGGEKARLQLALLMLQRDNVLILDEPTNHLDIDSKEMLEQALKDFEGTIIFVSHDRYFINQLANKVFDLNINGGQMYLGDYQYYIEKTEEAAAIKAHETITQNNFENKEINQDANTSTYISQKQQKRQQRKLERQIEHCERQIEELEAQISHIDEQLTQPEVFNDPLKASKFANQKSDTEQKLEQIMLEWEKLQEKL

SEQ ID NO: 48136 - protein, 163 aa, Bacillus halodurans C-125
MAIEPKVIEAFIEIPTGSQNKYEYDKERGVFKLDRVLFSPMFYPAEYGYIENTLALDGDPLDVLVIVSNPTFPGCVIDAKVLGFLNMIDGGEEDQKLIAVPTEDPRFKDVNSLNDLPKHKLDEIAHFFKTYKDLEGKKTEVGAYEDAEAAAKLIDECFARYKG

SEQ ID NO: 48137 - protein, 335 aa, Picrophilus torridus DSM 9790
MVDVALIPGDGIGREIMPGVAAAISSISDINFVTFDISSERYIKTGIIIKDDELEELKNYRAILFGAIGDPRVRPGIMEQGVILRLRRELELYMNIRPVRSFDDKIKITILRENTQDFYTDISGIIPGKRSFNVNGTRIEIDGSSCDEVYYTMGMLSYRYLKKFFNKAFSICDSTVTVTDKANAVKMYNLWRSTAMEAAIEKNINISFEYADALAYNMILNPKKYRYIIAPNLYGDIISDMGAALVGGLGYAPSANIGDKNALFEPVHGSAPDIAGRDMANPAASIMAGSMLLEYLGYRDESRIINDMVRNLYINGVFNSERTSKIIERFMTITK

SEQ ID NO: 48138 - protein, 854 aa, Magnaporthe grisea 70-15
MAAHAYTIPDWAPTQTTISDTPSNGRQVMLPTNPDDFHPLPRHDEADSESDHEPELSSSRPPPPTASIPTRRPSRLRSMSNSLGWRPRPKSAVFGTTTADDLAAPLADMVLDNARRASNGEWHAGSRSNNESAVMDVEEDGKGKGKVRGMIRRASVSLKRAVSRRSSTATSTGEEHEHAVRRFLRSAHGHLRSPSLDIHNREEHQPQQSQTRQKRGPPVSFRTPRYTSDQESARPSTSHSSTWRRLRQATSFRRSSGNLFESTDNSRNSAFFTSPVPGNGGAPPIIPRNTGGAARAAAADAAMNADVFRSMTPAEWAVNLAKGSNGLGSSNPNHPHHSLTHSNDGESGIGIAVTATESESERDKTDSRLDLAQHASGTYTMDRQRLSGGLTRAGSSTGSVQMADGIPRVDFIAHLPLELALEVLSYLDYIDLATAERVSSPWRHVTGHSYIWRKSFLRSMTSTFATGGQVKPGAGLGVPPVRPENNWKDIYRARVELDRRWKTGNASPVYLNGHTDSIYCLQFDESKIITGSRDKTIRVWDMHTLSCRYVIGPPDIVREQNVLCDANGQPTHFATTEASPRANPSFPATLTFPNHHNASILCLQYDDRILVTGSSDSTCIVHWITSGYRPIRRLQHHSAAVLDLVFDDRYIVTCSKDVSICVWDRETGELLRQLRGHAGPVNAVQMRGDTIVSCSGDFKVKLWNISTGTCIREFAGHTKGLACSQFSEDGRYVASAGNDRTIRVWDANTGECVREVAAHTNLVRSLHIDSVSGRLVSGSYDTDIMVFDMETGRQLLHFPGWHASWVLSAKSDYRRIISTGQDPKILVMDFGKGVPNIEALESCDQRDSGRVGYI

SEQ ID NO: 48139 - protein, 270 aa, Vitis vinifera
MQKKNFRKRSIEDDQAKDNNNSEDEEERRLALEEVKFLQKQRERKLGIPAIPTLQTTGVTPTKKVAEKNEVPDGDKEELVLQDTFAQETAVMVEDPNMLKYVEQELAKKRGRNIDATNQVGNDLKRADDELYVVPEHLKVKRRNSEESSTQWTTGIAEVQLPVEYKLRNIEETEAAKKLLQDKRLMGRTKTEFNIPSSYSADYFQRGRDYAEKLRREHPELYKDKGVQDNGGGSRLPDASTEVAGRRQAATDEFMLDRFRKRERHRVMRR

SEQ ID NO: 48140 - protein, 200 aa, Vitis vinifera
MSVGFGKCSKIRHIVRLRQMLRRWRHKAAEASRMSSSCIPSDVPAGHVAVCVGTDGKRFVVRATYLNHPVFKKLLVEAEEEYGFTNQGPLSLPCDESVFEEILCFISRSEASNSARFVNREDFQRYCHVGIRSSLDFWPESRPLLHRVCFTPKNVWRWHIGWRVPTESSRVRIGVRLKVEIDEPTEEEEERASVRMRLLL

SEQ ID NO: 48141 - protein, 441 aa, Phaeodactylum tricornutum
MKFVQAAIFALAASASTTAAFAPAKTFGVRSFAPVSLIELEAKASIEDLSDAELKGKKVLVRCDVNVPLDGKKITDDTRIRSSIPTIEYLKNKGAIVSVCSHLGRPKDGPEDKFSLGPCAERMGELLGQTVTLAPDCIGEEVAKIVNDAKEGDVIMLENTRFYKEETKNDPEFVEKLAAPFDLYVNDAFGTAHRAHASTEGVTKFLKPSVGGFLLAKELEYLDGAISNGKKPMAAIVGGSKVSSKITVLEALLDKCDKVIIGGGMVFTFLKAKGFNVGTSLVEDDFVDTAKEVLAKAEKLGKEILLPIDIVIADKFDAEAETKVVSAEEIPDGWMGLDNGPETTAQQKEALSDCKTIIMNGPMGVFEFEKFAKGTFDLVNILADLSKDKGAITIIGGGDSVAATEQSGRAGDMSHISTGGGASLELLEGKVLPGVAALNDK

SEQ ID NO: 48142 - protein, 449 aa, Phaeodactylum tricornutum
MLFRMLTSTALRRSPVTTSLTCCCKANAFAVRIRSFHAAPVIQAKMTVEQLAQQVHMKGTNVLVRVDLNAPLATDDVTVTDDTRLRAIVPTTKFLLEQGANVILCSHFGRPKGEIIETGKNGRLNPVVKPLEVLLGQTITKLDDCMGPDVEAATKNLGEGKVVLLENTRFYSGETKNDPELAAGLGKLADYFVMDAFGTAHRAHSSTAGVTTHMKFNAAGKLMEKELQYLQGAVEEPKRPMMAIVGGAKVSTKIPVIESLLDKCDVILIGGGMIFTFYKALGYDIGASLVEDDIVELASSLMKKAEEKGVKLILPVDVVLADKFDNDANSAVAKVTDISGDWMGLDIGPETIDLFRSEIAEANTIVWNGPMGVFEFSNFAAGTNDVAQMLAQATAERGAVTIIGGGDSVAAVNKAGLGDKVSHISTGGGASLELLEGKVLPGVAALTEV

SEQ ID NO: 48143 - protein, 187 aa, Rhodobacter sphaeroides 2.4.1
MAERENRRDRRDDRSREETPEFADRLVAINRVSKTVKGGKRFGFAALVVVGDQRGRVGFGKGKAKEVPEAIRKATEQAKRQMIRVALRDGRTLHHDQEGRHGAGKVVMRAAVPGTGIIAGGPMRAVFEMLGIQDVVAKSLGSQNPYNMIRATMDGLKRESSPRQVAQRRGKKVADILKKPEAEVAEA

SEQ ID NO: 48144 - protein, 440 aa, Aeromonas hydrophila
MNLSFDHIAGQLRHAIDDARLIQIRGRVTQVTGTLLKAVVPGVRIGELCHLRNPDNTLSLQAEVIGFAQHQALLTPLGEMFGISSNTEVSPTGAMHQVGVGEHLLGQVLDGLGNPFAGGHLPEPAAWYPVYRDAPPPMSRKRIAQPISLGIRAIDGLLTCGEGQRMGIFAAAGGGKSTLLASLIRSAEVDVTVLALIGERGREVREFIEADLGEEGLKKAVLVVATSDRPAMERAKAGFVATSIAEYFRDQGKRVLLLMDSVTRFARAQREIGLAAGEPPTRRGYPPSVFAALPRLMERAGQSDKGSITALYTVLVEGDDMTEPVADETRSILDGHIILSRKLAAANHYPAIDVLRSASRVMNQIIEPEHQAQAGRLRSWLAKYEEVELLLQIGEYQKGQDKVADEAIARIEAIRQWLKQGTHEPSSLPEALATLEALTR

SEQ ID NO: 48145 - protein, 779 aa, Saccharomyces cerevisiae YJM789
MGSFPLAEFPLRDIPVPYSYRVSGGIASSGSVTALVTAAGTHRNSSTAKTVETEDGEEDIDEYQRKRAAGSGESTPERSDFKRVKHDNHKTLHPVNLQNTGAASVDNDGLHNLTDISNDAEKLLMSVDDGSAAPSTLSVNMGVASHNVAAPTTVNAATITGSDVSNNVNSATINNPMEEGALPLSPTASSPGTTTPLAKTTKTINNNNNIIDLIESKDSIISPEYLSDEIFTAINNNLPHAYFKNLLFRLVANMDRSELSDLGTLIKDNLKRDLITSLPFEISLKIFNYLQFEDIINSLGVSQNWNKIIRKSTSLWKKLLISENFVSPKGFNSLNLKLSQKYPKLSQQDRLRLSFLENIFILKNWYNPKFVPQRTTLRGHMTSVITCLQFEDNYVITGADDKMIRVYDSINKKFLLQLSGHDGGVWALKYAHGGILVSGSTDRTVRVWDIKKGCCTHVFKGHNSTVRCLDIVEYKNIKYIVTGSRDNTLHVWKLPKESSVPDHGEEHDYPLVFHTPEENPYFVGVLRGHMASVRTVSGHGNIVVSGSYDNTLIVWDVAQMKCLYILSGHTDRIYSTIYDHERKRCISASMDTTIRIWDLENIWNNGECSYATNSASPCAKILGAMYTLQGHTALVGLLRLSDKFLVSAAADGSIRGWDANDYSRKFSYHHTNLSAITTFYVSDNILVSGSENQFNIYNLRSGKLVHANILKDADQIWSVNFKGKTLVAAVEKDGQSFLEILDFSKASKINYVSNPVNSSSSSLESISTSLGLTRTTIIP

SEQ ID NO: 48146 - protein, 485 aa, Arabidopsis thaliana
MGGSDENRHGVIGPMNRQQGGLRGGKVIPTNGQTRRALSNINKNIIGAPVYPCAVKRPFTEKNGICNKKIPPVPVHRPVTRKFAAQLAENNLQIHKEETKKPDLISNEALDRIITDVEEGDFNEPMFVQHTEAMLEEIDKMEGIEMQDSNDIDAEVEESVMDIDSCDKNNPLSVVEYINDIYCFYKKNEVTFSVLFLYHYDHSSFKIETFSIILQCRSCVPPNYMENQHDINERMRGILFDWLIEVHYKFELMEETLYLTINLIDRFLAVHQHIARKKLQLVGVTAMLLACKYEEVSVPVVDDLILISDKAYTRTEILDMVKSFTKSCPDYNHGCSALYVDDHYCVLQEKLMANTLQFNFCLPTPYVFMRRFLKAAQSDKKLELLSFFMIELCLVEYEMLQYTPSQLAASAIYTAQSTLKGYEDWSKTSEFHSGYTEEALLECSRKMVGLHHKAGTGKLTGVHRKYNTSKFGYAARIEPAGFLLL

SEQ ID NO: 48147 - protein, 481 aa, Oryza sativa
MLPSTAMAFHVFLIAALLLLPLPAAFSKAVRTQSLLANPLSPDPITQEQQLSLAAPRTNASTLHFRLAHREHFALNATASDLLAHLLARDAARAAALLAAPNNATRPRRRGGFAAPLLSGLPQGSGEYFAQVGVGTPATTALMVLDTGSDVVWLQCAPCRHCYAQSGRVFDPRRSRSYAAVDCVAPICRRLDSAGCDRRRNSCLYQVAYGDGSVTAGDFASETLTSARGARVQRVAIGCGHDNEGLFIAASGLLGLGRGRLSFPSQIARSFGRSFSYCLVDRTSSVRPSSTRSSTVTFGAGAVAAAAGASFTPMGRNPRMATFYYVHLLGFSVGGARVKGVSQSDLRLNPTTGRGGVILDSGTSVTRLARPVYEAVRDAFRAAAVGLRVSPGGFSLFDTCYNLSGRRVVKVPTVSMHLAGGASVALPPENYLIPVDTSGTFCFAMAGTDGGVSIIGNIQQQGFRVVFDGDAQRVGFVPKSC

SEQ ID NO: 48148 - protein, 325 aa, Brassica napus
  misc_feature (134)..(134): Xaa can be any naturally occurring amino acid
  misc_feature (151)..(151): Xaa can be any naturally occurring amino acid
MASSKKTLVRNLFNISKTYSRISGLTRMRPPTKPGIAPDAGDSGIRRRFLHKRAFFSPEIVPRGGNLMDKLKEMSLSNNRLRLDEMLPPPTTPEKTSPGSFPSVTVEDVKKLMRAAEMEMVKSRLRDIGKNWVXPYSEFVRVCGENYSDPXEHGTRAANMLDKAGNVIVLGNFVCLKPEELTKAVAGLIPTHEPTRNAATRQEFEQLEIIKSDIDKRADDLVRRELQAGLGLVIAQTIGFFRLTFWELSWDVMEPICFFVTSTYFMAGYAFFLRTAKEPSFEGFYKSRFETKQKRLIKMLNFDIDRFTKLQKIHRPDLTNSAGRG

SEQ ID NO: 48149 - protein, 386 aa, Haemophilus influenzae R2846
MSVIKMTDLDLAGKRVFIRADLNVPVKDGKVTSDARIRATIPTLKLALEKGAKVMVTSHLGRPTEGEFKPEDSLQPVVDYLKNAGFNVRLEQDYLNGVDVKDGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLIPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAINLFGIADKISYISTGGGAFLEFVEGKVLPAVEILEKRAKN

SEQ ID NO: 48150 - protein, 452 aa, Silicibacter sp. TM1040
MTDIKRKVLVIGAGPGGYVCAIRAGQLGLDTVIVDEARPGGTCLNIGCIPSKAMIHAADEFYKMTHAGAGPLGISAAGPTIDLEQTVAWKDGIVERLTGGVGGLLRKAGVKMISGRARFVDGKTVTVAGDEGEIQIRADYIVIATGSAPVELPFLPFGGAVMSSTEALSLTEVPESLAVVGGGYIGLELGTVFAKLGSKVTVVEAEDRILPLYDKALTRPVHKRLEELGVTVMTGTKAQSHEGGALQTDAGEIAAERVLVTVGRRPRTQGIGIDELSLTMNGPFIRIDKVCQTSMRGIYAIGDVTGEPMLAHRAMAQGEMVAEYLAGQAVEWDKRAIPAVCFTDPEIVTCGVLPGEVEGTKSAEFPFVANGRAMTTERDEGFIRVVWREADNAVLGLQGVGVGISELSSAFSLAIEMGACLEDIAATIHAHPTQSEGLQEACLKALGHALHI

SEQ ID NO: 48151 - protein, 421 aa, Silicibacter sp. TM1040
MGIFAIRLPDVGEGIAEAELTEWHVKPGDIVKEDDVLAAVMTDKAAVEVPSSVEGKVVELGGEIGDMLAIGCVLVRIEVDGEGNEAASVAEPEPTPAPKEQKAEPEPERGDKPAEPARPVVKTGKPVARAKNTKPLAAPSVRARAREEGVDLRQVPGSGPGGRISHGDLENWIASGGIQQGSVKRGKNTGVEDVRVVGMRRKIAEKMAISKRQIPHITIVEEIEMEALEDLRAALNRKYKDQRPKLTLLPFLMRAIVEAVREQPELNARYDDEKGIIHRHGGVHVGIATQTPNGLNVPVVHHAEAGSLWDNAAELARLAEAARDGSIKRDELTGGTITITSLGALGAIATTPIINHPEVAIVGVNKMQMRPVWDGQQFQPCKMMNISCSFDHRVIDGWDAAVFVQKLKLLLETPAMLFVEG

SEQ ID NO: 48152 - protein, 490 aa, Brucella melitensis 16M
MWGRAAIAGMALRPDATKRELHSSSQRAENRGRICAPPFPSLNRAGTKGNQGENAGSNLLMGVEVTRLPNGLTIATDTMPHVESVALGIWVKAGARNEAPDRHGIAHLLEHMAFKGTENRTAWQIASDIENVGGEINATTSVETTSYYARVLRNDMPLAIDILSDILTASKFDEGELEREKQVIMQEIGAAHDTPDDIVFDRFTETAYRHQPIGRAILGEPETVMSFTSDDLRQYMQEQYSADRMVVTAAGGIDHDEFVREVEKRLGSFRPHNTAPTLDLAHYVGGDFRENRELMDAQVLIGFEGRAYHVRDFYASQLLSMILGGGMSSRLFQEVREKRGLCYSVYAFHWGFSDTGLFGIHAATGRDELVELVPVIIDELHKAANSIGIEEVDRARAQYRASLLMSQESAASRAGQIARQFLLYGRPVENSELLDRLSLITPERLTDLAGRLFLNNKPTIAGVGPVGRLMSFDRLTDALSTNAHTRTIAV

SEQ ID NO: 48153 - protein, 294 aa, Corynebacterium glutamicum
MQHFRDKIVVVKYGGNAMVDDDLKAAFAADMVFLRTVGAKPVVVHGGGPQISEMLNRVGLQGEFKGGFRVTTPEVMDIVRMVLFGQVGRDLVGLINSHGPYAVGTSGEDAGLFTAQKRMVNIDGVPTDIGLVGDIINVDASSLMDIIEAGRIPVVSTIAPGEDGQIYNINADTAAGALAAAIGAERLLVLTNVEGLYTDWPDKSSLVSKIKATELEAILPGLDSGMIPKMESCLNAVRGGVSAAHVIDGRIAHSVLLELLTMGGIGTMVLPDVFDRENYPEGTVFRKDDKDGEL

SEQ ID NO: 48154 - protein, 219 aa, Oryza sativa Japonica Group
MDTEDTSSASSSSVSPPSSPGGGHHHRLPPKRRAGRKKFRETRHPVYRGVRARAGGSRWVCEVREPQAQARIWLGTYPTPEMAARAHDVAAIALRGERGAELNFPDSPSTLPRARTASPEDIRLAAAQAAELYRRPPPPLALPEDPQEGTSGGGATATSGRPAAVFVDEDAIFDMPGLIDDMARGMMLTPPAIGRSLDDWAAIDDDDDHYHMDYKLWMD

SEQ ID NO: 48155 - protein, 336 aa, Carboxydothermus hydrogenoformans Z-2901
MGSIKVTVLGAGSWGTALSNLLAQKGVNTVLWGRDSAVIEEINRERENKRYLPGVKISQELIATADLEFALKDANFLVAAVPSQAFRDLLQKIKPYFKPEQILVNTAKGIEEGSLLRMSAVFTEVLPEYRDNYTILSGPSHAEEVGRGIPTAIVVSGYSPEKLYKVQELFSTEYFRVYTNDDLTGVELGGSLKNIIAIASGICTGLGLGDNTRAALVTRGLIEITRLGIKLGAKKETFMGLSGLGDLFVTAGSRHSRNYKAGILIGEGKSLEETQKEINMVVEGIRTTRAAYQLAQRLEVEMPITEALYKVLFAGLPPREGLFGLMTRAKKEELNF

SEQ ID NO: 48156 - protein, 191 aa, Brucella melitensis 16M
MLRHGKSKVSHKQQADQTAISIRPALRRKSMTIKVGDRLPAATFKVKTADGVTEMTTDDVFKGRKVVLFAVPGAFTPTCSLNHLPGYLENRDAILAKGVDQIAVVAVNDPFVMGAWAQSTGGEGKILFLADGSATFTKAAGLDIDLSGGGLGVRSKRYSAIVEDGVVKSLNIEEQPGQAVTSAASALLAQL

SEQ ID NO: 48157 - protein, 334 aa, Oryza sativa
MSASIGINGFGRIGRIVLRAALEKGVKVVAINDPFIPLDYMVYMFKYDSTHGRFKGDIHHANGFLYVNGQQISVFTEKDPTQIPWGKSGAEYVVEATGVFTTIDKCQAHITGGAKKVIITAPSADAPMFVCGVNEKTYNPSINILSNASCTTNCLAPLAKVINDKFGIVEGLMTTVHSYTATQKTVDGPSNKDWRGGRTAATNIIPSSTGAAKAVGKVIPDLNGKLTGMAFRVPTADVSVVDLTVRLAKPAKYDEIKAAVKAASEGELKGILAYTEDEVVSSDFIGDHHSSIFDAKAGISLNDNFVKLVSWYDNEFGYSCRVIDLIKHVHSVSH

SEQ ID NO: 48158 - protein, 347 aa, Staphylococcus epidermidis ATCC 12228
MSYKIVALPGDGIGPEILSGTLELLKLISEKYHFEYHLESHHFGGVSIDYYGTPLTNETLQSCKNADAILLGAIGGPKWTDPNNRPEHGLLKLRKSLNLFANIRPTFVTKGASHLSPLKQDIVEGTDLVIVRELTSGIYFGEPSYVKKTEALDSLKYSSQEIERIVRIAFNLANRRRKKLTSVDKENVLSSSKLWRQIVNDVKKDYPEVEVNHMLVDACSMHLITQPTQFDVIVTENLFGDILSDEASVIPGSLGLSPSASFGQTGTRLYEPIHGSAPDIANEDKANPFGMVLSLALCLRESLNQNDAANELESIVYSFIQSNKTTADLGGQYRTSKIFKLLKEKYL

SEQ ID NO: 48159 - protein, 401 aa, Picrophilus torridus DSM 9790
MIIMIPIYAITWNFRDTPEGFDKIVNNDYNYFESLCKKSSIDEFVILITCNRVEIYAYTRNEIDKDLFKDSLIYNYPESTMHLLRVASGLESMSIGENDIMRQVKEAYELSIKRKTSGKILSYIFKKALNVGKEVRTQTSISRGKTSIPAISLDICDNEYGINNKSILIIGNGKMATDFSRYLKEYRPGNVTIAGRSIDHARNLAVLYGYSYDSIKNLNNLIKNSDIIIAATSAGNYIVKDLGDLARNKYFIDISKPENIDPEISKYARLLSINEIGKILKRNEDEKKGEVEIAEVIINQEQKTIDEKLKEMMLDDVIAMFYKFANNVKKDELEELFLIQDFNDEQKKDIDAMTSSLINKILAPYTNSVKQFIKENKNFDYILNEYKKMLEQFMENIVKKL

SEQ ID NO: 48160 - protein, 554 aa, Sulfitobacter sp. EE-36
MYSYTEFDDAFIAERNAQFRAQVERRIDGSLTEDEFKPLRLMNGLYLQLHAYMLRVAIPYGTLSSRQMHKLADIAAKWDKGYGHFTTRQNIQYNWPQLRDVPDMLDALAEVNMHAIQTSGNTIRNVTADHFAGAAADEIADPRPVAELIRQWSTDHPEFQFLPRKFKVAVSGAPHDRAVIKAHDIGLQIVEKDGEIGYQVIVGGGLGRTPMIGKVLYDFVSSEDLLPTLEAIVSVYNLLGRRDNKYKARIKITVHENGIDDIRARVDARYALIRPQFTGVDQQMLSRIEADFASPTFKTAPTDAYTASYDSDPVFKSWADTNLTDHRDPSYAIVSISLKAHGKTPGDATAEQMHRMAELAAEYGHDELRISHEQNVILPHVHRGDLPALHAALKEVGLATANIGLISDIIACPGMDYCALATARSIPIAQEIATRFDELKLEHDVGPLKIKISGCINACGHHHVGHIGILGLDRAGVENYQITLGGDGTENAAIGERAGPGFSADDIIPAIERLVKGYLDLRSDAGETFLQTYRRLGLAPFKAVLYPEAQANAA

SEQ ID NO: 48161 - protein, 92 aa, Brassica napus
MAFLLNNTSIASHLRLSSQKPDGAFAQSRRGFHVELGTREKDLLAQNDALRRFKSHKKGVGHLKRVGDVLTLVVLAGCCYEIYARATVQKED

SEQ ID NO: 48162 - protein, 504 aa, Sinorhizobium meliloti 1021
MAKAATPKETAAAKKPAAPKKAASAKTVVAATGAVGRVTQVIGAVVDVAFEEGQLPQILNALETDNNGNRLVLEVAQHLGENSVRTIAMDSTEGLVRGQKVADTGGPIAVPVGKETLGRIMNVIGEPVDEAGPLKTSARRAIHQEAPAYVDQSTEAQILVTGIKVVDLLAPYAKGGKIGLFGGAGVGKTVLIMELINNVAKAHGGYSVFAGVGERTREGNDLYHEMIESGVNKHGGGEGSKAALVYGQMNEPPGARARVALTGLTVAEQFRDEGQDVLFFVDNIFRFTQAGSEVSALLGRIPSAVGYQPTLATDMGQMQERITTTTKGSITSVQAIYVPADDLTDPAPATSFAHLDATTVLSRSIAEKGIYPAVDPLDSTSRMLDPMIVGEEHYEVSRKVQSTLQRYKALQDIIAILGMDELSEEDKIAVARARKIERFLSQPFFVAEVFTGSPGKLVALEDTIKGFKGLVNGEYDHLPEAAFYMVGSIEEAVEKAKKLAAEAA

SEQ ID NO: 48163 - protein, 118 aa, Arabidopsis thaliana
  misc_feature (33)..(33): Xaa can be any naturally occurring amino acid
  misc_feature (92)..(92): Xaa can be any naturally occurring amino acid
MYVKATYGTAYYVGGWIKVCKWVWGDDMGMIAXPANNGSTSITFFGGRVNCIQVSPPIGKKKIETLSYLPDLTDSELANEVDYLIRNKRISXVEFQFQHGSVYREHSNSPRYYDGRYW

SEQ ID NO: 48164 - protein, 117 aa, Oryza sativa Japonica Group
MSLQMKFVPRFQDCWRPQSNASPPTGNGPGLRPAEQGVEEEAGRPLPKFGEWDVNDPASADGFTVIFNKARDEKKGGNGQDTDSPCKETRTERVESYAPKTNSKKWFCCVTSSPTQS

SEQ ID NO: 48165 - protein, 521 aa, Vitis vinifera
MGCLAIALVSFTVIFISIIWQICRILFWRPYVVTRCFRKQGIRGPPYSVLSGSLHEIERLKNAARGSVLETSSNDIIQRVVPHYHRWSLDYGDTFLYWFGTQPRICISDPELAKHILSNKFGCFIKPMTRPLLEKMAGRGLGLVNGADWVKHRRITSPAFTSGKLKVMMKRMAECTLSMLHEWKNQSFVAHNQCKMIEVNGEFRKLTADIIAQTAFGTSYVQGREVFEAQRELRQCCRASIADILIPWSLYLPTPENLGIWKTERRLNKALRSIIESRLNSQVSRSSDSVHGDDLLGLMIGESEAAKTKPGLKLSMNEIIEECKMFFFAGQDTTSTLLSWTVFLLSSHQEWQDRLRQEVLKECRMGIPDSDMLAKLKLVNMVFLEVLRLYSPVITTFRKASKDIKFGNLIIPRDTCISIPVVKIHRMEKYWGEDANEFNPLRFSNGVSEAAKHPNALIAFGMGPRACIGKKFAMLEAKIVIVLMLQRFSFFLSPDYKHTPMENLTLQPQCGIPILMEPLLL

SEQ ID NO: 48166 - protein, 495 aa, Zea mays
MSLAAVVIMIAEGAFGSSAGALPAAYPSAWSEAAASFIRTGMEENATGINCWTIALLTAGWYLGGLHIVLILLMLLYVPPPRWYQIPDFHCNVCSFPAFRVVDADRFQDHFCPVKMADELRSTSVGQKFHGQSVLLSRISSYSAMNNPVFNNAYSAYNVPQRSYHGMNATAGLSSVMAPSPVFASAPKEKGFSGFMIDFMMGGVSAAVSKTAAAPIERVKLLIQNQDEMLKTGRLSEPYKGIGDCFGRTIRDEGFVSLWRGNTANVIRYFPTQALNFAFKDHFKRMFNFKKDKDGYWKWFAGNLASGGAAGACSLFFVYSLDYARTRLANDAKAAKKGGERQFNGLVDVYRKTLASDGIRGLYRGFNISCVGIIVYRGLYFGMYDSLKPVLLVGTLQDNFLASFLLGWGITIGAGLASYPIDTVRRRMMMTSGEAVKYNSSLDAFKQIVAKEGTKSLFKGAGANILRAVAGAGVLAGYDKLQVVVFGKKYGSGGG

SEQ ID NO: 48167 - protein, 401 aa, Thermotoga maritima MSB8
MNVVVQKYGGSSVATPERIKNVAQRIKKKVDEGYKVVVVVSAMGKTTDNLIKLAKEISPRPDSRELDMLLATGEQVSAALLSMALKDLGVKAKSLNAFQVKIKTTPHHTSARIVDIDDSVIRENLKDYDVLVVTGFQGVNEHGDLTTLGRGGSDTSAVALAAKLRVPCEIYSDVDGIYTCDPRVHPRAKKLAYITYDEALELTALGAKVLHSRSVEIAKKYGIPIYCASSFTEEEGTMVVERLPEWLEEPVVTGATISHGQIKVSISFLPKDVKYITAIFEEVGKRALNVDMISLVPSNGKVFLSFTILEDHKEDLDEALKEALRDVEGWKSTYEGGFAKLSIVGVGMRTSPGVAARFFEALERAGVTPELVTTSEIKISCLVPEEKAEEALKSVIEEFEL

SEQ ID NO: 48168 - protein, 413 aa, Rhodopirellula baltica SH 1
MKAFEATRIFFDQAADRLEIDPDLREALLMPQREVQVQVTIRLDDGRLANYIGFRVQHDHSRGPMKGGLRFHPEVDLDETRALASLMTWKTAVVDLPYGGAKGGIGIDPSKMSSAEIERLTRAFVDQIHDIVGPDTDIPAPDMGTDHQVMAWFRNQWEKYHGFHPAVITGKPVEEYGAKGREEATGRGVGTLTVKLTKRLGMDASKTRVAIQGFGNVGSHAAKFLHDAQFPIVAVSDITGTYYNADGLNIPELLRHKFAHPKGLLEGFERAEHLPLDALLKLDHVEVLIPAALGGVITQKNAQDINAKVIVEAANGPVDPDADAALHDRGVTILPDILANAGGVTVSYFEWVQNRQHYRWPLDRVRQELDHTMNEAFEKVWQMAAQHEVSLRTAAYMIGISRVRRATELAGLA

SEQ ID NO: 48169 - protein, 319 aa, Rhodopirellula baltica SH 1
MGGYSLMSRGKTFDNIARAIGDTPMVQINRLVPSGDATVFAKCEFFQPLNSVKDRIGVAMIEAGERDGSINPDTHIIEPTSGNTGIALAFVCAAKGYKLTLTMPESMSVERRALLRAMGANLVLTPAGDGMKGAITTAQELVDQTDNSFMPQQFENPSNPAIHEATTGPEIWADTDGKIDAIVAGVGTGGTITGVARYLKKQNPDFKAFAVEPKHSPVISGGSPGKHRIQGIGAGFIPGNLDTSIIDDVVQVDDEDAFEWGRQLAKQEGIVAGISSGANMWAAAQIAARPEMKGKRIVTVMCSLGERYLSTPLFGDLGL

SEQ ID NO: 48170 - protein, 675 aa, Daucus carota
MNTTCIAVSNMRPCCRMLLSCKNSSIFGYSFRKCDHRMGTNLSKKQFKVYGLRGYVSCRGGKGLGYRCGIDPNRKGFFGSGSDWGQPRVLTSGCRRVDSGGRSVLVNVASDYRNHSTSVEGHVNDKSFERIYVRGGLNVKPLVIERVEKGEKVREEEGRVGVNGSNVNIGDSKGLNGGKVLSPKREVSEVEKEAWELLRGAVVDYCGNPVGTVAASDPADSTPLNYDQVFIRDFVPSALAFLLNGEGEIVKNFLLHTLQLQSWEKTVDCHSPGQGLMPASFKVKNVAIDGKIGESEDILDPDFGESAIGRVAPVDSGLWWIILLRAYTKLTGDYGLQARVDVQTGIRLILNLCLTDGFDMFPTLLVTDGSCMIDRRMGIHGHPLEIQALFYSALRCSREMLIVNDSTKNLVAAVNNRLSALSFHIREYYWVDMKKINEIYRYKTEEYSTDAINKFNIYPDQIPSWLVDWMPETGGYLIGNLQPAHMDFRFFTLGNLWSIVSSLGTPKQNESILNLIEDKWDDLVAHMPLKICYPALEYEEWRVITGSDPKNTPWSYHNGGSWPTLLWQFTLACIKMKKPELARKAVALAEKKLSEDHWPEYYDTRRGRFIGKQSRLYQTWTIAGFLTSKLLLENPEMASKLFWEEDYELLESCVCAIGKSGRKKCSRFAAKSQVV

SEQ ID NO: 48171 - protein, 553 aa, Bordetella pertussis Tohama I
MSNIVEIKVPDIGDFKEVEVIEVLVSAGDTIKAEQSLITVESDKASMEIPASAAGVVKSVKVKVGDKIAEGTVILEVEAAGEAAAAPKAEAPKAEAPKAEQAAETPKADAAKAEAPQAQAAQAEAPAAAGPIEVKVPDIGDFKEVEVIEVLVAEGDTIKAEQSLITVESDKASMEIPASAGGVVQSLKVKVGDKVAMGTVIAVVQGQGAAAAPAAAEPAAPASPVAPASAPAQRPAPAAALQDEDLKPGQLPHASPSVRKFARELGVNLSRVTGSAAKGRITADDVRAYVKQALSAGAPAGASGGGDGAALGLLPWPKIDFTKFGPIEAKPLSRIKKISGANLHRNWVMIPHVTNNDEADITDLEALRVALNKENEKSGVKVTMLAFLIKAVVAALKKFPEFNASLDGDNLVLKQYYHIGFAADTPNGLVVPVVRDADKKGILELARETSELARKAREGKASPAEMQGGCFSISSLGGIGGTHFTPIINAPEVAILGVSRSAHKPVWDGKQFVPRLTLPLSLSYDHRVIDGASAARFNAYLGQLLVDFRRIAL

SEQ ID NO: 48172 - protein, 596 aa, Bordetella pertussis Tohama I
MSNIVEIKVPDIGDFKEVEVIEVLVAAGDTIKAEQSLITVESDKASMEIPASSAGVVKSVKVKVGDKVAEGTVILDVEAAGEAAAAPKAEAPKAEAPKAEAPKADAPKAPAAKASAPAAAAYSGSADLECDMLVLGAGPGGYSAAFRAADLGMDTVMVERYATLGGVCLNVGCIPSKALLHNAAVIDEARALAAHGISFGEPKVDLDKLRGYKDSVVAKLTGGLAGMARARKVRVVTGTGEFADPHHLTVTDGEGKKQTIRFKQAIIAAGSQSVKLPFLPDDERIVDSTGALQLRAIPKKMLIVGGGIIGLEMGTVYSTLGARLDVVEMLDGLMQGADRDLVKVWQKMNAPRFDNIMLKTKTVGAEARKDGIYVSFEGEGAPKEPQRYDLVLQAVGRSPNGKKIGAERAGVAVTERGFIEVDRQMRTNVPHIYAIGDVVGQPMLAHKAVHEGHVAAEAAHGEKSYFDARVIPSVAYTDPEVAWVGLTEDEAKKQGVKVEKGLFPWAASGRAIANGRDEGFTKLLFDAETHRIVGGGIVGTHAGDLISEIALAIEMGADMVDIGKTIHPHPTLGESVGMAAEVAEGVCTDLPPMRKK

SEQ ID NO: 48173 - protein, 250 aa, Triticum aestivum
MAPSQEVAAPAATATKEPSANGNGTNGTPAAAPKTKAPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDCRRYENHGGGLFIVLTTDRLQCFRLMLTDNFIGEFIQEEREQGGGRQRLPAVGGRLR

SEQ ID NO: 48174 - protein, 285 aa, Streptomyces avermitilis MA-4680
MSGQSLLVPGELSPTRPVPGNIRRPEYVGKPAPTPYTGPEVQTPETVEAMRVAGRIAAQAMAEAAKLIAPGVTTDELDRVAHAYMCDHGAYPSTLGYRGYPKSLCTSVNEVICHGIPDSTVLRDGDIVNLDVTAYIGGVHGDNNATYLVGDVDEESRLLVERTRESLNRAIKAVKPGRQINIIGRVIESYAKRFGYGVVRDFTGHGINSSFHSGLIVPHYDSPHATTVIQPGMTFTIEPMLTLGTHDYDMWDDGWTVVTKDRKRTAQFEHTLVVTDSGADILTLP

SEQ ID NO: 48175 - protein, 339 aa, Physcomitrella patens subsp. patens
MGIYLCSPKTDKTSEDDENAELRYGLSAMQGWRDSMEDAHKAILNVDKNTSTSIFGIFDGHGGKLVAKFCAKHLHQEVLKSEAYAKGDLKASLEYSFLRMDEMMKGASGWKELQSLEETSSQLDKLGNGNSSSNAREDDESDYSYAHKYSDFQGPIYGSTAVVALIRGNKLFVANAGDSRCIMSRRGEAVNLSIDHKPNLEHERKRIESAGGFVHGGRVNGSLNLTRAIGDMEFKGRPDLPPDKQVVTCCPDVVEVDLGPGDEFIVLACDGIWDVMSSQAVVDFVKSRLPTTKTLSSLCEEILDYCLSPTTRQQEGCDNMSIIIVQPKQSGVAASSSTD

SEQ ID NO: 48176 - protein, 413 aa, Saccharophagus degradans 2-40
MHSGKQDNWLSLREDIPACTNSVYLNSAGASPTHSATHHVMVAHLQLERELGGYQAAIKAMPAIEAFYTNIGTLINAQPHEISYCENATRAWQMAFYALNLTKGDRVITHISEYSSNLIAMQHRAERDGIIIDMAPSLTDGTIDTANLEQLITPRTKVIAITHIAMHLGMVNPVNNIGEIANRHNLIFMLDACQSLGQRVINVENIGCHILTATGRKFLRGPRGTGLLYVNASILPTLQPAFIDNLSATWQADGSFCLSQTNTRFESWERNISGMLGLAKAVEILNQIGPHGAQARVSELASYAVTSLTGSRFTTFESTCESTDKTPRETASDKLSGIITLKLEHTVNPFDIAQQLEQQGVHLSVIKRQQAFPYFRFRHVEQEGIIRIGLHYFNTHADIDFLNTQLQAIAPNT

SEQ ID NO: 48177 - protein, 424 aa, Staphylococcus epidermidis ATCC 12228
MTVTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 48178 - protein, 123 aa, Brassica rapa subsp. rapa
MAATAELIPAGEVIACHTVEDWNNKLKAAKESNKLIVIDFTAVWCPPCRFIAPIFVELAKKHLDVVFFKVDVDELATVAKEFDVQAMPTFVYMKGEEKLDKVVGAAKEEIEAKLLKHSQVAAA

SEQ ID NO: 48179 - protein, 85 aa, Physcomitrella patens subsp. patens
MFATAVLWARKLGPRPIKVQNLGEQVHLASQTLHKILEEHGPITVSECWNHASQMQNHGLKSKRHMKMMLRWMRERRTVKIVVKH

SEQ ID NO: 48180 - protein, 628 aa, Coccidioides immitis RS
MVSASKAARQAKRAAEGKEKKTPASRLSSKVNSKNASRASSVNGDQVEDANLIEEPATSASKMSDIKRLTEQMDKHGLSDRVTTGVLASLPSSQDVKITSASLVFHGRVLITDSTLELNYGRRYGLLGENGCGKSTFLKAIDKREFPIPEHIDIYLLNEGAPPSELGALEWVVKEAENEMERLDKLAEEILEKDGPESPILEDLYERMETMDPSTFHTRASLILTGLGFNKKTITKKTKDMSGGWRMRVALAKALFVKPSLLLLDDPTAHLDLEACVWLEEYLKKWDRTLILVSHSMDFLNGVCTNMIDMRQKSLMYYGGNYDSYHKTRSENETNQMKAYHKQQEEIAHIKKFIASAGTYANLVRQAKSRQKILDKMEADGFIQPVIPDKIFTFRFADVEKLPPPVLSFDDVTFSYSGDAKDNLYEHLDFGVDMDSRTALVGPNGVGKSTLLRLMTGKLSPTSGSVTRHTHLKLGLYSQHSAEQLDLTKSALDFVRDKYKEKSQDYQYWRQQLGRYGLTGDAQTALMGTLSEGQKSRIVFALLAIDGPNMLLLDEPTNGLDIPTIDSLADAINAFSGGVVVVSHDFRLLDKIAKDIMVCEHKTVRRWDGSIGEYKNYLRKKMISAGQV

SEQ ID NO: 48181 - protein, 431 aa, Zea mays
  misc_feature (413)..(413): Xaa can be any naturally occurring amino acid
MKRVSSHVSLASEAEINLDLSRLIIDKPRFTLERKRSFDEQSWSELSHRQNDGFDSVLQSPAFPSGVFDSPFSVGTHFGGPHPLVNEAWEALRKSVVYFREQPVGTIAAVDHASEEVLNYDQVFVRDFVPSALAFLMNNETDIVKNFLLKTLHLQSSEKMVDRFKLGAGAMPASFKVDRNKNRNTETLVADFGESAIGRVAPVDSGFWWIILLRAYTKYTGDVSLSESPECQKCMRLILNLCLSEGFDTFPTLLCTDGCSMIDRRMGIYGYPIEIQALFYMALRCALQMLKPEGEGKDFIEKIGQRLHALTYHMRNYFWLDFHQLNNIYRYKTEEYSHTAVNKFNVIPDSIPDWVFGFMPCRGGYFLGNVSPAMMDFRWFALGNCIAIVSSLATPEQSVAIMDLIEEKWDELXGEMPLKICYPALENHEWR

SEQ ID NO: 48182 - protein, 256 aa, Glycine max
  misc_feature (181)..(181): Xaa can be any naturally occurring amino acid
  misc_feature (188)..(188): Xaa can be any naturally occurring amino acid
  misc_feature (209)..(209): Xaa can be any naturally occurring amino acid
  misc_feature (236)..(236): Xaa can be any naturally occurring amino acid
  misc_feature (238)..(238): Xaa can be any naturally occurring amino acid
MAERGGGDRGGDRGGFGRGFGGRGRGGDRGRGPRREEDEKWVPVTKLGRLVNDGRIRSLEQIYLHSLPIKEREIIDTLVGPTLKDEVMKITPVQKQTRAGQRTRFKAFVVVGDNNSHVGLGVKCSKEVATAIRGAIILTKLSVIPVRRGYWGNKIGKPHTVPCKVTGKCGSITVKMVPTPXGSRIVAXLKVPKKVLQFTDINNIFTSSXKSTKTLSNFLKTTFNYLIKTYKFLTPXFXKKTSFSKSPFQKYTHLLT

SEQ ID NO: 48183 - protein, 175 aa, Brassica napus
  misc_feature (93)..(93): Xaa can be any naturally occurring amino acid
  misc_feature (168)..(168): Xaa can be any naturally occurring amino acid
GMGVSGGEEGARNGPSLMPGGSFQAYNNVKDILEKVAAQVEDGPCVTYIGEGGSGNFVKMVHNGIEYGDMQLISEAYDVLKNVGGLSNDELAXEIFTEWNRGELESFLVEITSDIFRVKDEFGDGELVDKILDKTGMKGTGKWTVQQAAELSVAAPTIAASLDCRYLXGLKDERE

SEQ ID NO: 48184 - protein, 421 aa, Bacillus halodurans C-125
MEDKDKRSGKTTDVLASTQTVIKKALDKLGYPDEMYELMKEPIRMLTVRIPVRMDDGSTKIFTGYRAQHNDAVGPTKGGVRFHPNVTEKEVKALSIWMSLKAGIVDLPYGGGKGGIVCDPRDMSFRELERLSRGYVRAISQIVGPTKDIPAPDVFTNSQIMAWMLDEYSRIREFDSPGFITGKPIVLGGSHGRESATAKGVTICIREAAKKKGIDLQDARVVIQGFGNAGSFLAKFMHDAGAKVIGISDAYGALHDPDGLDIDYLLDRRDSFGTVTKLFKNTISNEELLELDCDILVPAAIENQITEKNAHNIKAQIVVEAANGPTTIEATEILTNRDILLVPDVLASAGGVTVSYFEWVQNNQGYYWTEEEVEGKLEAVMVHAFDNIYKLAKGRKVDMRLAAYMVGVRKMAEASRFRGWV

SEQ ID NO: 48185 - protein, 307 aa, Physcomitrella patens subsp. patens
MGVIGETPAWATSLDWQAESLPAVNDLAVLPLFAIGFFTVRFCLDKLVFERLGRRFISGYTSSLEISSEEIETQRKKLVKFKESAWKCVYYLSAEILALAVTKDEPWFTTTKYFWTGPGDRSWPDQLMKQKLKFLYGFAGGFYTYSIFALLFWETRRSDFGISMSHHIATLMLIVFSYLAKLARVGSVVLAVHDASDVFLEIGKMTKYSGLEIIPSISFLLFAISWLVLRLIIFPFMIIRSTSYECLKYLDRTMAEGPVYYYVFNTLLITLQVMHIYWWVLIWRMIVRQIQDRGKLSDDVRSGSFLS

SEQ ID NO: 48186 - protein, 234 aa, Xanthomonas oryzae pv. oryzae KACC10331
MMRSGFAAASRSLPPRNSQRMRILLARHGETPWNAEGRYQGQIDIPLSPVGEGQARALGERLHALQIDRAVASPLSRAQATAKAALGASREALLQTDADLQEIAHGEWEGLLASEINDKDPARLRAWREEPDTVLMPGGESLRQVLDRSWRGLVRAADGLGADDTLLVVAHDAVNRVILCNILGLPLCKLWSFRQAPTTLNLLEGDDVEHLEVVRLNDCAHHTPFFGEAKHRAL

SEQ ID NO: 48187 - protein, 322 aa, Bacillus halodurans C-125
MKKVLVIHTGGTIAMHEDEKGGVQPKETNPLFATVESLTSIASIEVDDFLNIPSPHMTPELMFQLAERLKSRVGNESFDGVVITHGTDTLEETAYLLDLLLDWEVPVVVTGAMRSSNELGADGPHNFISAVKTAATDEAKGKGVLVVFNDEIHTAKNVTKTHTSNVATFQSPQYGPIGIVTKRGVTFHHAPSYKESYTVSSIDHRVVLLKAYAGMDGSVVDAIADTGIDGLVIEAFGQGNLPPAVVPSIKRLHQANIPVVLVSRSVSGIVQETYAYEGGGRHLKDLGVIFTNGLNGQKARLKLLVALELTTDRKKLQEIFFK

SEQ ID NO: 48188 - protein, 249 aa, Sulfitobacter sp. EE-36
MRRKLAAGNWKMNGTLAGLDMLADVAAAMDSTRAEAVICPPAPYLLPAVTKAQGTPVGIGAQDCHAEPKGAFTGDISASMIKEVGATYVIIGHSERRDAYGETDADVSAKARAAWDAGLTAIICIGESEADRSAGTTLDVIAEQLAGSLPDGCTGENTVVAYEPIWAIGTGKIPTLDQIVEVHDFIRATLAERFGTDVSDALRLLYGGSVKPDNAAEIFKVDNVDGALIGGASLRAADFVPIFQALAAT

SEQ ID NO: 48189 - protein, 408 aa, Frankia sp. CcI3
MTATTDQPTLGSTTSDFAGLSPRPSDDDPAFALHRGGKININATAPLNSREDLSLAYTPGVARVCTAIAGTPALADDYTWRSNTVAVVTDGTAVLGLGDIGPAASLPVMEGKAALFKRFGGVDAVPLALACTDVEEIVDTVARLAPSFGGINLEDISAPRCFAIERLLQDRVDIPVFHDDQHGTAIVALAALENAAKLTGRTLGDLRAVVSGAGAAGAAVARILLAAGIGDIAVGDSRGILYAGRDNLTPSKAALAAETNRAGLAGSITDALAGADVFLGLSAGQVPEEAVATMAPEAIIFAMANPDPEIDPAVAHKYARIVATGRSDYPNQINNVLAFPGIFRGALDVRASRVTEGMKLAAARALAAVIADELAEDLIIPSVFDDRVAPAVAAATAAAARADGVARR

SEQ ID NO: 48190 - protein, 574 aa, Zea mays
MEGLIQTRGILSLPAKPIGVRRLLQPSHGLKQRLFTTNLPALSLSSNGHKKFQAFQQIPLGISVSHKERSRGFICKAEAAAAGGGNVFDEGDTAAMAVSPKIFGVEVTTLKKIVPLGLMFFCILFNYTILRDTKDVLVVTAKGSSAEIIPFLKTWVNLPMAIGFMLLYTKLSNVLSKKALFYTVIVPFIVYFGAFGFVMYPLSNLIHPEALADKLLATLGPRFMGPLAIMRIWSFCLFYVMAELWGSVVVSVLFWGFANQITTVDEAKKFYPLFGLGANIALIFSGRTVKYFSNMRKNLGPGVDGWAVSLKAMMSIVVGMGLAICFLYWWVNRYVPLPTRSKKKKVKPQMGTMESLKFLVSSPYIRDLATLVVAYGISINLVEVTWKSKLKAQFPSPNEYSAFMGDFSTCTGIATFTMMLLSQYVFKKYGWGVAAKITPTVLLLTGVAFFSLILFGGPLAPLVAKLGMTPLLAAVYVGALQNIFSKSAKYSLFDPCKEMAYIPLDEDTKVKGKAAIDVVCNPLGKSGGALIQQFMILTFGSLANSTPYLGERERERELTSPPPPPKKKKKKTRG

SEQ ID NO: 48191 - protein, 752 aa, Saccharomyces cerevisiae YJM789
MASIGSQVRKAASSIDPIVTDYAVGYFNHLSGITFDAVQSKQVDLSTEVQFVSDLLIDAGASKAKVKELSESILKQLTTQLKENEAKLELTGDTSKRLLDINVLKSHNSKSDINVSLSMLGVNGDIEHAGRKMETRVDLKKLAKAEQKIAKKVAKRNNKFVKYEASKLINDQKEEDYDSFFLQINPLEFGSSAGKSKDIHIDTFDLYVGDGQRILSNAQLTLSFGHRYGLVGQNGIGKSTLLRALSRRELNVPKHVSILHVEQELRGDDTKALQSVLDADVWRKQLLSEEAKINERLKEMDVLRQEFEEDSLEVKKLDNEREDLDNHLIQISDKLVDMESDKAEARAASILYGLGFSTEAQQQPTNSFSGGWRMRLSLARALFCQPDLLLLDEPSNMLDVPSIAYLAEYLKTYPNTVLTVSHDRAFLNEVATDIIYQHNERLDYYRGQDFDTFYTTKEERRKNAQREYDNQMVYRKHLQEFIDKYRYNAAKSQEAQSRIKKLEKLPVLEPPEQDKTIDFKFPECDKLSPPIIQLQDVSFGYDENNLLLKDVNLDVQMDSRIALVGANGCGKTTLLKIMMEQLRPLKGFVSRNPRLRIGYFTQHHVDSMDLTTSAVDWMSKSFPGKTDEEYRRHLGSFGITGTLGLQKMQLLSGGQKSRVAFAALCLNNPHILVLDEPSNHLDTTGLDALVEALKNFNGGVLMVSHDISVIDSVCKEIWVSEQGTVKRFEGTIYDYRDYILQSADAAGVVKKH

SEQ ID NO: 48192 - protein, 332 aa, Kitasatospora griseola
MTRIAINGFGRIGRNVLRALLERDSKLEVVAVNDLTEPTALGRLLAYDTTSGRLGRPVTVEGDVLVVDGRRIKVLAERNPADLPWADLGVDIVLEATGRFTSAEAARAHLAAGAKKVLVSAPSDGADVTLAYGVNTEAYDPAAHTIVSNASCTTNALAPLAAVLDELAGIEHGFMTTVHAYTQEQNLQDGPHRDPRRARAAGVNIVPTTTGAAKAIGLVLPQLDGKLSGDSIRVPIPVGSIVELNTTVSRDVTREEVLAAYREAAGGKLAGVLEYSEDPLVSSDIVGNPASSIFDSELTRVDGRHVKVVAWYDNEWGFSHRVIDSLELLAAS

SEQ ID NO: 48193 - protein, 56 aa, Glycine max
STFGADANANANKSYEVSQPPSDAISSIRFSPKDNVFVTTSWDNQVRCWEITRNGT

SEQ ID NO: 48194 - protein, 150 aa, Lolium perenne
MAEQTFIMIKPDGVQRGLIGEIISRFEKKGFYLKGLKLQNVEKSFAEQHYADLSSKPFFGGLVEYIVSGPVVAMVWEGKSVVATGRKIIGATNPLASEPGTIRGDFAVDIGRNVIHGSDSVENARKEIALWFPEGLAGWTSSQHNWIYEA

SEQ ID NO: 48195 - protein, 440 aa, Pediococcus pentosaceus ATCC 25745
MNKNEHTHLQKNIGLFAAFSTVMGTVIGAGVFFKVSSVTASTQSAGLSLLAWLAGGLLTICAGLTSAELASAIPVTGGAIKYLEVTYGKLTGFLLGWAQTLIYFPANIAALSIIFGTQFTNLFHLKAGLILSIAVICGASITGINLLGTKHGARLQSVALIAKLIPIAVIIAFGLFAPSNVHLSLIPEHFTTSQTLTGFSGGLLSTLFAYDGWLGIGAIAGEMKNPKRDLPLAIGLGLTGIMIVYLGINLVFLKTLPISDLAGNLNAASTAAGQLFGNIGGKLVTIGILISVYGALNGYTMTGMRIPYAMAKEDSLPMSNHLSKLSRTAVPYVAGIVQLVIAGLMMIVGSFDLLTDMLIFVMWIFNVLIFYAVIKLRHTQPDLVRPYKVPLYPFLPVVAILGGIFVLVTTIIDQPILATTGIVITLLGIPLYLVTKRKSS

SEQ ID NO: 48196 - protein, 331 aa, Ralstonia metallidurans CH34
MSSPRGARRLGRPRLLIVGCGDVGTRILRLLSARMRVFAVTSQPERRAELRAAGAVPLVADLDRPATLARLSRLAERVIDLAPPPGQGEGDPRTQGLLGALRRTAWRRARFTRLPTGAGEAAILPEQGWHRAFQTARRHQSRGVFVYASTTGVYGDRGGARVREFDAVRPQTARARRRVAAEAAVRRFGRDAGWRAGIVRIPGIYAEDRLPIARLNKRTPALASQDDVYTSHIHADDLARTMIAAMWRGRPQRVVHASDDTELRMADYFDLVADRKDLPRPPRITRQQAREMIEPTLLSFMSESRRIDNRRLKRELRLRLRYPTVASFFDR

SEQ ID NO: 48197 - protein, 446 aa, Saccharomyces cerevisiae YJM789
MDDKVSEKESSPKQTEEDSEGKMAHVQPASYVNKKKYAFGKTLGAGTFGVVRQAKNTETGEDVAVKILIKKALKGNKVQLEALYDELDILQRLHHPNIVAFKDWFESKDKFYIITQLAKGGELFDRILKKGKFTEEDAVRILVEILSAVKYMHSQNIVHRDLKPENLLYIDKSDESPLVVADFGIAKRLKSDEELLYKPAGSLGYVAPEVLTQDGHGKPCDIWSIGVITYTLLCGYSAFRAERVQDFLDECTTGEYPVKFHRPYWDSVSNKAKQFILKALNLDPSKRPTAAELLEDPWIICTELKTHNLLPGLKEGLDARQKFRDSVERVRLNMKIQKLRDLYLEQTESDSDFDEGSQANGSVPPLKATDTSQLSKKLSEEEQSKLKSELTSKAFAQLVNTVLAEKEKFLNINRVCSSDSDLPGSDIKSLDEAKEKPEGKDTKTEE

SEQ ID NO: 48198 - protein, 335 aa, Rhodobacter capsulatus
MARLAINGLGRMGKLLLRRLIDLGRGPEIVLLNDAMGDAETHALLLEFDTVHGRWPTPVAATETGLQIAGQRIRLTREKTLEALPLAEIGVDLVLDCTGQFKTAAKVQPYFDAGVRKVVVSAPVKDTGALNLVYGVNHVLYDGSQRLITAASCTTNCLAPIVKVIHEALGIKHGSITTLHDVTNTQTIVDRPAKDLRRARSALMNLIPTTTGSATAITLIYPELKGRLNGHAVRVPLLNASLTDCVFELDRPTTVAEVNSLLQTAAEGGLNGILGFETRPLVSSDFTNDPRSAVIDGPSTMVVNGTQLKLYAWYDNEWGYVCRMADIARMVAGSL

SEQ ID NO: 48199 - protein, 267 aa, Arabidopsis thaliana
MASVASSTTLISSPSSRVFPAKSSLSSPSVSFLRTLSSPSASASLRSGFARRSSLSSTSRRSFAVKAQADDLPLVGNKAPDFEAEAVFDQEFIKVKLSDYNGKKYVILFFYPLDFTFVCPTITAFSDRHSEFEKLNTEVLGVSVDSVFSHLAWVQTDRKSGGLGDLNYPLISDVTKSISKSFGVLIHDQGIGIALRGLFIIDKEGVIQHSTINNLGIGRSVDETMRTLQALQYIQENPDEVCPAGWKPGEKSMKPDPKLSKEYFSAI

SEQ ID NO: 48200 - protein, 336 aa, Bordetella pertussis Tohama I
MTIRVVINGYGRIGRNILRAHYENGKKHDIEIVAINDLGDPKTNAHLTRFDTAHGKFPGTVTVDGDYMVVNGDKIRVLANRNPAELPWGELGVDVVLECTGFFTSKEKAGAHLKGGAKKVIISAPGGKDVDATIVFGVNQNVLKAEHTVISNASCTTNCLAPLVKPLHDKLGVETGLMTTVHAYTNDQVLTDVYHEDLRRARSATMSMIPTKTGAAAAVGLVLPELNGKLDGFAIRVPTINVSLVDLSFVAKRDTTVEEVNSILQAAAEGELKDILTYNTEPLVSIDFNHNPASSNFDATLTKVSGKLVKVSSWYDNEWGFSNRMLDTTVALMSAK

SEQ ID NO: 48201 - protein, 341 aa, Nanoarchaeum equitans Kin4-M
MAYLFIHLNGLYVLDEDGTLLEYKPMEFSEEEAYKLKKGILPESLKGEIDKLKSKYELKILGRAYKGLDLPLDLNTKLINKALFYARENDNFSYIRDVQYEVTIRELSESVSHDWLIIQAIKALDDTNKILNLMMERFREWYELYFPELSKKFEDHEQFVKAVLEKPREEWLKELGLDKTMGGNIDEESKQILMTFAQRIKDMYEFRKQLQNYIKQMMERYAPNVTAIAGPLVGARLLALAGGLKELAYLPASTIQVLGAEKALFKHLTKGTPPPKHGVLFNHPYVQKLPKKLRGRMARTLAAKIAIAAKVDAFGHYFIGDKLKKEIDERFEELKKEAERL

SEQ ID NO: 48202 - protein, 397 aa, Bordetella pertussis Tohama I
MSNVNTLSALAKSGALSGKRVFIRADLNVPFDDAGRISEDTRIRASVPGIRLALDAGAAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELDALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKTAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 48203 - protein, 406 aa, Glycine max
MDTDATGDPVDKLKAIQNDDVEYQDEDDDFDDEEEEEDDPITLGFVDKPKNEWSLRRQYFPSKTGGVPAWLDPLNIPSGRSSVCDICGDPLQLLLQVYAPTDKETTFHRMLFVFMCPSMKCLLRDQHEQWKRHPEKPSRSVKVFRCQLPRINPFYSPECPQYNESHEPAGSGAALCDWCGTWKGDKLCSSCRQARYCSEKHQAMSWRTGHKTACQQMKVSSPVFGPNKSGTTSLESHKVGSKNLWPEFEISIEDESEYNRDISEENSLANSLISRNRNDDTMNSLMDNFKGDDDKKSWASFQERIAEAPEQVLRYYRNTNAKPIWPVSSGRPSNADIPKCSYCSGPMSCEFQILPQLLYYFGVDNEVDSLDWASIVVYACEASCEASLPYKNEFAWVQIYSLSTTL

SEQ ID NO: 48204 - protein, 352 aa, Ostreococcus tauri
MTWNVLVTGGAGYIGSHTCVRLLQAGARVTVVDNFDNSCAESLKRVRNIVGEDAGARLTHHEVDCCDKVALDGVFASAGVTFDAVIHFAGLKAVGESVAEPMKYYENNIVSTLVLCETMAKHGCKTIIFSSSATVYGEPASVPCTEDFPTAALNPYGRTKLFIEHILSDLYVSDKEWKVALLRYFNPVGAHESGTLGEDPKGIPNNLMPFVQQVAVGRRPELNVFGNDYPTKDGTGRRDYIHVVDLADGHVAAVKKLTSDPDAGLLTVNLGTGKSTSVLELVAAFEKASGKKIPCKIVDRRAGDAAEVYGATDKAFKVLGWRALRTIEDCCIDQWKWASSNPYGYAGKPDDA

SEQ ID NO: 48205 - protein, 494 aa, Haemophilus influenzae R2846
MQTDNNCIVIFGASGDLTHRKLIPALYNLYKIGRLSENFSVLGVARSDLNDETFRKKMREALIHNEETTPDTLDAFCSHLYYQAVNTSDAQDYGKLVPRLDELHDKYQTCGNTLYYMSTPPSLYGVIPECLAAHGLNTEEYGWKRIIVEKPFGYDEKTAQALDVQIHRFFEEHQIYRIDHYLGKETVQNLLVLRFSNGWFEPLWNRNFIDYVEITGAESIGVEERGGYYDGSGAMRDMFQNHLLQVLAMVAMEPPAIINANSMRDEVAKVMHSLRPLTSEDMENNLVLGQYTAAEINGKMEKGYLEEKGVPADSRTETYISLRCEIENWRWAGVPFYVRTGKRLPARVTEIVIHFKTTPHPVFSQNAPENKLIIRIQPDEAISMRFGLKKPGAGFEAKEVSMDFRYADLAGTQVLTAYERLLLDAMKGDATLFARTDAVHAAWKFVQPILDYKANGGRIHEYEAGTWGPVAADKLIAKQGKVWRKPSGLMKKKV

SEQ ID NO: 48206 - protein, 269 aa, Haemophilus influenzae R2846
MLTLNEHLLNQVLLIAYQAGKHLQQFYQKQVHVELKEDNTPVTEADLFVSQFLTEKLTALFPNIPVLSEENCHISFEERKNWKEYWLIDPLDGTQQFINRTDQFSVLITLVRKNKPVLSVIHAPILSTTYYAMRDFGAFKKQLDQVKKLTKNTTNFDRPLRIAVGATTSQEKVRSILPKDFTCEFVVVGSSSLKSGLVAEGAVDCYVRLGQTGEWDTAGAEVLLNETHGAIFDSHFEPLTYNQRETLINPHFVMVGDQSFDWRSVFQFN

SEQ ID NO: 48207 - protein, 248 aa, Physcomitrella patens subsp. patens
MAARALYTVGFWIRETGQALDRAGCRLQGNYVFREELSRHKTLFNLFDKKPVVAEDAFVAPSASLVGDVQVGPKSSIWYGCVLRGDASGIRVGSETNIQDHSLVSVGGSRFGGGHAPAVIGNRVTIGHSAVIHACTVEDEAFVGMGATLMDGVVVEKGAFVAAGSLVTENTRIPAGQIWAGNPAKFLRELKGDETSFIPKSTDNYSELAAAHAEANVKSFQALTTAPEVKTEEPTPELSPNANPVSPS

SEQ ID NO: 48208 - protein, 493 aa, Leptospira interrogans serovar Lai str. 56601
MFMVTELSCCQKMTQLKRSLNLFDSISLMFSSMVGPGIFITTGYILHQVPNPNIVLLAWILGGFLAVAGAMSYAKSASLFPYAGGDYVYLKEAYSPIVAFASGWLSLSINFSASISLSALAFSKSFFSLINPSWDIYFFEIPFLGLTISIGTAQILAMSAILVFTIVNFFGISTASRIQNLFTSVKILGLVSFVILGFVIGNYDISRFKSFSLFPSDLKGFELLLAGVIPVTYSYLGWNMITYVAEEVKDPDKNIYKAVLYSCALVTILYILMNFLFLSSGTLSELSGDKIGITASSALFGPKATVFITVFICWAFLASISAYIIGGSRIYFAMARDGFFFQNMAKLHSKHKSPYMSLLFQCGYACLFCFVKEIESLLYLITCSTLLLATITAYTPILFEKRNYKLKFRIPGYPYTTYLYIASNFGIIATLLWNKPTEAFWGVGFTFLSIPMYYYFKIMQNTLSKNSTPLETPEVLATSLLPENEPVPIASGE

SEQ ID NO: 48209 - protein, 224 aa, Haemophilus influenzae R2846
MKPYLIAPSILSADLARLGNDVQNVLNAGADVIHFDVMDNHYVPNLTFGPAVCQALRDYGITEPIDVHLMVKPIDRIIPDFAKAGANYITFHPESSEHIDRSLQLIRDCGCKSGLVFNPATPLSYLDYVLDKVDVVLLMSVNPGFGGQSFIPATLKKLQQARKIIDESGYDIRLEVDGGVKVDNIAEIAAAGADMFVAGSAIFGKPDYKQVIDQMRTQLASVSA

SEQ ID NO: 48210 - protein, 594 aa, Coccidioides immitis RS
MDGFDEEAFKKFFPSTFGKQSREADVGAQINRTKRTEAAAKPQQLAGKPDVQTQQEVDSKAPAAQQPASASASGSDSDSDDSEDDDDEFPVSHDLVFKTHERAITTVTVDPSGARMITGSTDCTIKFHDFASLTPTTLRAFKSVEPSAKKHSAASETHPVHVAKFNPLSPGYVLAIAATPQPKILSRDGDTLTEFVKGDMYLRDMRNTKGHISEVTSGTWSPTDCNLCATAATDSTVRIWDANIGRSQKEVIVHKSKAAGSAGRTRITAVAWGSPAQGGNNVLVAAALDGSLVMWGGDGPFTRPSGEIRDAHTRDTWTSGLDISPDGRLIVTKGGDDTIKLWDTRKFKQPITTVSHISNSNIYPTSNIQFSPTGANIITGSQTGDLYILNPATLKPELKTPITPDSPIITVLWHEKLNQILAGSANGESHLLYNPNLSRNGALTIMSKAPKRRHIDDDPNLTTDLSLGFSGEGIISGSGIASATSFSSRHPTIGLTASGRSRDPRRPHLPAQTPFAKSQPDEKHIKENIPLSSMRDEDPREALLKYAEKAEKDPIFTSAWKHTQPKPIFAELSDDEEEEKKQGHLGPDRKRIKR

SEQ ID NO: 48211 - protein, 78 aa, Brucella melitensis 16M
MSDTAERVKKIVVEHLGVDADKVTEGASFIDDLGADSLDTVELVMAFEEEFGVEIPDDAAETILTVGDAVKFIDKASA

SEQ ID NO: 48212 - protein, 157 aa, Oryza sativa Indica Group
LKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 48213 - protein, 509 aa, Staphylococcus epidermidis ATCC 12228
MQNFKELGISDKTVQTLEAMGFKEPTPIQKDSIPYALEGDDILGQAQTGTGKTGAFGIPLIEKVVGQQGVQSLILAPTRELAMQVAEQLREFSKGQKVQVVTVFGGMPIERQIKVLKRGPQIVVGTPGRVIDHLNRRTLKTQGIHTLILDEADEMMNMGFIDDMRFIMDKIPAEQRQTMLFSATMPKAIQELVQQFMKAPKIIKTMNNEMSDPQIDEYYTIVKELEKFDTFTNFLDVHQPELAIVFGRTKRRVDELTSALLSKGYKAEGLHGDITQAKRLEVLKKFKNDQIDILVATDVAARGLDISGVSHVYNFDIPQDTESYTHRIGRTGRAGKEGIAVTFVNPIEMDYIRQIEDVNNRRMKALRPPHRKEVLKAREDDIKDRVQNWMSRENEPRLQRISSELLKEYDSTELVASLLQELVEANDEVEVQLTFEKPLARKNRSSKGGSRRSNHKRGNGKFDNKNRRSKGSKGQSSKKKNQKKFDRRDKQQKSGNQSLKGRTFADHQK

SEQ ID NO: 48214 - protein, 510 aa, Arabidopsis thaliana
MLTVDSQHCFSFILLCFFSLLCYSLLFKKLKDSHVGRDLLQSPPSLPIIGHLHHLLSSLAHKSLQQLSSKYGPLLHLSIFNFPVVLVSSASVAYEIFKAHDLNISSRDNPPINESLLVGSSVFVGAPYGDYWKFMKKLLVTKLLGPQALERSRSIRADELERFYRSLLDKAMKKESVEIGKEATKLSINSICRMSMGRSFSEESGEAERVRGLVTELDGLTKKVLLVNILRWPLEKLRISLFKKEIMYVSNSFDELLERIIVEREKKPNEHQGTYLMDVLLEAYEDEKAEHKITRNHIKSLFVELLLGGTDTSAQTIQWTMAELINNRNVLKRLREEIDSVVGETRLIQEKDLPKLPYLQSVVKEGLRLHPPLPLMVRTFQRSCEMKGFYIAEKTTLVVNAYAVMRDPTTWEDPDEFKPERFLRQEEERRALKHIAFGSGRRGCPGSNLATIFIGTAIGTMVQCFDLSIKGDKVKMDEVGGLNLTMAHPLECILVPRTQPFISNQQIPSL

SEQ ID NO: 48215 - protein, 406 aa, Anaplasma phagocytophilum HZ
MGDAVEVRAENLGGESILEAPIRVMKKVGDTVSAEDVLFIVETDKTSLEISAPVAGVLTELRVADEEVITKGQVLAIIRPQGEATAEGVNKEPESKEEVPAQPVVAQAVSTQKPQEKTIIEGKGLVTPTVEDFVAGINTTPTSRALGMSAKSEQDKKIVASQPSKDLMSCHGDVVGERRVKMSKIRQVIAARLKESQNTSATLSTFNEVDMSKVMELRAKYKDAFVKRYDVKLGFMSFFIRAVVLVLSEIPVLNAEISGDDIVYRDYCNIGVAVGTDKGLVVPVIRRAETMSLAEMEQALVDLSTKARSGKLSVSDMSGATFTITNGGVYGSLLSTPIINPPQSGILGMHAIQQRPVAVDGKVEIRPMMYLALSYDHRIVDGQGAVTFLVRVKQYIEDPNRLALGI

SEQ ID NO: 48216 - protein, 411 aa, Arabidopsis thaliana
MAGAASALFLLDIKGRVLVWRDYRGDVTAAQAERFFTKLIETEGDSQSNDPVAYDNGVTYMFVQHSNIYLMIASRQNCNAASLLFFLHRVVDYELLDEMMDFGYPQFTEARILSEFIKTDAYRMEVTQRPPMAVTNSVSWRSEGLKFKKNEVFLDVIESVNILVNSNGQIVRSDVVGALKMRTYLSGMPECKLGLNDRILLEAQGRAIKGKAIDLEDIKFHQCVRLARFENDRTISFIPPDGSFDLMTYRLSTQVLECVKPLIWVEAHIERHSRSRVEMLVKARSQFKDRSYATSVEIELPVPTDAYNPDVRTSLGSAAYAPEKDALVWKIQYFYGNKEHTLKADFHLPSIAAEEATPERKAPIRVKFEIPKFIVSGIQVRYLKIIEKSGYQAHPWVRYITMAGEYELRLM

SEQ ID NO: 48217 - protein, 432 aa, Ostreococcus tauri
MDGDADAPTDGFASVEDALEEVRRGRFVVVLDDEDRENEGDLIGAADKMTAASMAFMIRHTSGLVCVSLEEDRADALDLPLMVDSKSNKDAMKTAFTVSVDLATSTTGISAGERAATINALGAEETTANAFVRPGHVFPLRYKAGGVLKRAGHTEAAVDLARMAGCSPVGVLCEIVNDDDGSMARLPQLKVFAEKHGLKMVLIKDMIRYRRAREKLVERTAVARLPTEWGNFTCVSYKNTLDGIEHVALLYGEYDHDVASAIGPDMLVRVHSECLTGDIFKSARCDCGNQLDLAMQRVAKEGQGCIVYLRGQEGRGIGLGHKLRAYNLQDEGRDTVQANEDLGFPADSREYGVGAQILQDLGVTSLRLMTNNPAKYHGLSGYGLKVTGRVPLFAPITMENKRYIDAKRMKMGHLFDALPTLSVEAQAENPTR

SEQ ID NO: 48218 - protein, 390 aa, Vitis vinifera
MDVGLEGEPFLSSRLEPILEVEVEVETEGEGEVDDQFPFNISEPTISNQDIRDPCAPGPSTTHFLPRKTIHRCKTAPALAVMRDAKSQPAQLPKPNSDSTSIIRQAFFLLFLYLSLGVVIYSFNRDNFSGIETHAVVDALYFCIVTMCTIGYGDIAPLTPATKVFACVFVLVGFGFIDILLSGVVNYVLDLQENMILTGIQVGGAPAGGFSARNYIVDVEKGRMRIRLKVGLALGVVVLCIGMGTMVLYFVENLDWIDAVYLSVMSVTSVGYGDRAFKTLPGRLFAAIWLLFSTLAVARAFLYLAEARIDKRHRRITKWVLHREITVEDLLAADINNNGFISKSEYVIYKLKEMGKIAENDVLQICNQFNKLDPNNSGKITLPDLLENHL

SEQ ID NO: 48219 - protein, 220 aa, Physcomitrella patens subsp. patens
MGTQSLIYSFVARGPTVLAEYTAFSGNFSTIAVQCLQKLPPNNNKFTYTCDRHTFNYLVEEGYTYLVVADEEFGRQIPFAFLERVKEDFKRRYAGGKADSAIAHSLDKEFGPKLKDHMQYCVDHPDEMNKISKIKSQVAEVKGIMMDNIEKVLDRGEKIELLVDKTENLRFQADNFQRQGRQLRRKMWFQNMKVKLIVLAIIIVVIIIIWLSICRGFTCK

SEQ ID NO: 48220 - protein, 433 aa, Mesorhizobium loti MAFF303099
MTGGPRRHAAQGGFPMNSFSSRVATAAAAIRQIFPETPLQENDYLSKKTGARVLLKREDLSPVRSYKIRGAFNFFRKALGEGNQAELFVCASAGNHAQGFAFVCRHFGKKGVVFMPVTTPQQKIDKTRLFGGDFVEIRLVGDFFDDCYRAAFEFTERSGAHMVPPFDHKDIIEGQATVAYEIAAQMAGARMPDIVMLPVGGGGLAAGVTHYFADQGREARFVFCEPAGAPSLHDSLAAGKRLKLAKVDNFVDGAAVAEIGREPLRFLKEFAADTVRLIPENRLCATMIEMLNVEGVVLEPAGALAIDALKDFSRKEIRGKTIVAVVSGGNFDFERLPDVKERALRFEGLKKYFIIRFPQRPGALRDFLEMLGPDDDIARFEYLKKSARNFGSVLIGIETKDRRNFDLLKANFEAEGVQYQDITDNETLAGFII

SEQ ID NO: 48221 - protein, 632 aa, Ostreococcus tauri
MEDDEAELMALARERAMRKAAGGDARMLDLLKKRERLERASATMAVADEESDARRAFPMEFGKGGGVSAWTTSEGGEEWEREAAARGDRATPTTTARESEKAASSEEEESEDEYDEEDAIPDTSEAVMGGYNKPATCVGIDRSGTRMACGSSDGVVRLYDFAGMKNDFQPFRTITVREGYPMHAIDWSPTGDMFVAASGNWQPTVHSHDGTELGEFDKGDMYIRDLRNTKGHCAAATDAKWNPIDKSTVCTAGEDGSMRLWDINYLGDPRGSQKAVLKPQQIKPGRVHVTSCAYSHDGDLIAGGINDGSIQIFSSKGTQYKSASIGLVLPPSQQCKLDNHWSFNARPSHLFRKAHPVDEEVTSMSFSRDGRTLVSRCGDGTLNVWDMRNLNQPLKRFGNLPTNHSETNVAWSPNDVYFFTGVDAERDGESAGLCFFSREKLEMVRRVSTPRNCIAATWHPRLNQVFIGCGDAKGGEVRVLYDAKKSMEGVVKAVGKVAKKKVSDFARIDVQEISYTPNALPAFQEPMPGKRKLDATDIARKALRKNPGKAAVSMDKSGILSGGTGSSLLTQHLMKNNEELGEKNWMTMDAREAILRHAEEAAKNPKYTKQAYEKTQPKPMFREEEDEKRDSD

SEQ ID NO: 48222 - protein, 852 aa, Arabidopsis thaliana
MGGRLFFQQEGNHRAYKIPSSAPLRSHSSSSSSSPIDLSRNKFPNFLLRALLKTKKDFSTAILERKKSPNRLVVDEAINDDNSVVSLHPTTMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSAGDAGGAADRVLNQLLTEMDGMNAKKTVFIIGATNRPDIIDSALLRPGRLDQLIYIPLPDEDSRLNIFKACLRKSPVAKDVDVTALAKYTQGFSGADITEICQRACKYAIRENIEKDIENERRRSQNPEAMEEDMVDDEVSEIRAAHFEESMKYARRSVSDADIRKYQAFAQTLQQSRGFGSEFRFDSTAGVGRTTGVAAADPFATSAAAADDDDLYS

SEQ ID NO: 48223 - protein, 215 aa, Nocardioides sp. JS614
MRPATGEVPVRVRAEIDLTMAAGGRTLPGRVHTFTGLPGAEEHLVVAVGPYRRPRGGVPLVRLHSECLTGDVFGSRRCDCGPQLDEALVRIAEHGGYLVYLRQEGRGIGLYAKLDAYRLQDQGLDTFEANRALGYPEDARGYEVAGRMLRALDVLQVDLMTGNPQKAAGLAAGGVAVRRTLPTALHETTENLRYLHAKRRRGFRFAGDHGSLSVS

SEQ ID NO: 48224 - protein, 412 aa, Escherichia coli K12
MPQQNYLDELTPAFTSLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEVGNTLTLEQLKAENRAVLVTVGLSSGSGLPLFEHSDVEIAVDFLQRARQAQGDISIPQSALIIGGGDVAMDVASTLKVLGCQAVTCVAREELDEFPASEKEFTSARELGVSIIDGFTPVAVEGNKVTFKHVRLSGELTMAADKIILAVGQHARLDAFAELEPQRNTIKTQNYQTRDPQVFAAGDIVEGDKTVVYAVKTGKEAAEAIHHYLEGACSC

SEQ ID NO: 48225 - protein, 404 aa, Photorhabdus luminescens subsp. laumondii TTO1
MLAVKKSSKLDNVCYDIRGPVLKEAKRLEEEGNKVLKLNIGNPAPFGFEAPDEILVDVIRNLPTAQGYSDSKGLYSARKAIMQHYQARNMMDVTVEDIYIGNGVSELIVQAMQALLNTGDEMLVPAPDYPLWTAAVSLSSGKAVHYMCDEGSDWFPDLNDIRNKITPRTRGIVIINPNNPTGAVYSKELLLEVVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHLRIVTLPRLDELEMAIQKFARFIGKYHQ

SEQ ID NO: 48226 - protein, 229 aa, Leptospira interrogans serovar Lai str. 56601
MNYQKYLFLDVGDTILHLKKSAGETYLEILLQAGLQKKENAGEIYRRAFTESWQKMQKNSPPEHRDKYQFHSGGTPGWWKELLEDFLKRVPDQVSIEKAFPIIYHKFADPELWTLDPGFWKLKDYCKEENWGLGAISNWDHRLRALLEAKGILEYLNPVIVSAEFGYEKPSPKIFEEAMRLVELSGDCLVYCGDKYELDIKIPKSLGWRSYLKGEKGDLKTLSELIQFL

SEQ ID NO: 48227 - protein, 715 aa, Pseudomonas putida
MIYEGKAITVKALESGIVELKFDLKGESVNKFNRLTLNELRQAVDAIKADASVKGVIVSSGKDVFIVGADITEFVDNFKLPEAELVAGNLEANRIFSAFEDLEVPTVAAINGIALGGGLEMCLAADYRVMSTSAKIGLPEVKLGIYPGFGGTVRLPRLIGSDNAVEWIASGKENRAEDALKVGAVDAVVAPELLQAGALDLIKRAISGELDYKAKRQPKLEKLKLNAIEQMMAFETAKGFVAGQAGPNYPAPVEAIKTIQKAANFGRDKALEVEAAGFAKLAKTSVAESLIGLFLNDQELKRKAKAHDEIAHDVKQAAVLGAGIMGGGIAYQSAVKGTPILMKDIREEAIQLGLNEASKLLGNRVDKGRLTPAKMAEALNAIRPTLSYGDFANVDIVVEAVVENPKVKQAVLAEVEGQVKEDAILASNTSTISINLLAKALKRPENFVGMHFFNPVHMMPLVEVIRGEKSSEVAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDERRSAVDALYEANRLGQKNGKGFYAYETDKRGKPKKVFDAAVLDVLKPIVFEQREVTDEDIINWMMVPLCLETVRCLEDGIVETAAEADMGLVYGIGFPPFRGGALRYIDSIGVAEFVALADQYADLGPLYHPTAKLREMAKNGQRFFN

SEQ ID NO: 48228 - protein, 315 aa, Nocardioides sp. JS614
MTRSVHVLGNVQLDVIATPVTRLPDPGGDDVIDHISVRPAGAAGNVSLALAGLEVAHRLFGAVGDDQAGRWVAAELRRAGLGDDLQVVAGQETGISIALEAPGRERAFLTAHGVLRTYTQADVPAEATAADLVMLTGYFSLPGLRGAGTLEILRRARAHGARTLFDTGWDPDDWRGDAGREVLAILPSVDIFLPNEPEAQALTGEADPEAAADTLQRACGGWVVVKLAERGLVARGPDGARLRLAAPPVVAKDTTGAGDSLAAGMLAELVEHDDMAQALATGVRVASTVIGRDSLARYPSRAELLGVEETVPPLS

SEQ ID NO: 48229 - protein, 340 aa, Sulfitobacter sp. EE-36
MAGGNPMTRYVRQMILPQVGPSGQEALAAARVVVVGAGGLAAPVLPLLAGAGVGHITLVDGDDVALSNLHRQTLFTEADIGTPKVTAAARALRARNSACTVVAHPVTLGPDTVAKLCHDATLVLDCADSFAASYVLSDHCLNAGLPLISASALEFGGYVGGFCGGAPSLRAVFPDLPDRAASCDTAGVMGPVVATIGAAQAQMALACLLGLSPSPLGQLISFDLASYRFGGFRFDTAPEPDHGFGFVAPSQIRASDWVVDLRGPDEAPTAATPTAQRITLPDFLRNAPRPTYQPRAVIACRSGLRAWQAATHLASYWHGPITLLAVGEPSPLKGQTDETS

SEQ ID NO: 48230 - protein, 463 aa, Triticum aestivum
  misc_feature (26)..(26): Xaa can be any naturally occurring amino acid
  misc_feature (62)..(62): Xaa can be any naturally occurring amino acid
RPVRPPPVESTRRRPGPRPPPPPPKXKPPARTHAHFHDLPPTFPAPLRQSTADAAGLAAHLXAMPPHYRRILFSDDCDPWYGCPTPPAPPFFTPSPSPSPSSPPPIISPPPPPSPSFSFYFPSPPDLAPSPSPVHDGGGGWSDQGGGTYGYGAVDDRRRRFVTYVLCAAAALAFLSLILLGASIAVRRRQLRRRRQALLAQPPAAATNVGNDDPEGGGSGGVVHHVWYIRTVGLDEAAIDSIAVTRYRAGSGLLGAADCSVCLGEFNDGELVRLLPKCGHAFHVPCIDTWLRAHVNCPLCRSDVIDPAATTAGAGIESDSNPSADPDVNANAAAEQAAAGSDSTLEHEDDEEDQEAPRVEEEQHEQQQPNSPEPEPLPQLPGPLPRNVRRAASMNAAMVSTAADVAALDRLPDAAPEGEERNGREKHQSGATGHPSTERPAPGGLPRSFFARHCRARSSVLPL

SEQ ID NO: 48231 - protein, 360 aa, Glycine max
  misc_feature (79)..(79): Xaa can be any naturally occurring amino acid
MEPTSLTVPFVQEIAKDALTRVPERYVRPLHERPILLSATTTPLPQVPVIDLSKLLSQDLKEPELEKLHYACKEWGFFXQLINHGVSTSLVEKVKRGAQDFFNLPIEEKKKLGQREGEGVEGYGQAFVVSEEQKLEWADMFFMLTLPPHIRKPYLFPNIPLPFRDDLETYSAGLKKLAIQIVELMANALNVDSKEIRELFGEGVQSMRMNYYPPCPQPELVMGLNPHTDGGSLTILLQLNEVEGLQIKIDGSWIPIKPLPNAFIVNLGDMMEIMTNGIYRSIEHRATVNLEKERLSIATFYNPGMEVKLGPAPSLVTPTTPAVFKTISVPEYYRGYLSRELRGRSYLDSMKIQNEDENSS

SEQ ID NO: 48232 - protein, 442 aa, Arabidopsis thaliana
MSSSSDTHAGESRHRRNPIRWLLGFGFFVQGFRGFPWLGANFFLTEQLRVNPSVLQLLQNSANLPMVAKPIYGVVSDSVYFFGQHRIPYIAVGALLQAISWLAIAFLSRSNVSILALSIYLLLSNLGASLVEVANDAIVAESGKQKTSETQSGELPSFVWMVSSLGGILGNLLGGIAIKTFSAQSTFLVFGILALLQFLVTINIREKSLNLPENPSPAGGIRKHLSDLSHVLRKPEISYSIAWIAVSTAVVPVLTGTMFFYQTKFLKIDASLLGISKVFGQIAMLLWGFAYNRWLKAMRPRKLLTAIQLTIAFFVISDLLFVKGVYRDLGVSDSVYVLFFSGFLETLFYFKILPFTVLMARLCPPGCEGSLMAFVMSAIALAFIVSGYLGIVLASFVGVTEDDFSGFTRGLAIEACCVGIPLILTSWIYDEAETKEKSKKIE

SEQ ID NO: 48233 - protein, 313 aa, Oryza sativa
  misc_feature (183)..(183): Xaa can be any naturally occurring amino acid
MVPHGRVHPAAAASSSDFSGEMNQSAASSDPSSSPPYSFHFEKPLPPTAAAPPPADARRYQQLLPAPQPGTYVVQMPKDKVFRVPPPENARLFQHYTRRARRRARCSCARVCSWLLLALVLLAAALAASAAVVYLVFKPRQPDYTLLSLAVSGLGGILGNASSTAAPAPVSFSPEFDATVRAXDNPNGKIGVHYEGGGSHVAVSYGGVRLADGAWPAFYQGPRNVTVLVATAKGLGIRFSGRLLGDIAAAGRLRSVPFDVDVKVPVRLQVGGVRTWAVPVRVRCAVVVDRLAADAKVVSKSCRVKARFLFWKD

SEQ ID NO: 48234 - protein, 509 aa, Nostoc punctiforme PCC 73102
MTLSFQELGISQERVAQLEKIGFTEPTNIQVQAIPQLLGGRDVVGQSQTGTGKTAAFSLPILERLDINQKAVQAIVLTPTRELAMQVHDAIAQFIGDEGLRVLAIYGGQSIDRQMLQLRRGVHMVVGTPGRVIDLLDRGCLKLDQVKWFVLDEADEMLSMGFIDDVIKILSQAPVDRQTALFSATMPPSIRMLVNKFLRSPATVTVEQPKAAPNKINQVAYLIPRHWTKAKALQPILEMEDPETALIFVRTRRTAAELTSQLQGAGHSVDEYHGDLSQQARERLLVRFRNRQVRWVVATDIAARGLDVDQLSHVINFDLPDSVETYVHRIGRTGRAGKEGTAISLVQPFERRKQQTFERHNRQSWQLLSIPTRAQIEARHILKLQEQVREALTGERLASFLPIVSELIEEYDAQAIAAAALQIAYDQTRPAWLSSDVEIPQEESSAPKPRLGKRRESSSDRPRSAWKSDSNNGEERHSSPKPKLRTSGHESSASPSKKIGSPTARESAS

SEQ ID NO: 48235 - protein, 271 aa, Chlamydomonas reinhardtii
MPTGIFAWQRGRQIGQGAFGTVYQGLVHATGQEIAVKQVQLPRDNANSGKVSEHIRSLESEVAVLRSLRHENIVRYLGTERTSEHLNIFLEYVAGGPISSKLAQFGPLREETVRVYTKQILRGLEYLHKQKVMHRDIKGANILVDSNGVVKLADFGASKKIEDLATIGGGSRSIRGTANWMAPEVIKQSGHGRAADIWSLGCVVIEMATGRAPWANFSDPYAVMYHVAATKELPAMPDSLSHAAKDFITLCFNRVPRERPNATRLLQHPWL

SEQ ID NO: 48236 - protein, 476 aa, Frankia sp. CcI3
MDAIFANLIGGVSTPAVDGETMSILNPSTADLLAQAPRSGPADVDAAVAAASAAFEGWRDTTPAQRSRALLRVADALEDRADEVAAVESANTGKPLRLTVDEEVGPSADQIRFFAGAARLLEGRSAGEYLAGYTSYVRREPIGVCAQVTPWNYPLMMAVWKVAPAIAAGNTVVLKPSDTTPASSLLLAEIAAEFLPPGVLNVVCGDRDTGRALVAHPGPAMVSVTGSVRAGMEIARAAADSLKRVHLELGGKAPVIVFDDVDPAVVARQIAEAAYFNAGQDCTAATRVLAAPGVHDELAAALAEAAGKTATGSPEEPDVDYGPLNNAGQLARVSGFVERAPEHAEVLAGGAPLDRAGYFYPATVVSGLRQDDELIQSEVFGPIITVQRFDSEDTAVAWANGVEYGLASSVWTRDHGRALRVARRLDFGCVWINTHIRLVAEMPHGGFKKSGYGKDLSVYGLEDYTRIKHVMSNIEF

SEQ ID NO: 48237 - protein, 306 aa, Pseudomonas syringae pv. tomato str. DC3000
MNARHFLSMMDYTPDELLGLIRRGVELKDLRNRGVLFEPLKNRVLGMIFEKSSTRTRLSFEAGMIQLGGQAIFLSHRDTQLGRGEPIADSAKVISRMLDAVMIRTYAHDNLTEFAANSRVPVINGLSDDLHPCQLLADMQTFLEHRGSIKGKTVAWIGDGNNMCNSYIEAAIQFDFQLRVACPAGYEPNPEFLALAGERVTVVRDPKAAVAGAHLVSTDVWTSMGQEEETARRKALFAPFQVTRALLDLADKDVLFMHCLPAHRGEEISVDLLDDARSVAWDQAENRLHAQKALLEFLVAPCFQPA

SEQ ID NO: 48238 - protein, 715 aa, Photobacterium sp. SKA34
MNKKKTLLLLVIVSLIALWLHFDLGQYLTLEFIKQEQLALQAKIESQLFTAYLSFFVLYIAVTALSLPGAAILTLLGAALFGFWPSLIIISFASTIGATLAFLSSRYILQDWVQQRFGQRLTTINQGIENEGAFYLLTLRLIPVVPFFLINLLMGLTPIKTRTFFFVSQLGMLAGTAIYVNAGTQLSNINSLSEIISFSVLISLVLLGIFPLLAKALINYIKSQKVYSGWQKPTAFDQNLVVIGAGAGGLVSSYIAAAVKAEVTLIERHKMGGDCLNTGCVPSKALIRVAHSAYELQQAQQFGIEAKIGKIDFKAVMARVHNVIKDIEPHDSVERYSKLGVHCVQGDATILSPWEIEVNGKVITTRNIIIATGASPLLPSISGLNTVNPLTSDNLWQLDTLPEKLLILGGGPIGCELAQAFNRLGASVTLVEMAEQLLNREDKDAADLIYQKLTHEGVRVLLKHKAISFVEKGAAQYHHVKLDDLTTEQTIDVEFDQVIVALGRVANTKGFGLERLKLATNPQGTIKVNHYLQTQYPNIYAVGDVAGPFQLTHAAAHQAWYASVNSLFGTFKKFKADYSVLPAVTYTAPELARVGLNEKEAISQNIDYRTYTYPISDLDRAIADNAAEGFVKVLTPPNSDKILGVTIVGHHGGELLAEFTLAMRYKLGLNKILSTIHPYPTMSEATKYTAGVWKQANAPQKLLAIVKRYHQWMRK

SEQ ID NO: 48239 - protein, 463 aa, Arabidopsis thaliana
MGKVPSSFRSIPANLLVRKTTPSPPAPPRDFRNRTAVGGDSAKLPHNTQAPREPSLRNPFKSPNLSDAKSLFNSIAATSRIPLDLKFHNSVLQSYASIAVVDDTVKFFQHIMKSQPNFRPGRSTFLILLSHACRAPDSSISNVHRVLNLMVNNGLEPDQVTTDIAVRSLCETGRVDEAKDLMKELTEKHSPPDTYTYNFLLKHLCKCKDLHVVYEFVDEMRDDFDVKPDLVSFTILIDNVCNSKNLREAMYLVSKLGNAGFKPDCFLYNTIMKGFCTLSKGSEAVGVYKKMKEEGVEPDQITYNTLIFGLSKAGRVEEARMYLKTMVDAGYEPDTATYTSLMNGMCRKGESLGALSLLEEMEARGCAPNDCTYNTLLHGLCKARLMDKGMELYEMMKSSGVKLESNGYATLVRSLVKSGKVAEAYEVFDYAVDSKSLSDASAYSTLETTLKWLKKAKEQGLVP

SEQ ID NO: 48240 - protein, 396 aa, Escherichia coli K12
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 48241 - protein, 837 aa, Oryza sativa
  misc_feature (36)..(36): Xaa can be any naturally occurring amino acid
MAPAAHRDGAAEAVGQRVFHFGKGRSDGNKTMKDLXWVEGNMGAVLGDPRRPLLLSVRSGAAVSMPGMMDTVLNLGLNDHVVAGLAHRSGERFAYDSYRRFLDMFGNVVMDIPHSLFEEKIEAMKAALGLRNDTELTARDLKELVAQYKNVYVEAKGEEFPSDPKKQLHLSVLAVFNSWDSARAKKYRSINQITGLKGTAVNVQCMVFGNMGDTSGTGVLFTRNPSTGERKLYGEFLVNAQGEDVVAGIRTPQDLDTMKDCMPEPYAELVENCKILESHYKEMMDIEFTVQENRLWMLQCRTGKRTGKGAVKIAVDMVNEGLIDRRSAIKMVEPRHLDQLLHPQFESPSSYGDKVIATGLPASPGAAVGQIVFTADDAEAWHAQGKSVILVRTETSPEDVGGMNAAAGILTARGGMTSHAAVVARGWGKCCVAGCSGIRVNDAEKVVLVADKVLCEGEWLSLNGSTGEVILGKLPLSPPALSGDLGEFMSWVDEVKKLKVKANADTPADALTARNNGAEGIGLCRTEHMFFSSDERIKAMRQMIMAETIEHRQIALDRLLPYQRLDFEGIFRAMDGLPVTIRLLDPPLHEFLPEGNVEDMVRLLSSGNVYTQEEILTRIEKLSEVNPMLGFRGCRLGISYPELTAMQARAIFEAAISMTEQGVKVFPEIMVPLIGTPQELAQQVDVIREVAEKVFANAETTISYKIGSMIEVPRAALIADEIAALAEFFSFGTNDLTQMTFGYSRDDVGKFLPTYLSKGILQNDPFEVFDQKGVGELVKVAVERGRKARPDLEVGICGEHGGEPSSVAFFAKVGLNYVSCSPFRVPIARLAAAQVML

SEQ ID NO: 48242 - protein, 366 aa, Physcomitrella patens subsp. patens
EVSATPGGKGTEDGDREVLGRCDIAHGKWVYDEMYPLYRSRNCPFLDAGFRCEENGRPDTDYMKYRWQPHDCDLPRFNAKDMLERLRNQRLVFVGDSLGRNQWESMLCMLAEGVQNKSRIYEIDGQPITKHTGELKFRFQDYNCTVEYYRDPFLVPQTRPPRNAPENVTNVLQIDRVSWSASRWPGASILVFNSGHWWSWEKIGRQGGAFQVEKNVTSHGFEEAFRIALTTWASWMEKNIDPMKTQVFFRSFASIHFRGGTWRSGGHCHEEVKPLTDEEVLTMQKIPWTNKYIEDAIHQNIKMKRSAVEYMDVTTLTNYRSDGHSGLYANNVKLMGPTPKNRQDCSHFCLPGVPDTWNELLFATLL

SEQ ID NO: 48243 - protein, 372 aa, Zea mays
  misc_feature (360)..(360): Xaa can be any naturally occurring amino acid
MVLPLGLRHPSLLHQWAAGISADKKETKFDCRPSHYSILVMLDTLGPEIQVHNSTGEPIELKAGNHVIITPDICKALSAEILPIKFGDLAKAVKKGDTLFMGQYLFTGSETTSVWLEVVETSGENVNCLVKNAATLDGPIFTLHASQVHINLPTLSEYDKHVISTWGSCNSVDIISLSHTRSAEDVRELRAFLQAHALPDTQIYAKIENSEGLDHFDDILNAADGIIISRGDLGIDLPPENVFMFQKTAIHKCNLEGKPVIITRVVDSMIDNLRPTRAEATDVANAVLDGTDGILLGAETLRGLYPVDAAETVYNQPLQFKKVMWHVGDPMPHEESVASAAVGSAIKVKAAAIVVFTFSXRAAKVVAKYRPT

SEQ ID NO: 48244 - protein, 364 aa, Solanum lycopersicum
MAIENNDQSFFLDVLYCEEEEEKWGDLLEDEEGVIINPLLLSSEGTTKTNSLLLLPLLLLEQDLFWEDEELLSLFVKEKETRCCFESFGSDPFLCSARVDVVEWILKVNAHYDFSALTAILAINYLDRFLSSLQFQKDKPWMTQLAAVTCLSLAAKVEETQVPLLLDFQVEDAKYVFEAKTIQRMELLVLSSLKWRMNPVTPLSFLDHIIRRLGLKNNVHWEFLRRCESLLLSVMIDCRFVRYMPSVLATAIMLHVIHQIEPCNAIDYQNQLLGVLKISKENVNNCYELISEVSSKPITSHKRKYDENPSSPSGVIDPIYTSESSNDSWDLDLPSFKKSKVQEQQMKMSSSLSRVFVEAVGSPH

SEQ ID NO: 48245 - protein, 271 aa, Mesorhizobium loti MAFF303099
MQPVDPIWRSIRDEAMDAVNRDPLLAAFLYSTILNQESLEEAVIHRIAERLAHQDIGSDLIRQTFKTMLADDKEWPTTVRVDIQAYYDRDPACDRFIMPVLYFKGFHAIQTHRLAHWLWNQGRKDFALYLQSRSSSVFQTDINPAARIGKGIFIDHATGLVVGETAVIEDDVSILHGVTLGGTGKAGGDRHPKIRRGVLIGAGAKILGNIEIGHCSKVAAGSVVLSPVPHNKTVAGVPARVVGETGCDQPSRQMDQLLPSQSMDQVVSFDI

SEQ ID NO: 48246 - protein, 561 aa, Ustilago maydis 521
MNSKAAQDRQQRILLDLVRQPGNDVCADCKGRAPRWASWNLGIFICVQCAGVHRKMGVHISKVKSITLDTWTREQVDRMKEVGNLKSNRKYNPDEMRNRPPTNMEESERDSELEKYIRRKYEFRRFVEGRPPPVPSKDATFLTSPSGSVEYSHAPRSPVEPISSSQSSSSLAQGSSIARSRTAPIPSTWSEAQQRVKANAPPLPNPTAAGYRAASGSQINGTSALSTRSTALTQSSLQLPGASVPLRTTSALNTRDGGQIASASKPTTPTVQSSVFDDLISLNESSQPTATQPPLQMNPWASLQAQQQAVLSAPAIQEPTGLFWAGQPSPNGVASPMAPFGISPSNNNMTFDPVRNTPQHANTMPSLSVSSAQNPLSSQATGMLSASNGGMYSQFEQQRSVGLGSMAFSTSPLPSPGFAPSNPFNATQSNSAAPLPQTAGFVGVNSLFQHQPQQLGQVAFQGQANILAPNQAFYGQQQYSIQIQPASNGVGHFQSSMMPNGFGQAQFGTSHLMQQQQRQQQQQQQQQQQQQQQQQQQQQQQQQQQQQQQQQQNTQQFGQRP

SEQ ID NO: 48247 - protein, 630 aa, Magnetospirillum magnetotacticum MS-1
MLHINDLTFRYGGRTIFEAATVHIPAGQRVGLVGRNGTGKTTLFKLILGELHADGGEINMRPRARLGRLAQEAPEGEISLIDCVLAADTERTALFEEAENCHDGHRIAEIHERLTAIDAHSAPSRAASILSGLGFDSEAQQQPVSDFSGGWRMRVALAAALFANPDLLLLDEPTNHLDLEATLWLQSHLAVYPGTLVVISHDRELLNEVATRIIHLENGKLNGYGGNYDRFEATRRARMELQSKAFVKQQEQRKKIQSFIDRFKAKATKAAQAQSRVKMLERMEVVVPVVEDRGMSFDFPDPEELSPPIIAIDNGVAGYGEKVVLRKLDIRITMEDRIALLGANGNGKSTLAKILSGRMDLLGGQLRKPSKLKIGYFAQHQTEELRLDETPFDHMALLMKGLPEAKVRAQLGRFGFEQDRANVKVSSLSGGEKSRLLFALMSREAPHLMILDEPTNHLDIDAREALVSALNAYDGAVILISHDPHLIELAADSLWLVGDGAVRPFDGDLAAYRRLLLDQARDAKRSARKDAGADKSGDGAQRKADRKAAAGARAQLAPLRKAVQAAEKALEDLVKEQKALAAKLADPKLYQGPPAKVTELRRQEGDLARKVEAAELAWLCAQEELEAAQA

SEQ ID NO: 48248 - protein, 312 aa, Arabidopsis thaliana
MPPAGELRHQSPSKEKLSSVTQFDEAEAAAAAISAAAADAEAAGLWTQIKAEARRDAEAEPALASYLYSTILSHSSLERSISFHLGNKLCSSTLLSTLLYDLFLNTFSSDPSLRNATVADLRAARVRDPACISFSHCLLNYKGFLAIQAHRVSHKLWTQSRKPLALALHSRISDVFAVDIHPAAKIGKGILLDHATGVVVGETAVIGNNVSILHHVTLGGTGKACGDRHPKIGDGCLIGAGATILGNVKIGAGAKVGAGSVVLIDVPCRGTAVGNPARLVGGKEKPTIHDEECPGESMDHTSFISEWSDYII

SEQ ID NO: 48249 - protein, 175 aa, Mesorhizobium loti MAFF303099
MPLYAIDGAEPSFADAGSNWIAPDATLIGDIRVGRNAGFWFGVVIRGDNEPIIVGADTNVQEHTVMHTDPGFPLTIGEGCTIGHRAMLHGCTIGDNSLIGMGAIVLNGARIGKNSLVGAGALVTEGKEFPDNSLIVGSPAKAIRVLDDAAVERLRGSAAHYVANGKRFKAGLKKV

SEQ ID NO: 48250 - protein, 140 aa, Magnetospirillum magnetotacticum MS-1
MAIERTLSIIKPDATRRNLTGKINARFEEAGLRFVAQKRVQLTKAQAQQFYSVHAERSFFGELVDFMISGPVVVQVLEGEGAVARNREIMGATNPANAAPGTIRADFAESVEANSVHGSDSAENAAIEIAYFFAGSEIVG

SEQ ID NO: 48251 - protein, 713 aa, Photorhabdus luminescens subsp. laumondii TTO1
MSRTIMLIPTSTSVGLTSVSLGVIRSMEQKGVSLSVFKPIAQPRCRAAQDQTTTIIRANSSIKTAEPLDMAHVESLLTTNQKDVLMEKIVALYHENTKDAEVILIEGLVPTRKHSFAQSLNYEIAKTLNAEIVFVLALGNDSPEQLKERVELARAEFGGNKNQNITGVIINKLNAPVDDQGRTRPDLSEIFDESSKAIVSNIDPNTLFKNSPLPILGCIPWSFDLIATRAIDMAKHLNARIINEGAIKTRRVKSVTFCARSIPHMLEHFRPGSLLVTSADRPDVLVSACLAAMNGVEIGAILLTGGYAIDEPIKQLCERAFNTGLPVFMVDTNTWQTSLNLQSFSLEVPADDHERIEKLQNYVAHHINKEWIDSLTANSERPHRLSPPAFRYQLTELARKAGKRVVLPEGDEPRTVKAASICADRGIARCVLLGDPEEIRRVAAAQGVELGAGIEIVDPIAVRERYVPRLVELRKNKGMTEVVAREQLEDNVVLGTLMLEQGEVDGLVSGAVHTTANTIRPPLQLIKTAPGSSLVSSVFFMLLPEQVLVYGDCAINPDPTAEQLSEIAIQSADSAKAFGIEPRVAMISYSTGNSGAGSDVEKVREATRLAQEKRPDLIIDGPLQYDAAIMADVAKSKAPNSPVAGQATVFIFPDLNTGNTTYKAVQRSADLVSIGPMLQGMRKPVNDLSRGALVDDIVYTVALTAIQSAQGEA

SEQ ID NO: 48252 - protein, 69 aa, Oryza sativa
  misc_feature (36)..(36): Xaa can be any naturally occurring amino acid
NNLIKDKVESTAVAPFRSESPGCRNSARGGEHGGEXLSVAFFAKAGLDYVSCSPFRVPIARLAAAQVLL

SEQ ID NO: 48253 - protein, 489 aa, Escherichia coli K12
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 48254 - protein, 745 aa, Cryptococcus neoformans var. neoformans JEC21
MSTSSHLAHATHLPRPADSLPRSPYPHDAQHSPLPPPSFLHAFPLPPRASISSVAAPPASAPLHSAPPYSSAQTLRASLPLPHPYYPLPLPHTPSGHRVLRSPNPPCLWPLPHPLPAIDSLRRPSRHPPHPASHSGSPSLDHPRAYYDPTVSVPLAYRESYPSHPSTHPSSPYLPPPTPSAYGYRAPSPFRIPPPLTFRYSRSPPPLDTMPPRKKAEPSTADTAAASNASATTGAPASASTRARRGANGKGWTTEHTYEPNGQRKEVIVIDDSASPMVQPVRKRTRAQVAAEQAAQQQQLHQAYASTNAGYSDTVSISNGHGSVASTAGTAAGGTTKKRKLEEDQGKKAKAKVASTATSASIQTTGTWQSTQQAAPAKATQYQKAPAQPAQQQGPPPWDDPEGHYIVKPDDVIGGRYKIVRLLGQGTFGKVVEARHIETRRKVAIKVIRAVQKYREASKIEIRVLETLRKHDPRNDNKCIHLDEYFDFRNHPCLVSELYGMSVFDFLKQNGFQPFPDKHIQDFAKSLLRSVSYLHSLKLVHTDLKPENILLCSNEARLAGPRVRNARSKSILKNTEIRLIDFGSATFESEYHSSVVSTRHYRAPEIILGLSWSYPCDMFSIGCILVEFYTGNALFQTHDNLEHLAMMEVVMGKFSQRMIEKGKSKKPEYFKGNKIDFPNSTVSKASRKYVKSMQSLKQVIDPANRHQQLFLDLCTRLLEHDPDVRIKVQDALRHPYLTEPIPEPA

SEQ ID NO: 48255 - protein, 356 aa, Vitis vinifera
  misc_feature (257)..(257): Xaa can be any naturally occurring amino acid
MALESESQKKSYGVFGDVYGVMMVPKELEIEKDASIDQFRFQFPDLKQAFQDFMRTREVGEFISGALAGAMTKAVLAPLETIRTRMVVGIGSKNISGSFLEVIEQQGWQGLWAGNTINMLRIIPTQAIELATFECVKRSMTEAQEKWSKKECPKLQIGPVSLNLSISWISPIAVAGAAAGIVSTLACHPLEVLKDRLTVSPDIYPSISVALSKIHNDGGIGAFYAGISPTLIGMLPYSTCYYFMYETMKKSYCTAKXKTSLSRPEMLLIGALSGFTASTISFPLEVARKRLMVGALQGKCPPHMAAALSEVIREQGIMGLYRGWGASCLKVMPSSGITWMFYEAWKDILLAERRHL

SEQ ID NO: 48256 - protein, 214 aa, Physcomitrella patens subsp. patens
MAELVLEGSQPVDLAKHPSGIVPTLQNIVSTVNMDCRLELKTIALHARNAEYNPKRFAAVIMRIREPKTTALIFASGKMVCTGAKSEQQSKLAARKYARIIQKLGFPAQFKDFKIQNIVGSCDVKFPIRLEGLAYAHGHFSSYEPELFPGLIYRMKQPKIVLLIFVSGKIVLTGAKVRDEIYEAFENIYPVLTEFRKIQQWYVTCMVEIARVAR

SEQ ID NO: 48257 - protein, 120 aa, Lactobacillus johnsonii NCC 533
MALDTEKIIEDLKGASILELNDLVKAIEDEFGVSAAAPVAAAGAAGAGAEKTEFDVELTDVGQEKVKVIKVVRDITGLGLKDSKDLVDGAPKNVKEGVSEDEANDIKAKLEEVGATVTVK

SEQ ID NO: 48258 - protein, 183 aa, Coffea canephora
GAYGIVCSVLNSETNEMVAVKKIANAFDNYMDAKRTLREIKLLRHLDHENVIAIRDVIPPPLRREFSDVYIATELMDTDLHQIIRSNQSLSEEHSQYFLYQIPRGLKYIHSAKVIHRDLKPSNLLVNANCDLKIIDFGLARPNTKNEVMTEYVVTRWYRAPELLLNSSDYTAAIDVWSVGWIF

SEQ ID NO: 48259 - protein, 332 aa, Sulfitobacter sp. EE-36
MTTYALNGLGRIGKLALRPLLEQGAKIAFINDAVGDPEMHAHLLEFDSVHGRWPATFSAEDNAITIDGTRIPVTSTKSITDLPLEGVDVVIDCTGAFKTEAKLAPYFEAGVKKVVVSAPVKDGPTANIVYGVNDDTYDPATHSIVTAASCTTNCLAPVVKVLLEGIGIKHGSITTIHDVTNTQTIVDRPAKDMRRARSALTNLIPTTTGSATAITLIYPELTGKLNGHAVRVPLLNASITDCVFEVERETSVEEVNALFKTAAEGPLKGILGFEERPLVSSDYTNDTRSGIVDAPSTMVVNGTQVKIYAWYDNEMGYAYRLVDVALMVGGKL

SEQ ID NO: 48260 - protein, 417 aa, Chromobacterium violaceum ATCC 12472
MHLLAFGLNHHTAPLSIREKLAFPAETLPRALESLLASQAAREAAIVSTCNRTEIYCSSPDPHAALDWLCQFHGLSRAELEPYLYRLEASQAARHAFRVASGLDSMVLGETQILGQLKDAVRSAEHAGALGTLLNGLFQRTFAVAKEVRSSTAVGASSVSMSAAAVKLAEQIFPSVAELNVLFVGAGEMIELVATHFAARNPSCITVANRTLERGQRLAEQFGGNAITLAELPESLARYDVVVTSTASQLPIIGKGMVERAIKARRHRPMFMLDLAVPRDVELEVGKLDDVFLYSVDDIAGIVEVGKEARQNAAEEAETIIQARVAEFTDWLKKRETVPLIRALRDEADRARRHALEGALKQLARGDAPEKVLEALSVQLTNKLMHPPTQALSSGSGAEHDAQVQAIARLYRLHPES

SEQ ID NO: 48261 - protein, 602 aa, Lactobacillus johnsonii NCC 533
MAYQALYRKWRPRTFDGVVGQTAITDTLKNAIKRGKISHAFLFAGPRGTGKTSCAKIFAKALNCTNLQDGEPCNECENCLAADQGTMNDIIEIDAASNNGVDEIRDIRDKVKYAPTQGKYKVYIIDEVHMLSMGAFNALLKTLEEPPEHVVFILATTELQKVPATIISRTQRYNFKRIDQHDLIARMTYILGQEKIDFEEKALEVIAQVADGGMRDSLSILDQILSYDQDKVKYEDALRITGYAAQEKIEQVLLNLLNGKTSAALEIVHALLQDGASTKNILDELISLTVKGMLAIKSNKEETFLTENYASELAKIPEEKFYSLVQAANKALNDLRYTNQQQIPLDVFVVQVTQAPVKADSTPQQAEAISSDVVQTLKNQIDTLSKQVAELKNRPVPARSTTSDFSGTIKTETKSQIRQRNEQENKPEQKPKRRKASSNNQAAQENNRRQVYHVLENATKEDLNTVKDIWPDLLSTLKVSQRAVMEVLDPVAASHEQIVLKCKYELWFERANQDGDLISQLEAEIAKLTKHNYSIVLVADSSWLKVRHDFVASHKEELLAKKFQRLEKSEQEANGNQIDPQAKKEVIDKAKELFGDLAQVKD

SEQ ID NO: 48262 - protein, 348 aa, Zea mays
MNIFDKTPFVHKDACRPPRGRLIVTAGETSPSNGAKRQCSLTTEQTPASVTLLPLGSLRLPSSPSLRSLGYERIRIASPPPRPGEMAGLGKAMYAVGFWIRETGQALDRLGCRLQGKYFFHEQISRHRTIMNIFDKSPHVHRDAFVAPSASLIGDVQVGQGASIWYGCVLRGDANNIQIGSGTNIQDNSLVHVAKSNLSGKVFPTIIGNNVTIGHSAVLQGCTVEDEAFVGMGATLLDGVVVEKHGMVAAGSLVRQNTRIPCGEVWGGNPAKFLRKLTDDEIAFITESASNYSNLSKVHAAENAKPLEKIEFEKVLRKKFAHQDEEYDSSIGITRGAPPELTSPNPAQ

SEQ ID NO: 48263 - protein, 512 aa, Pseudomonas syringae pv. tomato str. DC3000
MPHTTVPTPPLSEVYDIAVIGGGINGVGIAADASGRGLSVFLCEKDDLASHTSSASSKLIHGGLRYLEHYEFRLVREALAEREVLLAKAPHIVKPMRFVLPHRPHLRPAWMIRAGMFLYDNLGKREKLPASRTIRFGADSPLNSSITRGFEYSDCWVDDARLVVLNAMAARENGAHIHTQTRCVSARRIKGMWHLHLERSDGSLFSIHAKALVNAAGPWVAKFIREDLKLDSAYGIRLIQGSHLIVPKLYEGEHAFILQNEDKRIVFTIPYLEHFTIVGTTDREYQGDPNKVDITEGEMDYVLKVANDHFKKQLNRTDVLHTFSGVRPLCNDESDNPSAITRDYTLSLSGSGDEAPILSVFGGKLTTYRKLAESAMAQLAPFFKQMKPSWTAKAALPGGEDMTSPQALAAEMTRRYSWLPAPIAKRWSITYGSRSWRLLEGAHSLEDLGQHLGAGLYTREVDYLCDQEWATDIKDILWRRTKLGLFTTPEEQAAVSSYMDTVARNKATIEAA

SEQ ID NO: 48264 - protein, 143 aa, Mesorhizobium loti MAFF303099
MTVKAILEKKGHDVLTLGPNEKLSEAIRILAEHKIGALVITNGDHKIVGILSERDIVRVVAKEGAAALDIAVRSAMTPKVKICNENHTVNEVMEIMTRGRFRHLPVEKDGLLDGIVSIGDVVKRRIEDVEREADEIRAYIATA

SEQ ID NO: 48265 - protein, 454 aa, Physcomitrella patens subsp. patens
MGCVRGFQVNTGEATRVDPRTVLSIILGGGAGTRLYPLTKRRAKPAVPIGGAYRLIDVPMSNCINSGINKVFILTQFNSTSLNRHLARTYNFGKINFGDGFVEVLAATQTPGDKGAEWFQGTADAVRQYLWLLEDAKNKVVEDVVILSGDHLYRMDYMDFVQKHRDSGADITISCVPMDDSRASDYGLMKIDDEGRVLYFSEKPKGNDLKNMQVDTTVLGLSPEEAVEKPYIASMGIYVFKKDVLMKLLRWRYPTANDFGSEIIPASAKEFNVQAYLFNDYWEDIGTIKSFFDANLALTAQPPQFSFYDAAKPIFTSPRYLPPTSIEQCMIKDSIVSHGCFLKNCSVEHSIVGVRSRLEFGSVLKDTMMMGADYYETEDEVAAMLKNGKIPLGVGENSRISNCIIDKNARVGKNVIIANTDNVQESARPELGFYIKTGVTVIEKNGIIRDGTVI

SEQ ID NO: 48266 - protein, 677 aa, Arabidopsis thaliana
MIPLSFAALGDIVDKKLDEDYVKEEVEMMIQVSLLSTQAAPGERPTMSEVEIFRNSCLCYINWFCNIISIIYSNSLLLRIDSGSSSISVVFLVFTLSRMEQRRMLTAARPRLSSTIRTITSHVAFSASRLLKPYVAYRLGLEDANQRKTENESTGGDKEIANSLLHCLKFHYLLLHFPSFSLQIHNRSTSLSLSRFEKMAKLVMLLVLCILPAIAMAARRGNIGKNTMVVQGSTYCDICKFGFETPESSYFIPGATVKLSCKDRKTMEEVYTDKAVSDKEGKYKFIVHDDHRDQMCDVLLVKSSDKTCSKISVGREKSRVILNHYSGIASQIRHANNMGFEKEVRMATSTTMSHQAIGSVVSQRPFKASQFLKEPLNNVPMKFRQKRFKIEATASQISVVDNTFLSPSPSKNKPHESKKKSNEAALILIRHGESLWNEKNLFTGCVDVPLTQKGVGEAIEAGKKISNIPVDLIFTSSLIRAQMTAMLAMTQHRRKKVPIILHNESVKAKTWSHVFSEETRKQSIPVIAAWQLNERMYGELQGLNKKETAERYGTQQVHEWRRSYEIPPPKGESLEMCAERAVAYFEDNIKPELASGNNVMIAAHGNSLRSIIMYLDDLTSQEVTTLDLSTGVPLLYIFKEGKFMKRGSPVGSTEAGVYAYTKRLAQYREKLDAAATI

SEQ ID NO: 48267 - protein, 178 aa, Clostridium pasteurianum
MERLVGKPAPEFEMKAVKGDGRGFTEVKLGDYKGKWLVMFFYPLDFTFVCPTEITGFSKRAEEFRDLKAELLAVSCDSQYSHETWINQDIKQGGLGKINFPIASDKTTEVSTKYGIQIEEEGISLRGLFIIDPEGIVRYSVVHDLNVGRSVDETLRVLKAFQTGGMCALDWHEGDDNL

SEQ ID NO: 48268 - protein, 392 aa, Heterocapsa triquetra
MAKALLIPATFGCAAAFVAPGQSLRGVPAAGVQEASQAPTAAPAQSSSVLSTTATLAGAAIAVGGVVRRRGGRAAAKATAMRATGIAINGFGRIGRQVARIAMKDPEVELKLINASYDAEYLAYQMKYDSIHGRYNGTIEVDGDSLVIDGQKVALSHTRDPAEIPFKKHGAEYVCESTGVFLTTEKVQPHLKAGAKKVVFSAPAKDDSHTVVMGVNQETYKSSMECVSCASCTTNGLAPLVKCINDAFGIRRGLMTTIHAMTASQPTVDGASKKDWRGGRAASGNIIPSSTGAAKAVAKVIPEVAGKLTGMAFRVPTIDVSVVDLTCELEKATTYEEICAEVKKRAEGDMKGFLGYCDEDLVSTDFETCTISSTFDSKAGIMLDPTFVKLVA

SEQ ID NO: 48269 - protein, 480 aa, Silicibacter sp. TM1040
MAKQPMLKFVKIDRDMPEKRDAETRREDFDEIYAEFAAVKAEEQASRCSQCGVPYCQSHCPLHNNIPDWLRLTATGRLEEAYATSQATNTFPEICGRICPQDRLCEGNCVIEQSGHGTVTIGAVEKYITDTAWDKGWVKPNAPIEERAESVGIIGAGPGGLAAADMLRKAGVQVTVYDRYDRAGGLLTYGIPGFKLEKEVVMRRNQLLADGGVTFVMNCNIGEDISFDEIRAKHDAVIIATGVYKSRDLNMPGSGAKGIVKAIDFLTASNRVANFGDTVPEYEDGTFNATGKKVVVIGGGDTAMDCVRTSVRQGAESVKCLYRRDRANMPGSQRETQNAEEEGVVFEWLSAPKGFTDADGKVSGVMVQKMRLGQPDASGRQAPEVIEGADYVEEADLVIKALGFEPEDLPTLWGQPNLPVTRWGTIKAEFKTGATNLDGVYAVGDIVRGASLVVWAIKDGRDCAEAIIERFNNKAAVAAE

SEQ ID NO: 48270 - protein, 484 aa, Photorhabdus luminescens subsp. laumondii TTO1
MIKNNKTQQNLSAEKFADTQTLHRGLSARHIQLISIGGAIGTGLFMGSGKTIAVSGTSIIITYAIVGFFVYMVMRAMGELLLTKLNYRSFADFVSDYLGTKASFFLGWTYWMSWIVSCIADVVVCGGYIQYWFPGVSLWVPAFITLGLLGTCNLLSVRLFGEAEFWFAMIKVIAILALIIIGVGMVMVGWQSPDGTIASVNNLTDPSVFLPNGIFGFFAGFQIAIFSFTGVELVGTMTAETKDPEKILPKAINYIPMRIMIFYIFSMLSIIAVTSWGRISAETSPFVTLFALAGLPAAAAVVNFVALTSAMSSANSGLYACTRMLYGLSTEKNAHRKFKILSRNTAIPVHSLIFSCFCMVVGTSLLFIVPNVMQLFTIVSTVASVMVIYSWCVILIAYLVYRKNYPDVHKRSIFKMPLGVLMTWLTLIFFIFTIVVMVFDPDTLIALCGTPLWFIMLSILWRVKKKNEAQKEQRYQIAKESFRS

SEQ ID NO: 48271 - protein, 643 aa, Brucella melitensis 16M
MSRPSTPLLDKAPTPDRLRALPEQDLPQLAEELRTELIDAVSTTGGHLGAGLGVVELTVALHHVFNTPYDRIIWDVGHQAYPHKILTGRRDRIRTLRQAGGLSGFTKRAESEYDPFGAAHSSTSISAGLGMAVASELSGEKRNVIAVIGDGSMSAGMAYEAMNNAGALDARLIVILNDNDMSIAPPTGAMSAYLARLVSGRTYRSVREAAKQVAQKLPKFLQDKARKSEEYARAFFTGGTLFEELGFYYVGPIDGHNLDHLLPVLKNVRDTQKGPVLIHVVTQKGKGYAPAEAAADKYHGVNKFDVITGKQAKPPANAPSYTKIFGTSLIEEARHDDKIVAVTAAMPTGTGLDLFGEAFPKRVFDVGIAEQHAVTFAAGLASEGYKPFCAIYSTFLQRGYDQVVHDVSIQNLPVRFPIDRAGLVGADGPTHAGSFDTGFLAALPGFVVMAASDEAELRHMVRTAAEYDEGPISFRYPRGDGVGVDLPERGSVLEIGKGRIVREGTKVALLSFGTRLQECLAAAEELGAAGLSTTVADARFAKPLDHDLIRRLAREHEVLVMVEEGAVGGFGSHVLQFLATDGLLDRGFKVRALTLPDIYQDHGKPDAMYAEAGLDRTGIVRTVFAALHRDELGHEALPTPFRA

SEQ ID NO: 48272 - protein, 371 aa, Debaryomyces hansenii CBS767
MSRRERYSVEPIPNDANEFQDNVSFIHKFITNWLITDPSLRNPGLEKNVKAKNYQVQKHENVQFIYLCGGRLRSVKQKPINVVTGILILIPGILFWIFEAKWIWFHVNPSIVILFSYFWLITVSFFIKASMSDPGMLPRNIHVPYSISNANTSPKASPPDEYFNIISLPYNAEDHTGVGLKYCATCHIWRSPRASHCSVCNSCIISHDHHCVFLNNCIGYRNYKYFLWFLLFAVLGCILMSVISFIHVFYYRLGMETSVSTFRSSISKYPVSFLLCIYSLLALVYPFPLLIFHIFLTSYNLTTREYFNNVRGVKNLQNHFTNHFDTHSIFKNLYINWLGRARGFSLVRQTDSYQIGDLRFEKLDPLQSFSL

SEQ ID NO: 48273 - protein, 183 aa, Coffea canephora
LVIGAYGIVCSALNSETTEHVALKKIANAFDNRIDAKRTLREIKLLRHMDHENVVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 48274 - protein, 426 aa, Thermosynechococcus elongatus BP-1 [sequence omitted]

SEQ ID NO: 48275 - protein, 161 aa, Coffea canephora
RRLRMLLITGSMRRGLCERSSFFAIWIMKTSVVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 48276 - protein, 371 aa, Brucella melitensis 16M
MSYNQKQVVDAICAFERGEIVVVMDDDGRENEGDLIVAAVHCTPEKMAFIVRHTSGIVCTPMTREEAKRLNLTPMVAENESAHTTAFTVTVDYRHGTTTGISAEDRTLTVRNLANPNAGASDFVRPGHIFPLVAREGGVLMRSGHTEAAVDLCKLANLPPIGVICELVNDDGTVMRGPDVAAFAEEHKLHRVTVADLIAYRQRKETLVRRIGDAPVETCAGKAHAYSYELPWEPMQHVAVVFGDIRDGEEVPVRLHREDVLNDVFGKGGSNLDAIMQRMGQEGRGILVYLREGSVGVRSDHRDARAREALQGEHEAHAEAVAREEEWRQIGLGAQILKDLGVSSIVLLASRERHYVGLEGFGICITRTEII

SEQ ID NO: 48277 - protein, 183 aa, Coffea canephora
LVIGAYGIVCSVLNSETNEMVAVKKIANAFDNYMDAKRTLREIKLLRHLDHENVIAIRDVIPPPLRREFSDVYIATELMDTDLHQIIRSNQSLSEEHSQYFLYQILRGLKYIHSAKVIHRDLKPSNLLVNANCDLKIIDFGLARPNTENEVMTEYVVTRWYRAPELLLNSSDYTAAIDVWSVG

SEQ ID NO: 48278 - protein, 459 aa, Thermosynechococcus elongatus BP-1
MRVCVIGTGYVGLVTGVCLAHIGHEVICIDNNIDKVKLLQQGESPIYEPGLTELLRGCIASGHIRFSSDLGTGVEFGEVLFIAVGTPALPNGETDTRYVEAVARGIGAHLHLGYKVIVNKSTVPIGSGDWVRMIILDGVVEREPDLADALKGGGTHPPLDFDVVSNPEFLREGSAVYDTFNPDRIVLGSSSRRAIQIMQELYGPIIERKYAADPTLPPVPVLVTDLSSAEMIKYAANAFLATKISFINEIANICDRVGADVVQVAKGMGLDSRIGEKFLQAGLGWGGSCFPKDVSALIHTAADYGYDAQLLKAAVQVNQRQRFIVIEKLQQVLKILKGKTIGLLGLTFKPNTDDLRDAPALNLIEELHRLGAKVKAYDPLVSQSGLRSGLSHVIVETDLLHLADGCDALVLVTDWPQFQEVDYGELAKVMHQPVIIDGRNFLDRKGLESLGFRYVGMGH

SEQ ID NO: 48279 - protein, 174 aa, Acidovorax sp. JS42
MAIYELDGVAPQVAASAWVADSGQVMGDVVLGEDASVWFGTVVRGDTARITIGAGTNVQDASVLHADIGQPLVIGERVTVGHQVMLHGCTVGDESLIGIGAIVLNGAKIGRNCLVGAGSLVTEGKEFPDGSMILGSPAKVVRQLTPEQIEGLRQSARHYMENARRFKAGLRKLG

SEQ ID NO: 48280 - protein, 148 aa, Brassica napus
MASTALSSAIVGTSFLRRQTTPISLRSLPSANTQSLFGLKSGTARGGRVTAMATYKVKFITPEGEQEVECDDDVYVLDAAEEAGIDLPYSCRAGSCSSCAGKVVSGSVDQSDQSFLDDDQIAEGFVLTCAAYPTSDVTIETHREDDIV

SEQ ID NO: 48281 - protein, 211 aa, Oryza sativa Indica Group
SKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 48282 - protein, 586 aa, Triticum aestivum
MGGDERHLGRTMSFGIPDVALGLVMGCVEDPWDRDAISLVCRHWCKVDALSRKHVTVAMAYSTTPDRLFRRFPCLESLKLKAKPRASMFNLIPEDWGGSASPWIRELSASFHFLKVLHLRRMIVSDDDVAVLVRAKAHMLVSLKLDRCSGFSTSSLALLARCCKKLETLFLEESSVAEKENDEWLRELATSNTVLETLNFFLTDLRASPAYLLLLVRNCRRLRTLKISDCFMSDLVDLFRTAETLQDFAGGSFDDQDQGGNYANYYFPPSVQRLSLLYMGTNEMQILFPYGATLKKLDLQFTFLTTEDHCQLVQRCPNLEVLEVRDVIGDRGLEVVAQTCKKLQRLRVERGDDDQGGLEDEQGRVTQVGLMAVTQGCPDLEYWAVHVSDITNAALEAIGTFSKNLNDFRLVLLDREVHITELPLDNGVRALMRGCTKLRRFAFYVRPGALSDIGLSYVGEFSKTVRYMLLGNAGGSDDGLLAFARGCPSLQKLELRSCCFSERALAVAALQLKSLRYLWVQGYKASPTGTDLMAMVRPFWNIEFIAPNQDEPCPEGQAQILAYYSLAGARTDCPQSVIPLYPSVGG

SEQ ID NO: 48283 - protein, 428 aa, Acidovorax sp. JS42
MSAIVDIVGREVLDSRGNPTVECDVLLESGVMGRAAVPSGASTGSREAIELRDGDKSRYLGKGVLKAVEHINTEISEAVLGLDASEQGFLDKTLIDLDGTDNKSRLGANAMLAVSMAVARAAAEESGLPLYRYLGGMGSVQLPVPMMNVINGGAHANNSLDLQEFMIIPVGAPSFREAVRWGAEVFHALKKIIHDKGMSTAVGDEGGFAPSVENHEAAIQLILQAIEAAGYTAGEQIALGLDCAASEFYKDGMYVLEGEGGLQLTAQQWTDMLASWCDKYPIISIEDGMHEGDWDGWKILTERLGHNVQLVGDDLFVTNTKILKEGIDKGIANSILIKINQIGTLTETFAAIEMAKRAGYTAVISHRSGETEDSTIADIAVGTNAGQIKTGSLSRSDRIAKYNQLLRIEEDLGDIAFYPGRAAFYNLR

SEQ ID NO: 48284 - protein, 444 aa, Vigna radiata
MGSHQHEPWLLENGNPKVLTREMRHGRTAHSKSSNSLRTKSDRTLVSKVPCATIRNVLFNLQEVILGTKLSILIPAIPVAIVAEYCGFGRPWVFVLSLLGLTPLAERVSFITEQVAFYTGPTVGGLLNATCGNVTELIIAIFALSSNKIAVVKYSLLGSILSNLLLVLGTSLLCGGIANVGLEQKYDRRQGDVNSLMLLLALLCYLLPMLFKYSAASAALTVDPSLHLSRASSIVMLIAYVVYIIFQLWTHRQLFEAEDEDEDDNNGSDEQAVIGLWSGIAWLIGMTVFIALLSEYVVDTIEDASDSWGLSVSFLSIILLPIVGNAAEHAGAVIFAFKNKLDISLGVALGSATQIAMFVVPLCVIVAWTMGVKMDLNFNILETGSVALAIIVTSFTLQDGTSHYMKGLVLLLCYIVIGACFFVQRTPFNQADVTNVIPNGVLSA

SEQ ID NO: 48285 - protein, 171 aa, Vicia faba
MSNPKVFFDMTVGGQNAGRIIFELFADVTPRTAENFRALCTGEKGVGRSGKPLHFKGSSFHRVIPNFMCQGGDFTAGNGTGGESIYGSKFADENFIKKHTGPGILSMANAGPGTNGSQFFICTAKTDWLDGKHVVFGQVVDGLNVVRDIEKVGSGSGKTSKPVVIANCGQL

SEQ ID NO: 48286 - protein, 140 aa, Oryza sativa
  misc_feature (81)..(81): Xaa can be any naturally occurring amino acid
MLKFLSKVVVEYCPLDPRKAAVVELLAQCNGRKAKDSNPACSVELRRLPSLARAADAGDQSADPEPRVDDTYCSGVEESYXVGEGARAQGIREQILERGRLLDTEQLFRDGGEKWPVLIPEEELTMSFRASSQEAEEKPG

SEQ ID NO: 48287 - protein, 320 aa, Silicibacter sp. TM1040
MSVAVLGAGAFGTALAISLARKAPTTLWCRSKDHADEIRSTRENTRRLPGAPLPDALAVTSDIACLGAHDVILLAVPMQKMRGFLTAHHAALSGKTLVACCKGIELDSGLGPVAVLRDTVPDATAALLTGPSFAADIALGLPTALTLACDPDETGKALQATLSTDNLRLYRTTDLTGAEIGGALKNVIAIACGAVIGARLGDSARAALMTRGYAEMQRLALARGARPETLAGLSGFGDLTLTCGSELSRNFRLGLSLGRGEAFDPSITVEGAATARATAKTAQEMGLEMPITQTVTNLLDQRLTISDAADQLLKRPLKEE

SEQ ID NO: 48288 - protein, 347 aa, Datura metel
MATLVSNWSTNNVSESFIAPLEKRAEKDVALGNDVPIIDLQQDHLLIVQQITKACQDFGLFQVINHGVPEKLMVEAMEVYKEFFALPAEEKEKFQPKGEPAKFELPLEQKAKLYVEGERRCNEEFLYWKDTLAHGCYPLHEELLNSWPEKPPTYRDVIAKYSVEVRKLTMRILDYICEGLGLKLGYFDNELTQIQMLLANYYPSCPDPSTTIGSGGHYDGNLITLLQQDLVGLQQLIVKDDKWIAVEPIPTAFVVNLGLTLKVMSNEKFEGSIHRVVTHPIRNRISIGTLIGPDYSCTIEPIKELISQENPPLYKPYPYAEFAEIYLSDKSDYDAGVKPYKINQFPN

SEQ ID NO: 48289 - protein, 167 aa, Glycine max
GDSRCVISRKGQAYNLSRDHKPDLEIEKERILKAGGFIHVGRVNGSLNLARAIGDMEFKQNKFLSAEKQIVTANPDINTVELCDEDEFVVLACDGIWDCMSSQQLVDFVHEQLHSETKLSAVCERVLDRCLAPSTASGEGCDNMTMIVVQFKRPAQSSVPAEESSSN

SEQ ID NO: 48290 - protein, 473 aa, Lactobacillus reuteri
MKKTKIVSTLGPASTDVDTIVKLINAGANIFRFNFSHGDHPEHLGRIENVHKAEEITGKHVGLMLDTKGAEIRTTVQKEGKINFEIGDKVRISMDPSIEGTHDKIAVTYPGLYDDTHVGGHVLFDDGLIDMVIDEKDDANKELVCHVLNHGVLGSRKGVNAPGVSINLPGITEKDSSDIRFGLENKINYIAASFVRKAQDVLDIRELLKEKNMEDVQIFPKIESQEGIDNFEEIIAVSDGLMVPRGDMGVEIPAQNVPIVQKHMIKRCNELGKPVITATQMLDSMQENPRPTRAEVSDVANAVFDGTDATMLSGESANGDYPVESVAMMNDIDIKAENHLWEFGTEKFDWDKSDVTETIGSAVANAAKDLDIHTIVAYTASGYTAKMISKYRPNADIVALTPNERVERGLMINWGVQPYVVDEMKNTDTMFDLAAKKAVELGFAKKGDRIIIVAGVPLGVPGATNMMRVKTID

SEQ ID NO: 48291 - protein, 231 aa, Nanoarchaeum equitans Kin4-M
MVNIEEWQPKTKLGRLVKEGKITNIDEILSNKYVIREPEIVDVLLPNLEVEFMKWRIIRGKFRSKKPYRMAQKKTAEGNKTRYEVIAIVGDKDGHVGVGLGRSSDLLIAREKAINRAKLNIIKVARGCGSWECACGAPHSIPYQVEGKSGSVRVILKPAPKGVGIVADDEIKKIFRLAGIKDVWVRSFGKTKTKMNHVFAVFDALKKLSNVRVQPFFIKFSGYTEGSIINK

SEQ ID NO: 48292 - protein, 209 aa, Brassica napus
GQTYERAYIQRWIDCGNLTCPKTQQKLENFTLTPNYVLRSLISRWSAEHNIEQPAGYINGRSRNRGDMSVIKALVHKLSSRSVEERRNAVSEIRSLSKRSTDNRILIAEAGAIPVLVNLLTSEDVATQENAITCVLNLSIYDNNKELIMFAGAVTSIVQVLRAGTMGARENAAATLFSLSLADENKIIIGGSGAIPALVDLLENGTPRG

SEQ ID NO: 48293 - protein, 217 aa, Lactobacillus reuteri
MIKVAPSILSADYVNLQKDIEKVEKAGAPYLHIDVMDGTFVPSISYGPGFVKAIRPITNMVLDVHLMVESPEHILPMFIDAGADIIGVQVEATQHIHRALQIIKNGGVKAEVVINPGTPVAMIEPVLHMVDQVLVMTVNPGFGGQKFLPETVDKIAQLNAIKEEKGYNFDIEVDGGVNDKTVVDCYKAGATVAVAGSYVFNAEDPAERIKALEDATK

SEQ ID NO: 48294 - protein, 473 aa, Frankia sp. EAN1pec
MALHGRARGRRGDQAVEVRPHLVIPDEDGPVPRYRMPRSSMSAETAYQIVRDELMLDGNARLNLATFVTTWMDEHADRLMTECAAKNMIDKDEYPQTAELEARCVNMLADLWHAPDATDAVGCSTTGSSEACMLAGLAMLRRWRSTREPHRGEQGGGQRGTGARPNIVMGANVQVCWEKFARYWDVEPRLMPLAPGRTHLTAPEAVARCDENTIGVVAVLGSTFDGTYEPVAEIVAALDQLAASGGPDVPVHVDGASGGFIAPFCDPDLVWDFRLERVVSINASGHKYGLVYPGVGWALWRDARHLPAELVFDVDYLGGSMPTFALNFSRPGAQVVAQYYSLLRLGRAGYRHTARTCRDNARWLADEIAKLGPFELISDGSGIPAFAFTTRDAAEFSVFEVSEALRARGWLVPAYRFPPDLAELAVLRIVVRAEFSRDLAHLLVEDLHRVVGRLSGPRWRTAAGGADLASFHH

SEQ ID NO: 48295 - protein, 382 aa, Mesorhizobium loti MAFF303099
MVVSLSRRGNVEPFHAMDVLAEANRLKAQGVPVISMAVGQPSDPAPVRVRAAAARALQDGRIGYTDTLGLAGLRKAIAEHYADHYRLEVEPARIAVTTGSSAAFNLAFLAMFDPGDRVAIAAPGYPAYRNIMAALGIDVVEIELGDAAYLHAGHLETAHREKPLKGVLFASPANPTGAVIPADELSALVNTAEALGIAVISDEIYHRLAYGAPDTTALAFGNSVTVINSFSKYYCMTGWRIGWMVLPEELVRPVERIAQSLYISPPELSQIAAIEAFAATEELEAVKGRYAWNRELLMKRLPELGFPLAAPMDGAFYAFCDVTRHSNDSMAFARKMLAEAHVAATPGRDFDTQAGHRTMRFSYAGSHDDMVEAMARIERWLR

SEQ ID NO: 48296 - protein, 231 aa, Arabidopsis thaliana
MVGATVVSKWTPLCVASPPERNSASLNPHCSPARVNFRTALAAFRPQFRLFSRNSASRRRLRASSSAESGIFLPHLVASMEDVEETYIMVKPDGIQRGLVGEIISRFEKKGFKLIGLKMFQCPKELAEEHYKELSAKSFFLTLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 48297 - protein, 315 aa, Mesorhizobium loti MAFF303099
MPELERAPKLDQALAEVAAEMAERTDRGDVATYIPQLGKVDPRKFGIAAVTNDGRVLVAGDADQAFSIQSISKVFTLTLALGNVGDALWQRVGREPSGNPFNSIVQLEHENGIPRNPFINAGAIVISDILLAGHQPREAIGEILRFIQFLADDDTIIIDREVAASERATGYRNFALANYMKSFGNLHHAPELALGVYFHHCAIAMSCRQLAMAGRFLANGGKNPATGHSVVSAERARRIGAMMLTCGHYDGSGDFAFRVGIPGKSGVGGGILGIVPGVASLAVWSPGLNANGNSKLGSIALEKLARMMNWSIFAP

SEQ ID NO: 48298 - protein, 287 aa, Glycine max
MESKEEDVRVGATKFSERQPIGTAAQGDKDYKEPPPAPLFEPGELKSWSFYRAGIAEFVATFLFLYITILTVMGVNRSPSKCASVGIQGIAWAFGGMIFALVYCTAGISGGHINPAVTFGLFLARKLSLTRALFYIIMQCLGAICGAGVVKGFEGNARYEMFKGGANFVNSGYTKGDGLGAEIVGTFVLVYTVFSATDAKRNARDSHVPILAPLPIGFAVFLVHLATIPITGTGINPARSLGAAIIYNRDHAWDDQWIFWVGPFIGAALAAVYHQIVIRAIPFKTRA

SEQ ID NO: 48299 - protein, 440 aa, Lactobacillus reuteri
MSLITDIYAREVLDSRGNPTVEAEVYTEAGGVGRGIVPSGASTGEHEAVELRDGDKNRFGGKGVLKAVSNVNNIIAKEIVGMEVTDQIAIDKAMIKLDGTPNKGKLGANAILAVSLAAARAAADELQVPLYNYLGGFNAHVLPTPMMNVINGGAHSDNKVDFQEFMIMPVGAPTVREAIRWGSETFHALKKELEAAGKVTSVGDEGGFAPDFANNEEPFEYLIKAIEDAGYKPGKDIAIAFDVAASELWNDEDKKYKLRWSTGEEYTTEEWINYLSGIIEKYPVVSVEDPIDENNWDDWVTITDKLGKKVQLVGDDFFVTNTDYLKKGIQMGAANSILIKLNQIGTLTETVEAIEMAKEAGYTAIVSHRSGETEDTTIADLVVATNAGQIKTGSMSRTDRLAKYNQLMRIEDQLGDVAQYKGIHSFYNLSQQARQDIENR

SEQ ID NO: 48300 - protein, 355 aa, Saccharomyces cerevisiae
MVIDLEHVVDYIMHIDSQLQLHKASPAKMNSESREDMAINSIKLLAGNSHPDLAEQISKKLGIPLSKVGVYQYSNKETSVTIGESLRDEDVYIIQTGIGEQEINDFLMELLILIHACQIASARKITTVIPNFPYARQDKKDKSRAPITAKLVANLLQTAGADHVITMDLHASQIQGFFHIPVDNLYAEPSVLNYIRARKTDFDNAILVSPDAGGAKRVAALADKLDLNFALIHKERQKANEVSKMVLVGDVTNKSCLLVDDMADTCGTLVKACDTLMEHGAKEVIAIVTHGIFSGSAREKLRNSRLSRIVCTNTVPVDLDLPIADQIDISPTFAEAIRRLHNGESVSYLFTHAPV

SEQ ID NO: 48301 - protein, 506 aa, Azotobacter vinelandii
MRYAHPGSEGAIVSYKVRYGNYIAGQFVPPVKGQYFTNSSPVTGEEFTEFPRSTAEDIEKALDAAHAAAGAWGRTSVQERAAVLLKIADRIEQNLEVLAVTETWDNGKPVRETLNADVPLSADHFRYYAGCIRAQEGSAGEINENTVAYHFHEPLGVVGQIIPWNFPLLMAAWKLAPALAAGNCIVLKPAEQTPLSITVLVELIGDLLPPGVLNIVQGFGREAGEALATSKRIAKIAFTGSTPVGAHILKCAAENIIPSTVELGGKSPNIFFEDIMQAEPAFIEKAAEGLVLAFFNQGEVCTCPSRALIQESIYDDFMKVVMKKVGQIKRGHPLDTDTMVGAQASSQQFEKILSYLEIARGEGAEVLTGGAAERLEGSLASGYYIQPTLLKGHNKMRVFQEEIFGPVVGVTTFKDEAEALAIANDTEFGLGAGLWTRDINRAYRMGRGIQAGRVWTNCYHLYPAHAAFGGYKKSGVGRETHKMMLDHYQQTKNLLVSYDINPLGFF

SEQ ID NO: 48302 - protein, 465 aa, Yersinia enterocolitica (type 0:8)
MLLPVIMAGGAGSRLWPLSRTHYPKQFLALTSELSMFQETLLRLEISPHLSPLVICNAEHRFIIAEQLRQQNLLHSGIVLEPIGRNTAPAIALAALLATSNGEDPILLVLAADHVIQDKPAFISAIQLAEPLAEMGKLVTFGIVPNTPETGYGYIRQGKQIEGGAFQVDSFVEKPDLAKAEQYLSSGDYYWNSGMFVFKASRYLQELEKHRPDIFEACKSAIADNGKDLDFIRLDEAAFYSCPDESIDYAVMERTSDAVVVPMNAQWSDVGCWSALWEINDKDSHGNVVRGDVLTEDTNNSYIYSQNRLVATVGINDLIIVETKDALLVANKNKVQSVKEIVGQLKLGSRLEYLQHKEVYRPWGSHDAIAEGVRYHVQHVTIKPGQRTATQIHHHRAEHWVVVSGTARVYRDNESYLVTENESTYIAVGVAHSIENPGKLPLEIIEVRTGSYLEEDDIVRIEHKI

SEQ ID NO: 48303 - protein, 242 aa, Carboxydothermus hydrogenoformans Z-2901
MHRFSRTEILIGSEGLKVLHRSRVMVFGLGGVGSPAVEALARTGVGSLVLVDFDRVSLTNINRQLPALESTVGLLKAEVLAKRIREINPEAEVITVTEKLTPENTERFFRYNPDYVVDAIDTLKNKIALITYMYRKYIPFISVMGAGNRLDPTRFKVADISRTHTCPLTRRVRQALKKEGIYQGVKVVFSEEPPVLERGTSDEPLPAEKKHLPGSVMFVTATAGLIAAGEAVRDLLLRHKIL

SEQ ID NO: 48304 - protein, 752 aa, Geobacter sulfurreducens PCA
MSKKQDALDYHSTGRKGKIEVIPSKPCLTQRDLSLAYSPGVAEPCLEIEKNPEDAYKYTAKGNLVAVLSNGTAVLGLGDIGALAGKPVMEGKGVLFKRFADIDVFDIEVDTKNADEIIKVCQLLEPTFGGINLEDIKAPECFYIEEKLKETMNIPVFHDDQHGTAIISGAALINALELVGKKIEDIKIVVNGAGASGIACAQMAVELGAKKENIILCDTKGVIFKGRSAGMNEYKERFAVETEDRTLEDAFKNADVAYGLSSKGAFTPEMIRDMAPNPIIFAMANPDPEITPEEVAAVRADAIMATGRSDYPNQVNNVLGFPFIFRGALDVRATTINETMKKACVFALAELAKEDCPDSVCRAYGNKKFAFGREYIIPKPFDPRALLRVAPAVAKAAMESGVARQPIADMEKYMEHLETLQGKAKETLRLIINKAKTDPKRVVLPEGENEKILRAAQVMIEEGIAYPILLGNRQEIRKKIEELNLDLNGGVTIIDPDDSPDTERYSQALFEQRQRKGITLTEARRMIRRRGRTYFGCEMVRCGDADALLSGIDAHYPDIIRPALEVIGKQEGLSSVHGLYLMVFKRGIFLLADTTVCIEPTAEELAETAILAAEKARLLDLDPRIAMLSFSNFGSVNHPQALKVKRAAEIVKQRAPELIIDGEMQADTAVVPDILESHYPFATLKGGANILIFPDLNSGNISYKLLTRLGGADAIGPILMGMKKPVHVLQRGDDVMDIVNMAAIAVVDAQSN

SEQ ID NO: 48305 - protein, 666 aa, Arabidopsis thaliana
MVLLLFLVLFFVPESVVCQRPNPNGVEFNTSGNMYTSGSAYINNNGLIRLTNSTPQTTGQVFYNDQLRFKNSVNGTVSSFSTTFVFSIEFHNGIYGGYGIAFVICPTRDLSPTFPTTYLGLFNRSNMGDPKNHIVAVELDTKVDQQFEDKDANHVGIDINTLVSDTVALAGYYMDNGTFRSLLLNSGQPMQIWIEYDSKQKQINVTLHPLYVPKPKIPLLSLEKDLSPYLLELMYVGFTSTTGDLTASHYILGWTFKMNGTTPDIDPSRLPKIPRYNQPWIQSPNGILTISLTVSGVIILIILSLSLWLFLKRKKLLEVLEDWEVQFGPHRFAFKDLHIATKGFKDTEVLGKGGFGKVYKGTLPVSNVEIAVKMVSHDSRQGMREFIAEIATIGRLRHPNLVRLQGYCRHKGELYLVYDCMAKGSLDKFLYHQQTGNLDWSQRFKIIKDVASGLYYLHQQWVQVIIHRDIKPANILLDANMNAKLGDFGLAKLCDHGTDPQTSHVAGTLGYISPELSRTGKASTRSDVFAFGIVMLEIACGRKPILPRASQREMVLTDWVLECWENEDIMQVLDHKIGQEYVEEQAALVLKLGLFCSHPVAAIRPNMSSVIQLLDSVAQLPHNLLDIVQTREVHRGTEISGEAADSPESCSIAPLTFTESFVSHGR

SEQ ID NO: 48306 - protein, 369 aa, Oryza sativa
  misc_feature (340)..(340): Xaa can be any naturally occurring amino acid
MAEAAGDGGWPEPVVRVQALSESGAATIPDRYVRPETERPSSSSEANAVANINIPVVDMSSSPGTAAAAVAEACREWGFFQAVNHGVPAALLRRARGVWRGFFQQPMEVKQRYGNSPATYEGYGSRLGVDKGAILDWGDYYFLHVRPPHLLSPHKWPHLPPDLRETTTEYSEEVRRLCERLMAVMAVGLGVEEGRLQEAFGGREGAGVCVRVNYYPRCPQPDLTLGLSSHSDPGGMTVLLVDDRVKGLQVRHAGAWVTVDPVPDAFIINVGDQIQVVTNALYRSVEHRVVVNAAEERLSIATFYNPRSDLPVAPLPELVSPERPPLYSPMTFDDYRLYIXRRNGPRGKSQVDRLAAAAATIPNSTTTTQ

SEQ ID NO: 48307 - protein, 461 aa, Chlamydomonas reinhardtii
MMLKQGVQQRIAAGATQSTRSCVVEAHAQASSRQVITPFAPRASGKTACLGFARSAASVSGGRARSLVVRAAASASPFPKRNARLVLEDGSVWHATAFGATGTEIGEVVFNTSLSGYQEIMTDPSYKGQFVAFTCPHIGNVGINLEDMESTKCHLGAIIVRDLSCVVSNYRSRMSLDEYCKKENVIGLANLDTRALTKVLRETGCLVGVVTTDASKTDAELVTMAKGWTIVGKDLLSVVSCTEPYEWGKGTTDEWEFNHRAKLNKQHGPFHVVAYDFGIKTNILRRLASFGCRITVVPATYPASEVLKMNPDGVFFSNGPGDPSAAPYAVDNAKAILGKKPVFGICMGHQVLGQAFGGKTFKLKFGHHGGNHPIRYMPTGRVEISAQNHNFAVDPSTLPAGVEVTHINLNDGTCAGMVFKEKKAMTIQYHPEASPGPHDADVCFEQFVDMMRAEKAAHASA

SEQ ID NO: 48308 - protein, 563 aa, Yersinia enterocolitica (type 0:8)
MHHSTPLITTIVGGLVLAFLLGSLAHRLRSSPLVGYLAAGVLAGPFTPGFVADTSLAPELAEIGVILLMFGVGLHFSLKDLLAVKAIAIPGAVAQIAVATLLGMGLSHLLGWDLMTGFVFGLCLSTASTVVLLRALEERQLIDSQRGQIAIGRSIVEDLAMVLTLVLLPAFAGVMGNETTSLSQLFTELAITIGKVIAFITLMIVVGRRLVPWILAKTASTGSRELFTLAVLVLALGIAYGAVGLFDVSFALGAFFAGMVLNESELSHRAAQDTLPLRDAFAVLFFVSVGMLFDPMILLREPLAVLASLAIIIFGKSAAAFILVRMFGHSNVYSTHHFCPWRKSVNLPFILAGLGISLGLMSEHGRNLVLAGAILSIMLNPLLFTLLDRYLAKNETMEDLILEEAVEEEKQIPGRFVQSCTVSRLWSGGSLLGAKLHAEGIPLVVIENSRPRVEALREQGINAVLGNAASADIMSLARLDCALVIILTIPNGYEAGEIVASARIKRPDLEIIARAHYDDEVVYISVRGANQVVMGEREIANSMLNMLKIETLTEEDKRPLCPI

SEQ ID NO: 48309 - protein, 150 aa, Brassica napus
MKKVMVIIDESNSSYDLLVWVLTNLKDVIDSSKVVIFAKQPQNSFTPPTALSSSVGFAQIFYPFSANAELMRLAQEKNTKIALGILEKAKKLCGNHGVKADTFTDVGDVKDIIHKIIQERKINLIAISDQQNRNLKKCLPTTECSLVVVK

SEQ ID NO: 48310 - protein, 552 aa, Geobacter sulfurreducens PCA
MPKNRDAARASLENLYRIFTVPEAPDSTLGAIDQAISGDVTGFLQTHIVAIERDLEDIEANFSSFSIPEEPTYVSEYTEFVKENLVAHSVHTASPAFVGHMTSALPYFMLPLARLMTALNQNVVKVETSKAFTPMERQVLAMLHHLVYRRDEDFYPSWIHNSRHALGAFCSGGTIANITALWVARNRLFAPNGAFRGIAQEGLARALKHRGADGIAVLVSERGHYSLGKATDLLGIGRDDLVKVKTDANNRIDLKALREECRRFQDRNTLPLALVGIAGTTETGNVDPLEAMADLAQELGCHFHVDAAWGGPTLFSDRHRSLLKGIERADSVTIDGHKQLYVPMGAGMVVFKDPTALSAIEHHANYILRHGSKDLGSHTLEGSRPGKAMLVHAGFSIIGRKGYELLIDMGIERARTFADMIKQHPDFELISEPELNILTYRYCPAAVQQTLHDVTDRERADINALLDLVCQLLQKFQREAGKTFVSRTRLHVARHDRELTVLRVVLANPLTTDEILESVLAEQCELVQLPEIQAVLQQVEELCTGLAKAASW

SEQ ID NO: 48311 - protein, 483 aa, Frankia sp. EAN1pec
MQEQDRLFIGGEWVAPSGTRTIEVVSPHSEQVIARVAAPGTEDVDRAVAAARTAFDEGPWPRLDPAERVAVIRRLGALLKPRRKELSELISAEMGAPISFAKLSHVTLPLLMMGAFADIAENLAWEEPRKGFYGQDILLRKEPIGVVAAIVPWNMPLFLTIGKLVPALLAGCSVVLKPSPETPLDAYALAESLAEAGLPQGVVSVLPGDREIGEYLVAHPGVDKVSFTGSTAAGRLVAASCGSNLKRVSLELGGKSAAVVLDDADPAAVAAGVEIAGLMNSGQACVAQTRILVPRARYGEFVDALAAMVEALPVGDPSDPATKVGPLVARRQQERVRGYIEEGQKEGARLVVGGSDLPAGVDQGWYVRPTVFADVESGMRIAQEEIFGPVLTVLPYSDDADAVRIADDTEYGLSGSVWTSDVERGLAVARRVRSGTFGVNQAYSMDPNAPFGGVKASGIGRELGREGIESYLDVKSISVAPAS

SEQ ID NO: 48312 - protein, 262 aa, Frankia sp. EAN1pec
MMCRLTAMGERLSDSIPARRLEGKVAVVTGAGSGIGRAAALLFAREGARVVCADLSGREKETSTIIGEGAVPVHVDVTSSADVQNMIDTAVQEFGRLDVLFNNAGGGGPRKPITEFDEETFDKLIAVNLKGVFLGMKYGIAAMLRGDGGSVINTASAAGLVGWKDQAIYSAAKGGVVQMTKSAALDFAESGVRVNAICPGMTWTGLAHAADDSEPPVANLPQPMRRWGRPQELAAAALFLASDESSFVTGTAIPVDGGYVAR

SEQ ID NO: 48313 - protein, 397 aa, Aquifex aeolicus VF5
MLRKKTLRDVDVKGKRVLVRVDYNVPLDEQGNIVDDTRIRASLPTVEYLLDANAKVILMSHLGRPKNRDPKYSLAPVAKRLSRYINKEVKLAPDCVGEEVKRIVNSMKEGDVVLLENLRFHKEETECDENFARELASLGEVYVADAFGTCHRKHASVYLVPKFLKPAVMGFLLEKEITYFEKAMVAPQRPVVAILGGAKVSSKLEVIKNLIRRVDKLFIGGAMAFTFLKAMGYKVGNSLVEDDLQDVARDLIDVAKKLEIKLYLPVDFVIGQEVSENTPTKVVPWQEIPDGWMGLDIGPVSVELVKEIISDAQTIVWNGPMGVFEIDKFKHGTIEVAKLLAQSSALTIAGGGDTDHAIHKAGVYHAFDFVSTGGGAFLELLAGKELPCLVNLDDKEA

SEQ ID NO: 48314 - protein, 284 aa, Nanoarchaeum equitans Kin4-M
MDIDKILEAGRIAKEAREYAQKLCKSITDGLELAIKVEEFIKKRAKLAFPVNVSIHNVAAHFSPIEPIEMYGVVKIDLGANVDGYLSDTAFSCDLDGNYEELVEASKKALENASKIMRYGVTLSEIGKTIEETIKSYGFNPIKNLTGHSIEYNQLHGGLYIPNYDNGDKTIIKEGLYAIEPFATMGKGYVRNGPPSNIYILVKPKRVRDIRARKVLQYIIENYGWLPFAKRWLIEEFGPIDRELYYLLKEGIIYSYPQLIEEKPVSQFEHTFLVLKDKTIITTL

SEQ ID NO: 48315 - protein, 527 aa, Mesorhizobium loti MAFF303099
MSSDTTIAPEALTFSDLGLSPKVLSAVTDAGYTVPTPIQAGAIPHALLGKDILGIAQTGTGKTASFVLPMLTRLEKGRARARMPRTLILEPTRELAAQVEENFVKYGKNHKLNIALLIGGVSFDEQDKKLERGADVLIATPGRLLDHRERGKLLLNGVEILVIDEADRMLDMGFIPDIERICEMIPFTRQTLFFSATMPPEITKLTEKFLHAPVRVEVSKAASAATNITQRLVKSGSKPWDKRETLRNLIKAEDAELKNAIIFCNRKVEVSELFRSLLKYDFDAGALHGDMDQRARMQMLANFRDGKLRYLVASDVAARGLDIPDVSHVFNYDVPIHAEDYVHRIGRTGRAGRSGKSFTIATKSDTKYIDAIERLIGNKIEWHDGDLSTVVASEGEDDAPRRGKGAPRRAGRKDDDRKDRGERKKGGERRARHSEEDAAVAQQEQPDVAETAVADISERRARKEAIRSENTERKSSDRNEPRAPERGDTRPQRDNSRPARHRHQEDNDTTVGFGDDMPAFMRIVAKV

SEQ ID NO: 48316 - protein, 331 aa, Brassica napus
MGGKGAMMVAMLCLWALSATTEAVVMEEEPGLMMNFYKDTCPQAEDIIREQVKLLYKRHKNTAFSWLRNIFHDCAVESCDASLLLDSTRRELGEKEHDRSFGLRNFRYIEEIKEALERECPGVVSCSDILVLSAREGIEAVGGPHIPLKTGRRDGRKSRTDMLESYLPDHNESISVVLEKFKSIGIDTPGLVALLGSHSVGRTHCVKLVHRLYPEVDPSLNPDHVPHMLHKCPDSIPDPKAVQYVRNDRGTPMVLDNNYYRNILDNKGLLLVDHQLAHDKRTRPIVKKMAKDQAYFFKEFTRAIQILSENNPLTGSKGEIRKQCNLANKIH

SEQ ID NO: 48317 - protein, 205 aa, Zea mays
  misc_feature (103)..(103): Xaa can be any naturally occurring amino acid
  misc_feature (140)..(140): Xaa can be any naturally occurring amino acid
  misc_feature (180)..(180): Xaa can be any naturally occurring amino acid
RPPSAFPTVLSNLAAKPHRTMATFTAASSLSLLFSHPHSHSRQPSAQGPTASSHLHLHPRASRARCASSDTTATKHRRPAEENIREEAARLRGPAQGFSAWYXPFPPAPGGDPNERYSLDEVVYRSSSGGLLDVRHDLEXALAPLPRGSYWGDLLPTPGVGPHRPGPNGSGGWGPQRERXLPEKKSQQIGFPLFGGNPTLFGGGG

SEQ ID NO: 48318 - protein, 347 aa, Nocardioides sp. JS614
MNRTWQNPDQPPPATPSTTEEQRTVTGMKRTTEKNLMVFSGRAHPVLAEEVATLLGTPLVPQSAYEFANSEIYVRYEESVRGCDAFVLQSHTAPVNEWIMEHLIMVDALKRASAKRITVVMPFYGYARQDKKHKGREPISARLMADLFKTAGANRLITVDLHADQIQGFFDGPVDHLMALPILADYVRDKYGSQPLAVVSPDAGRIKVAERWSARLGGAPLAFIHKTRRTDRPNESVANRVVGDVSGRMCVLVDDMIDTGGTIVKAAEALMADGAAGVIIAATHAILSDPAVDRLKNCSAVEVVVTNTLPLAPECEFDKLTTLSIAPLISRAIREVFEDGSVTSMFE

SEQ ID NO: 48319 - protein, 402 aa, Zea mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 48320 - protein, 249 aa, Vitis vinifera
  misc_feature (26)..(26): Xaa can be any naturally occurring amino acid
MEKQMVMVVVAAVMAVFVAEADDTNXVFDPCSDAKVKRFDGFTFGLAFSTKDSFFFNQTQLSPCDRRLSLSSTNSQLAVFRPKVDEISLLTVNSTNFNPVWFNDFLVFSQISNGGYMVAFAGRKYAARSTPVLVADGQHTITSFTLVLEFKKGTLQSFYWKKFGCSKCSKSSAFVCLNEQDCAVKSSHCKNQGGSIDCNISIQLIFSGTDKKLVALNSWYELKNLRQYSLYGLYSNIRDAIIDQYDNFF

SEQ ID NO: 48321 - protein, 535 aa, Burkholderia vietnamiensis G4
MPIIESKLNPRSEDFRANAAALEAVVADLRAKIEQLAQGGGQAARDKHLARGKLLPRDRIAQLLDPGAPFLELSQLAANGMYNDDAPGAGLITGIGRIAGRECVIVCNDATVKGGTYYPMTVKKHLRAQEIAAENRLPCVYLVDSGGANLPNQDDVFPDRDHFGRIFYNQATMSAAGIAQIAVVMGSCTAGGAYVPAMSDESIIVKNQGTIFLGGPPLVKAATGEEVSAEDLGGGDVHTRLSGVVDHLAQNDAHALSIARNIVSHLAPKIAAPVALREPKPPRYDARSLYGAIPVDTRKPFDVREVIARIVDDSEFDEFKARFGTTLVTGFAHIWGHPVGIVANNGILFSESAVKGAHFIELCCQRRIPLVFLQNITGFMVGRKYENEGIARHGAKMVTAVSNAKVPKFTVIIGGSFGAGNYGMCGRAFGARFLWMWPNARISVMGGEQAASVLATVRRDGIEAKGGTWSADEEEAFKQPIRDQYERQGHPYYASARLWDDGVIDPAQTRDVLGLGLAASMNAPIDETRFGVFRM

SEQ ID NO: 48322 - protein, 249 aa, Prochlorococcus marinus str. MIT 9211
MLKAIQSDIAIIKERDPAARGLLEIILCYPGFQALVLHRISHRLWKFGMPLFPRLLSQITRSLTGIEIHPGAKIGKGVFIDHGMGVVIGETTEIGNRCLLYQGVTLGGTGKDEGKRHPTLAENVVIGAGAKVLGAITVGTNTRIGAGSVVVRDVEANSTVVGIPGRVVHQSGVRINPLAHSALPDTEATVIRNLMERIDYLEGQVSSMSNSLKDFNQGSSPNAVLPGEAQNLKDREIIEFLGDEVNDDQ

SEQ ID NO: 48323 - protein, 372 aa, Klebsiella pneumoniae subsp. pneumoniae MGH 78578
MKSRAAVAFGPGQPLKIVEIDVAPPKKGEVLVKITHTGVCHTDAFTLSGDDPEGVFPAVLGHEGGGIVVEVGEGVTSLKPGDHVIPLYTAECGECKFCKSGKTNLCQAVRATQGKGLMPDGTTRFSYNGEPIYHYMGTSTFSEYTVCAEISLAKVNPQAPLDKVCLLGCGVTTGIGAVHNTAKVKAGDSVAVFGLGGIGLAVIQGAVQAQAGRILAVDTNPDKFTLAKEMGATDFINPNDYDKPIQDVIVELTDGGVDFSFECIGNVNVMRAALECCHKGWGESVIIGVAGAGQEIKTRPFQLVTGRVWRGSAFGGVKGRSQLPGMVEDAMAGKIRLDPFITHRLPLEQINEAFDLMHEGKSIRTVIHFGDQ

SEQ ID NO: 48324 - protein, 733 aa, Glycine max
MSTQKKRPYHIEAFKHRAVGDPKYAEKTWKVLEHAIHEIYNHNASGLSFEELYRNAYNMVLQKFGEKLYTGLVTTMTSHLKEISQSIESAQGEIFLEEINRKWVDHNKALQMIRDILMYMDRTFIPSNHKTPVHELGLNLWRDVVIHSSKTQARLLDTLLELVLRERNGEVINRGLMRNIIKMLMDLGLPVYQQDFEKHFLDVSANFYCRESQKFIAICDCGDYLKKAERRLNEEMERVSHYLDPRSESKITNVVEKEMIESHMHTLVHMENSGLVSMLVDDKYEDLQRMYNLFRRVSDGLTIVKDVMTSFVRDTGKQLIMDPERLRDPVDFVQRLLDLKDKYDRVITMSFNNDKTFQNALNSSFEYFINLNARSPEFISLFVDDKLRRGLKGVGEEDVEIVLDKVMMLFRYLQEKDVFEKYYKQHLAKRLLSGKTISDDAERSLIVKLKTECGYQFTSKLEGMFTDMKTSHDTMQGFYANLGTELGDGPMLSVQVLTTGSWPTQPSPPCNLPVEILGVCDKFRTYYLGTHNGRRLSWQTNMGTADLKATFGKGQKHELNVSTYQMCVLMLFNSAERLTCKEIEQATAIPMSDLRRCLQSLACVKGKNVLRKEPMSKDIAEDDAFFFNDKFTSKFFKVKIGTVVAQRESEPENLETRQRVEEDRKPQIEAAIVRIMKSRRTLDHNNIVAEVTKQLQSRFLPNPVVIKKRIESLIEREFLERDKVDRKLYRYLA

SEQ ID NO: 48325 - protein, 465 aa, Rhodococcus sp. RHA1
MPSPSPGYSITVRVHAPVGAGTTSTLAAAIASVKGAMTALDVVESHPDHMVIDLTCDASDVAHADQISTAIAEVPGVIVGKVSDRTFLLHLGGKLEVVPTVPLKHRDDLSRAYTPGVARVCTAIAEHPEDVRRLTIKRNTVAVVTDGSAVLGLGNIGAAASIPVMEGKAALFKQFAGVDAWPVCLDTQDPDAIVEIVRALAPVYGGINLEDISAPRCFEIEARLRDILDIPVFHDDQHGTAIVVLAALTNALRVVGKSLDRARIVVSGVGAAGHAVIRLLVAQGATNIIGCGRKGILSPDDTADEFRTWIAEHTNPEGRTGSLRDALVGADVFIGVSAPNIVTGDDIAAMADESIVFALANPVPEVDPVAAGEHATVVATGRSDFPNQINNVLAFPGVFRGLLDAHAVDITDEMLIAAAGAIADRVSPSELNATYIVPSVFDAGVAPAVAAAVREVAERGPQSEK

SEQ ID NO: 48326 - protein, 123 aa, Oryza sativa Japonica Group
MAPIVIASLATSVAPFQGLKSTAGLPVSRRSTNSGFGDITNGGRIKCMQVWPVDGKKKFETLSSPGYYDGRYWTIWKLPMFGCSDNSQVIKELEEAKKAYPDAFIHIVGFDNVRHVQCISFIA

SEQ ID NO: 48327 - protein, 465 aa, Rhodobacter capsulatus
MSPAAEAFARLRAGDARRRTEFTVQKRRAVLKRLASEIRAREAEIMAALAADLGKPAVEVRISEIIPILSEIRHTSRHLKAWAGVRRVRPTLSMIGTRATIRPEPKGTVLILAPWNYPLCLALGPLVSAIAAGNAAVVKPSELAPATSALVAKIVAACLPEDLVAVVEGGVETATALLAQPFDHIFFTGSPAVGKVVMAAAAKTLASVTLELGGKSPVILGPDADLKKAARMVAWGKFQNAGQTCIAPDHVFVPRAQEAGFTKALRAEIARMYGARPQASRSFARLIGAKHFERVRGMVTEAVGHGATLITGGEAEAASRYLAPTVLTHVPADAALMREEIFGPVLPVIAYDDLGAVLAGIEAGEKPLALYVFARDRKLIARICAATTSGAVGVNVTLAHFLHLNLPFGGIGQSGLGAAHGRWGFQAFSHEKPVLENRFAVLDPLMPPYGKLSARLARLVQALVG

SEQ ID NO: 48328 - protein, 133 aa, Zea mays
MQARAIFEAAIGMTNQGVQELGHQVALIRQVANKVFTGMGKTIGYQIGTMIEIPRVALVADEIDAIRGWLDGGNDTPVTGQPLAHRELAPNLALGAVIQDYTVMRRWQCRFCDSHDDVAPALQIFPSPVGCER

SEQ ID NO: 48329 - protein, 405 aa, Frankia sp. CcI3
MPDQTATPARPRVSAKAATFTESVIREMTRLALAHDAVNLAQGFPDFACPPQLKEAAKAAIDADVNQYAITWGAAEFRAAVAAKVAGTYPGWSVDPDTEICVTCGSTEAMIAAMLALVDPGDEVIMFEPFYENYGPDAILSGARPKLVRLHAPDWTIDEAELRAAFSDRTRAIVLNTPHNPTGKVLRRAELDLVAELCQRHDALVFTDEIYEHIHYLGPGGHIPPATVPGLEDRTVTINALSKTYAVTGWRVGWTIAPAAYTSAIRKVHDFLTVGAAAPLQAGGVAAMNLPQTYYVDLARQYRERRDLLCAALARTGFTFREPDGAYYVMCDTRALDPAGDDVAFARRLATGIGVATVPGSSFFADPADGRHIIRFGFPKKLTTLEAAARRLARLTPAATPATPG

SEQ ID NO: 48330 - protein, 641 aa, Lactobacillus johnsonii NCC 533
MIIAQAQDLEQRFGGNTIFSNISFSVPDNARIGLVGPNGAGKTTLLKIMTGQQEPTSGQFTINKGLKVGYIAQENALDENKTIWDEMLTVFDNLIEKNKRITKMQEQIAEHPEDEDLLKRYDQLAYDFEQEGGFTYQAEIKSILNGFNFKENTWQKVIGTLSGGEKTRLAFVKLLLQKPPVLLLDEPTNYLDLDTLDWLEAFLKNYQGAIITVSHDQYFLDHLANQIFELNFGKLTTFKGNYSQYVKERELMNNQQEAAYEKQQEKIKKEEEFIQKNLVRASTTKRAQSRRKALDKMERIKPPKHKQKVRINFTSDRPSGKEVLIAKDLTIGYPDKTMVSDIDFQVNKNDRVAIIGPNGIGKSTLLKTIMKKLEPKDGSIKYGASLDIGYYDQELQSLDPSKTVLDTIWDRHKTMPEKDVRSILASFLFTAEDIDKTVGQLSGGQKARLTLTVLSLEKDNFLLMDEPTNHLDIEAKEVLEQALDNYDGTLLFVSHDRYFINELANKIISVRDGHAKIYNGNYSYYLDEKAKQAAAVQEAKAEQTESTTSANQNQGKLSYQEQKAHDSQKRKLERAVSDAEARIEKLENEEQEIQTEMANPDIAASFEKLGPLQEKLSAVQEQLNQANTDWENALEALDEFE

SEQ ID NO: 48331 - protein, 517 aa, Oryza sativa Japonica Group
MRIPRRKGGAGPLVGAPSRRAQVAAVFALALLLGVSVLYDSAHIAASLRRHGVGGGGSSGGGGGGGGDGARAYTNTKLSATTEEAEAEAAEVRSPPAQGVESAVEATDRGEAPPEQPVAADSGASSAETPPSLLEQVTETPPPSPSSSSAAAAAAEAQVGGDHGGESCDVYKGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILHGGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSKANPRKFADCIHWCLPGLPDTWNEFIYGHIVSSPQRRPVEPIENQPQR

SEQ ID NO: 48332 - protein, 506 aa, Crocus sativus
MVSTGCSGNGAKGTNGGIVVPEIKFTKLFINGEFVDSVSGSTFETRDPRNGDVIANIAEGDKEDVDLAVKAAREAFDHGKWPRMSGYERGRIMMKFADLIEAFIEELAALDTLDAGKLLSMGKAVDIPAAVHIIRYYAGAADKIHGYTLKLSSELQGYTLKEPIGVVGVIIPWNFPTTMFFLKVSPALAAGCTMVVKPAEQTPLSALYYAHLAKLAGVPDGVINVVPGFGPTAGAALSSHMDVDSVAFTGSAEIGRAIMESAAKSNLKNVSPELGGKSPMIVFDDADVDMAVSLNSLAVFFNKGEVCVAGSRVYVQEGIYDEFVKRAVEAARSWKVGDPFDQSRNMGPQVDKDQFESVLKYIEHGKSEGATLLTGGKPAADKGYYIEPTIFVDVTEDMKIAQEEIFGPVMSLMKFKTVEEGIDCANNTKYGLAAGILSQDLDLINTVSRSIKAGIIWVNCYFGFDLDCPYGGYKMSGNCRESGMDALDNYLQTKSVVMPLHNSPWL

SEQ ID NO: 48333 - protein, 366 aa, Physcomitrella patens subsp. patens
MNPRYSMINDNYRSLEEVQRALKDNGLESSNLIVGIDFTKSNEWTGRVSFGGRSLHAIGQEQNPYEKALTIIGTTLSPFDDDNLIPCFGFGDSTTHDKQVFSFYSENRPCDGMEEALARYRAILPHVRLAGPTSFAPIINAAVDIVEESGGQYHVLFIIADGQIEGPQERATVDAIVNASYYPLSIVLVGVGDGPFSMMKEFDDNLPERTFDNFQFINFTEIMQSRLLPQEKEAKFALGALMEIPLQYKATVKLGILGTRRGQSPGVRPRPPPPRVLQMDGLGYGPSPGSPQTPSFTHMDSQKYGRSNNPQAPSSIYSEDAECPVCLLDKKDTAFNCGHQTCQYCAQALTNCPICRQPISRRIRLY

SEQ ID NO: 48334 - protein, 212 aa, Brassica napus
MATQGQVITCKAAVAYEPNKPLVIEDVQVAPPQAGEVRIKILFTALCYTDAYTWSGKDPEGLFPCILGHEAAGVVESVGEGVTEVQPGDHVIPCYQAECRECKFCKSGKTNLCGKVRSATGVGVMMNDRKSRFSVNGKPIYHFMGTSTFSQYTVVHDVSVAKIDPKAPLEKVCLLGCGVPTGLGAVWNTAKVEPGSNVAIFGLGTVGLAVAE

SEQ ID NO: 48335 - protein, 458 aa, Clarkia xantiana
  misc_feature (445)..(446): Xaa can be any naturally occurring amino acid
GRIAQIIGPVLDVAFPPGKMPNIYNALVVKGRDTVGQEINVTCEVQQLLGNNRVRAVAMSATDGLTRGMEVIDTGAPLSVPVGGATLGRIFNVLGEPVDELGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGDEHYETAQRVKETLQRYKELQDIISILGLDELSEEDRLTVARARKIERFLSQPFFVAEVFTGSPGKYVGLAETIRGFKLILSGXXDGLPEQAFYLVG

SEQ ID NO: 48336 - protein, 312 aa, Bacillus thuringiensis serovar konkukian str. 97-27
MKKVYFNHDGGVDDLVSLFLLLQMDNVELTGVSVIPADCYLEPAMSASRKIIDRFGKNTIEVAASNSRGKNPFPKDWRMHAFYVDALPILNESGKIATHVAAKPAHHHLIETLLQTEEKTTLLFSGPLTDLARALYEAPIIENKIKRLVWMGGTFRTAGNVHEPEHDGTAEWNSFWDPEAVARVWEANIEIDLVTLESTNQVPLTIDIREQWAKERKYIGIDFLGQCYAIVPPLVHFAKNSTYYLWDVLTAAFVGKADLAKVQTINSIVHTYGPSQGRTVETDDGRPVHVVYDVNHDRFFDYITRLAKKVST

SEQ ID NO: 48337 - protein, 154 aa, Aquifex aeolicus VF5
MQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 48338 - protein, 387 aa, Leifsonia xyli subsp. xyli str. CTCB07
MDLYEYQARDLFEKYGVPVLPGIVADTPEEVRAAAEKLGGVNVVKAQVKTGGRGKVGGVKVAKNPDEAEEAAKAILGLDIKGHVVRRVMVSGGARIAREFYFSVLLDRANRSYLSLTSVEGGMEIEQLAVEKPEALARIGVDPIAGVDTTKATEIARAAGFPEELVSKVADVFVKLYDVYKGEDATLVEVNPLVLTEEGEVIALDGKVTLDENAGFRHPEHEELEDKAAADPLEAKAKEADLNYVKLDGQVGIIGNGAGLVMSTLDVVAYAGERHKGVKPANFLDIGGGASAEVMAAGLDVILNDPQVKSVFVNVFGGITACDAVANGIVKALEILGGDANKPLVVRLDGNNVEEGRRILTDANHPLVTLALTMDEGADKAAELAAK

SEQ ID NO: 48339 - protein, 158 aa, Prochlorococcus marinus str. MIT 9211
MVSIEGRFNDASNFRIAIVVARFNDLITNKLLSGCIDCLQRHGVDTSESSPQLDIIWVPGSMELPLICQSLASKGKYQVLITLGAVIRGDTPHFEVVINESSKGIASVARENGIPIIYGVLTTDTMQQALERAGIKSNLGWNYALQALEMASLMKALR

SEQ ID NO: 48340 - protein, 153 aa, Glycine max
FGTRPRADDHHVLLEGTLLKPNMVTPGSESARVKAEVIAEHTVRALQRTVPPAVPAIVFLSGGQSEEEATVNLNAMNQLKGKKPWSLTFSYGGALQQSTLKAWGGKDENIPKAQSALLVRCKANSEATLGTYKGDATLGEGASESLHVKDYKY

SEQ ID NO: 48341 - protein, 371 aa, Zea mays
GISLSPQNPPSSFTPATALSMASPLGPGSFSLAHPAARRPVNSTGPAAMLMLRRAGLATVCPPERSLGSDCLRAGADPRLAIHVALRCRSASSTGRGTRAAATMTKKSVGDLTAADLEGKRVLVRADLNVPLDDSQNITDDTRVRAAIPTIKHLISNGARVILTSHLQELDYLVGAVSNPKRPFAAVIGGSKVSSKIGVIESLLEKCDILLLGGGMIFTFYKAQGHSIGSSLVEDDKLELATSLLRKAKEKGVSLMLPFDLVVADKFAPDASNSISAFSSALETTQTVIWNGPMGVFEFDKFAVGTKAIAKKLAELSGKGVTTIVGGGDSIAAVEKVGVADSLSHISTGGGASLELLEGKELPGVAALDEA

SEQ ID NO: 48342 - protein, 588 aa, Prochlorococcus marinus str. MIT 9211
MVLLVQKFGGTSVGSVERIQSVAQRIALCKDQGFELVIVVSAMGKATDELTQLAQEISHKAPKREMDMLLATGEQVSIALLSIALNEIGIPATSMTGAQVGIVTESSHGRARILEIKTARIENLLSQGQVVVVAGFQGTSLGSGGTAEITTLGRGGSDTSAVALAAALHADACEIYTDVPGVLTTDPRKVPNAQLMNSISCDEMLELASLGAAVLHPRAVEIARNYGIKLVVRSSWDETPGTTITSQGNREIGKEGLELGRPVTGVELVENQAVLGLAHIPDKPGIAADLFETLSKGGVNVDLIIQSTHEGNSNDITFTVAEEELSLAKALCKQFINKFGGELSTQSEMSKLSIRGAGIMGRPGIAAKLFETISKAGINLRLIATSEVKLSCVIDSGMGCKALRAVSEAFEIKKDHIHINPEICNLEEPEVRGVALDTNQAQMSVINVPDIPGTAATLCRALTESGISLDTIVQSERKHKKGGRNISFTLHKEDREKLNKVLLPLLKTWHEAYLQDGKAIARISSVGAGMPATIGTAARMFRALANAEINIEMIATSEIRTTCIVSESYGTKALQAVHEFFQLNESDK

SEQ ID NO: 48343 - protein, 639 aa, Physcomitrella patens subsp. patens
MVSIARLKEACSHCLPPTVAPYHAVCTPPALVTRVFEQATIGRDVRVIGPADLAKFMTDWQGDRNATEERATSLMADFNFLKSTASRALRIPGLSHSSKYSLSSRHSGSKHGQSAPETPTFDIATFLKFLLHPEFNGHRVPVSKTPTDDMNAPLSDYYIFSSHNTYLMGNQLCSPSSTAPIVKALLDGCRVIELDCWNGSNKRIDVLHGGTLTKAVPFEDCVKAIKDNAFTTSAYPVVVTIESHLDLEHQKEAARVLNKILGNIMFVPPPNELPPQSFRSPEQLKHRIIISDKPPGDALLSQAANEPEFAQQTLLHEVVRDPSPDNRHEHRHGRRGKKKKLRRRQSQIAESRIQKLPSGKLGDSGRPAIANDPAFDELLYIHCQKPTEMATEQKKGGPLIKGQHAIMANLSESQLDDLIEDHTDSLIEFSKTNLTRVYPFGLRVTSSNADPMDAWEHGVQVAAINMQGRDRPVWISKAIFSRNGGCGYVKKPDILLPESNMDHKSLMNLQPKLELKVTVLLGTDWHKNYDVFKKPDYFVKVAIHGMHDDEQKFKTHVCKRSREPHWEDEEFVFQIRVPELAILRLEVREYDRIVRDDMVGQSCVPVTELRQGIRAVQLASKKGEPRSSKLLCHFITRTL

SEQ ID NO: 48344 - protein, 478 aa, Acidovorax sp. JS42
MTYPDTRLFIAGQWQDAESGKTIAVHNPATGQEIGRVAHAGIADLDRALAAAQKGFEVWRDTPAIERAKTMRRAAALMRERADAIAAILTQEQGKPRAEARVEAMAAADIIEWFADEGMRVYGRIVPSRNLAVRQMVVKDPVGVVAAFTPWNFPINQVVRKLGAALAAGCAVLVKAPEETPASPAELIRAFADAGVPAGAVGLVYGNPAEISNYLIPHPIVRKVTFTGSTPVGKQLAGLAGQHMKRVTMELGGHAPVIVCEDADIELAVKASGGAKFRNAGQVCISPTRFLVHESVRADFVAALTRHAQGLKVGDGLAEGTQMGPLANPRRVAAMADLLADAVQQGATVRTGGERLGEVGNFFAPTVLDNVPTHARIFNEEPFGPVAAVQGFTQLEAAIAEANRLAYGLAGYAFTRSLKNAHLLSQRVEVGMLWINQPATPSAELPFGGIKDSGYGSEGGPEALEACLNTRAISITHV

SEQ ID NO: 48345 - protein, 476 aa, Physcomitrella patens subsp. patens
MPPSHRIKAASLSAFQEFQNARANRYTKVKSSVMVLGLSIHTTPVEMREKLAIPEAEWPRAIDELSSQNHIEEAGVLSTCNRFEIYVVAVSWNRGVKEVTEWMSKTSGISVEDLMEHIFILRDQDATQHLFRVSSGLDSLVLGEGQILAQVKQVLKVGQEVSGFGRNLTGLFKQAITAGKRVRTETNISAGAVSVSSAAVELAVMKLPEGGVSRVNVLIVGAGKMSKLLVKHLISKGCTRMTIVNRSEQRVLDLQTEFPDANIIYEPLTEMLRCTGESDLVFTSTSSEIPLFTKENVEPLTPASQTSGGVRHFIDISVPRNVAACLSDLSSTRVYNVDDLKEVVAANKEDRRRKAADAQVIIDAEIQNFEAWRDSLETVPTIKKLRSYAERVRQAELEKALSKMPEDLTTKQKRALEDLSRGIVNKLLHGPMQHLRSDGTDSKTVSETIENMHALERMFDLGSEVLVVETKAKGKK

SEQ ID NO: 48346 - protein, 192 aa, Xanthomonas campestris pv. campestris str. ATCC 33913
MLLMLDNYDSFTYNLVQYLQALGAEVTVVRNDAMSVDQIAALKPERIVISPGPRTPNEAGISLQLIEQLGQTTPILGVCLGHQSIGQVYGGDVIRASNIMHGKTSPIRHHGKGVFAGLPDSYEATRYHSLVVDKATLPDALEVTAWTENPDGSMEEIMGLRHRQFPVEGVQFHPESILTQHGHALLKNFLER

SEQ ID NO: 48347 - protein, 524 aa, Trametes sp. C30
MGRLQRFSAFVPLTLSFISQASAAIGPVTDLTISDADISPDGFTRAAVVMNDQFPGPLIAGNKGDNFQINVIDNLSNSTMLTSTTIHWHGFFQKGTNWADGAAFVNQCPISAGNSFLYDFTATDQAGTFWYHSHLSTQYCDGLRGPMVVYDPDDPHASLYDVDDDSTVITLSDWYHTAARLGARFPAGADSTLINGLGRAAGGDADAALAVFNVTQGSRYRFRLVSLSCDPNFNFTIQDHNMTIIEVDGVNVEPVTVDSIQIFAGQRYSFVLTADQDIGNYWIQAVPNTGTVTTDGGVNSAILRYDTADPIEPDAADPTSSIPLVETDLVPLENLAAPGDPTVGGVDLAMNLEFDFNGTWFFINGEPFVPPSVPVLLQIMSGAQSAADLLPSGSVYTLPANSTIEISFPMNTTAAPGAPHPFHLHGHTFYVVRSAGSTEYNYVNPPQRDTVSTGTDGDNVTIRFTTNNPGPWFLHCHIDFHLDAGFAIVLSEDTPDAASANTPSSAWDDLCPTYNTDYPDGLGR

SEQ ID NO: 48348 - protein, 469 aa, Coccoloba uvifera
  misc_feature (11)..(11): Xaa can be any naturally occurring amino acid
LGRVAQIIGPXLDVAFPPGKMPNIYNALVVKGRDTAGQPINVTCEVQQLLGNNRVRAVAMSATDGLTRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNKQDVLLFIDNIFRFVQAGSEVSALLGRMPSAVGYQPTLSTEMGSLQERITSTKQGSITSIQAVYVPADDLTDPAPATTFAHLDATTVLSRALAAKGIYPAVDPLDSTSTMLQPRIVGEEHYKTAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAM

SEQ ID NO: 48349 - protein, 364 aa, Pleurotus pulmonarius
SSMLKTTSIHWHGFFQEGSSWADGPAFVTQCPIASGDSFLYDFRVPDQAGTFWYHAHLSTQYCDGLRGAFVVYDLLDPHRLRYLVDNEDTVITLADWYHTVAPQAGLVPVPDSTLINGRGRYAGGPTVPLSLIRVLWGVKYRFRLVSLSCDPNYTFSIDGHKMTIIEVDGVNTKPLEVDSIQIFAGQRYSFVLHANQRIANYWIRANPNLGTRGFEGGLNSAILRYYGAPNSDPTTTQETSVNPLVETNLVPLRDAGAPGVPGVGNADVNINLAMAFDFPSLQFTINGAPWVSPTSPVLLQIISGASSASELLPPGSIYTLPRNKVVELSIPALAIGGPHPIHLHGHAFDVVRSAGSSTYNYNN

SEQ ID NO: 48350 - protein, 373 aa, Bordetella bronchiseptica RB50
MAKRDYYEVLGVAKNASDEDLKKAYRKLAMKYHPDRNPDSKEAEEKFKEAKEAYEVLGDEQKRAAYDRYGHAGVDPNAAGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 48351 - protein, 259 aa, Aspergillus oryzae
MADAAPRGRGGFGSRGDRGGDRGRGRGRRGRRGGKQEEKEWQPVTKLGRLVKAGKITSMEQIYLHSLPIKEYQIVDFFLPKLKDEVMKIKPVQKQTRAGQRTRFKAVVIIGDSEGHIGLGIKTSKEVATAIRAAITIAKLAVLPVRRGYWGSNLGEPHSLPVKQSAKCGSVSVRLIPAPRGTGLVASPAVKRLLQLAGVQDAYTSSSGSTKTLENTLKATFLAVVNTYGFLTPNLWKETKLIRSPLEEFGDVLRQGKKY

SEQ ID NO: 48352 - protein, 503 aa, Leifsonia xyli subsp. xyli str. CTCB07
MREANVYSEIVPHTVTAADIAAKRPAGIILSGGPSSVYEEGAPRLDEGIFELGVPVLGICYGFQVMAVALGGEVAKTGHREYGSTAVRVSAGARGGAGFLLDGQPGDQTVWMSHGDSVAKAPEGFDVLASTDDTPIAAFANDGRKLYGVQWHPEVKHSEHGQAVLENFLHRAAGIPADWNSGNVIADQVAAIRAQVGSGRVLCALSGGVDSAVAAALVHKAIGDQLVCVFVDHGLLRRDEARQVQEDYVSATGVRLITVDAEEQFLAALESVSDPEAKRKIIGREFIRVFERAQADLVAEAASEGDPIRFLVQGTLYPDVVESGGGAGTANIKSHHNVSGLPEDLQFELVEPLCTLFKDEVRAIGRELGLPEVIVGRQPFPGPGLGIRIVGDVTRERLDLLRDADAIVRAELTAAGLDSEIWQCPVVLLADVRSVGVQGDGRTYGHPIVLRPVSSEDAMTADWTRLPYHLLAKISNRITNEVEGVNRVVLDVTSKPPGTIEWE

SEQ ID NO: 48353 - protein, 318 aa, Musa acuminata
MDSFPVIDMEKLLGRERGAAMEILRDACEKWGFFEILNHGISHYLMDEVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 48354 - protein, 463 aa, Leifsonia xyli subsp. xyli str. CTCB07
MHLGEDLIILGLLLLVAYALGRLGKLVGLPAIPIYMIVGLLASPNTGWFPLDFESRYIELIAVFGLILLLFNLGLEFDQDEFFGNFGKLIISGGSYILINMGVGLAFGFWVGWGTREALVIAGMTATSSSAIVTKLLIELRRLPNRETPMILGVTVVEDIFIAIYLAIVSVVLSGETALWPVAGKLAIAFAFLVVMFTLARWGGKVFSRLFRTKDDELFTILFFGLAVLFAGIGEILGVTDAIGAFLIGLVLGATKHRNKIEHIAIPLRDVFAAFFFLNFGLELEPAKFSGVLGPVLIAVAMTIALNILAGQVVAWINGMDAQAGINTTVILQNRGEFALILATLSISAGLDPRIQPFAGLYVLIMAVLGPVLAASSERIGALVLRTGKLRRRGRRKPRPPMLDEEIALVEAATADLDSDKPREEKSAAVAAEETRRAVDRLVEQAMQQAGPQNDTTGDRKRD

SEQ ID NO: 48355 - protein, 213 aa, Zea mays
FVYLIIYLRYLTRADFQEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGT

SEQ ID NO: 48356 - protein, 271 aa, Arabidopsis thaliana
MASIASSSSTTLLSSSRVLLPSKSSLLSPTVSVPRTLHSSSASSSSLCSGFSSLGSLTTSRSASRRNFAVKAQADDLPLVGNKAPDFEAEAVFDQEFIKVKLSEYIGKKYVILFFYPLDFTFVCPTEITAFSDRYEEFEKLNTEVLGVSVDSVFSHLAWVQTDRKSGGLGDLNYPLVSDITKSISKSFGVLIPDQGIALRGLFIIDKEGVIQHSTINNLGIGRSVDETMRTLQALQYVQENPDEVCPAGWKPGEKSMKPDPKLSKEYFSAI

SEQ ID NO: 48357 - protein, 613 aa, Leifsonia xyli subsp. xyli str. CTCB07
MATTALSNSAQSSAASAPSRLGPAERAAAIAALKESELDILVVGGGIVGAGSAVDAVTRGLSVGLVEARDFASGTSSRSSKLVHGGIRYLEQLDFGLVREALIERGLLLQRIAPHLVKPVRFLYPLHKRVWERLYIGAGMMLYDIFSYTGLRPPGVPHHRHLSRRQVLKAIPSLAPNALVGGITYYDAQVDDARYVATLARTAAHYGAQVATRLRVEGFVKVGERVVGVWARDLETDERFEIRAKQVVNATGVWTDDTQAMVGERGQFKVRASKGVHLVVPRDRFQSKIGLLLRTEKSVLFVIPWGRHWLIGTTDTDWNLDKAHPAATAADIDYLLAHVNQVLNVPLTREDVEGVFAGLRPLLAGESEETSKLSREHLVAHSVPGLVVIAGGKWTTYRVMAKDAIDAAVDALDGKIPASATMEIALVGAEGYQAAWNSRGRIARESGLHPARIEHFLNRYGTMTADILALIREDPALAEPLPGADDYVGAEVVYAVSHEGALHLEDVLARRTRISIEAWDRGASAAPVAAYLMAKVLGWDRAREEREVQTYLLRVAAERESQLQPDDESADRVRLEAPDIVAVDAAAETGSAAKAPRTAAASRRPKGPKGPKP

SEQ ID NO: 48358 - protein, 425 aa, Methanopyrus kandleri AV19
MIGIVLAAGEGTRMRPLTKTRPKVLLPVADRRLIDFSIEAMKRIGVEHLVVVVEYLAEKVERYVKDRWGDSFELEFVRQGKPLGTAHAVYVAWREIEPDETVVITNGDLVFDSELLERAVREHEGVASMVLVEVEDPSEFGVARLQDGYVVELVEKPKPEEAPSNLANAGVYVAEPEFERFLERVKPSPRGEFEITDALLDAAIDEGVLGISYDGFWSDVGRPWDLLDANAWALRNAMSRPEVEGVIEENVELRGPVWVAEDAILRSGAVVEGPAYIGPGCEIGPNCYIRPATTLVRDVRIGQAVEIKNSIIMEGTNVSHLSYVGDSVIGAKCNLGAGTIIANLRHDERNVKVVVKGELEDTGRRKFGAVLGDGVKTGINTSILPGRKLGPYSATAPSTVVRKNVPEGKMLVQGDQILVDWEGRG

SEQ ID NO: 48359 - protein, 343 aa, Thermococcus kodakarensis KOD1
MGKYDELFARIKEKAKDVDRVILELVPEKEPLELYKAARHYPLAGGKRVRPFVVLRAAEAVGGDPEKALYPAASVEFIHNYSLVHDDIMDMDELRRGRPTVHKLWGVNMAILAGDLLFSKAFEAIAKAEVPAEKKARILDVLVRTSNLLCEGQALDIEFETKEEVTVEEYLKMISGKTGALFQGSAEIGAIVGTEDEEYIGALSKWGMNVGIAFQIWDDVLDLIADEEKLGKPVGSDIRKGKKTLIVSHFFEHASEEDKAEFLKVFGKYAGDAKGDALIHDENVKEEVAKAIELLKKYGSIDYAANYAKNLIREANEALKVLPESEARRDLELLAEFLVEREF

SEQ ID NO: 48360 - protein, 425 aa, Nocardioides sp. JS614
MASIEAVGAREILDSRGNPTVEVEVLLDDNSFARAAVPSGASTGAFEAVELRDGGDRYLGKGVAKAVEGVIQTIAPAIEGLAADDQRLVDQTMLELDGTPNKGKLGANAILGVSLAVARAAADSAELPLYRYVGGPNAHLLPVPMMNILNGGSHADSNVDVQEFMIAPIGAPTFREALRSGAEVYHALKSVLKKKGLATGLGDEGGFAPNLDSNRAALDLIAEAVSAAGLTLGKDIALAMDVAASEFYKDGSYAFEGGTKTAEQMTAYYADLVASYPIVSIEDPLDEEDWAGWKALTDELGSKIQIVGDDLFVTNVERLQRGITGGQANALLVKVNQIGSLTETLDSVELAHRNGYRCMMSHRSGETEDTTIADLAVATNCGQIKTGAPARSERVAKYNQLLRIEDELGDAARYSGASAFPRYAG

SEQ ID NO: 48361 - protein, 394 aa, Oryza sativa Indica Group
MAAVRCSAAKRSYNVTLLPGDGIGPEVVAVAKDVLSLAGALEGKASNQSLSLSLSLGPTRVEFRFQEKLMGGAAVDAYGVPLPEETLAAAQASDAVLLGAIGGYKWDNNEKHLKPETGLLQIRAGLGVFANLRPAAVLPQLVDASTLKKEVAEGVDIMVVRELTGGIYFGQPRGFGKNDKGEDTGFNTEVYSASEIDRITRVAFEVARKRRGKLCSVDKANVLEASMLWRKRVTSLASEFPDIELSHMYVDNAAMQLIRNPKQFDTIVTNNIFGDILSDEASMLTGSIGMLPSASVGESGPGLFEPIHGSAPDIAGQDKANPLATILSAAMLLRYGLGEENAAKRVEAAVTETLNNGFRTGDIYSPGTTLVGCKRMGEEVLKTVESQSAVALNS

SEQ ID NO: 48362 - protein, 578 aa, Prochlorococcus marinus str. MIT 9211
MSNTYAPLHNKYRPQSFDDLVGQKVIASTLKQALLTNRIAPAYLFCGPRGTGKTSSARILARSLNCLNVEEPTINPCCQCNLCQTISAGNALDVIEIDAASNTGVDNIRDLIEKSKFAPVIARWKIYVIDECHMLSAAAFNALLKTLEEPPSRVVFILATTDPQRLLPTIISRCQRFDFSQIELNDLINHLQEIANKEEIGIEKEAINLVARRSQGGLRDAQSMLDQLSLLPQPITVNAVLDLLGEVSEEKLLDLAMALTKKDPLNLLLICRELINNGKDPMGILQGLASILRDLVLKNAAPDYPDLCSISQESHQKLSEIASLVEPERLLQWQSHLKGSENNLRHSSQPRLWLEVLLLGLLNEPFNTKLETQVNAARANISYTSQERHEPSENPNKNNPNLENKNVADKHQSSLEKNVNVKETNSGLSEAWEQVLARIDLPSTRMLLSQQAQLVGLSENKAEINVAENWLGMIESRKSLLEKAINEALGQERKLILNSQSRLSVNTEKKIKVSDKHLKQTSTETAQDIKPKESPINNIDSSKFQSEKKDESNKFINGKAEEFAKFFNGEVINIDKKT

SEQ ID NO: 48363 - protein, 309 aa, Physcomitrella patens subsp. patens
GPRVFTFKELAAATKNFSRTELLGRGGFGSVYKGVLRDKSMVAVKSIAKDSRQGEIEFLAEVSIIGKIRHRNLVRLRGWCAEKEKLLVVYDYMPNGSLDKWIMPAEEGETNPVLAWNARYNILSGLSGALAYLHEEWQQCILHRDVKPSNILLDDKFNAYLGDFGMARLIDHNKVAYSTVVAGTMGYLAPELPHTRKATPKTDVFSFGVLALEVTCGRRAFDPNRPHAEVYLLDWVWTMHQNNQLRKCVDPRLGEDVDVMQSRLVLHIALLACHPDPASRPSMRFVRQVLYGDLSLPTIPPSRPVISYS

SEQ ID NO: 48364 - protein, 532 aa, Adiantum capillus-veneris
MSEQGCYTDCWGAIWWIWESGIKAMAGLEGEIQTRRLRGREIPVLPPVTRSAAASAANVGYNENTRKTKVSTKRAAADDTSSRVASNVPVQHAKKRAALANLTNQSNSAITRNSSLPSKSHASAVNGKTRAAAGQVKEVQQVAQQVVEPLQEVGREPNTGRSSLANSSITFDNDENACPERATSSVGMKSRTLDVLQLVGNENKTVASLERKTQHSLYISKDTKPRARQGGLFEDCKDDNEEGGWSSKNYMDIDNHKDPQMCSAYAAEIYHHLRMAELKRRPSLNFMDTVQQDINASMRGILVDWLVEVAEEYKLVPDTLYLTISYIDRFLSGNLVTRQRLQLLGVASMLIASKYEEICAPQVDEFCYITDNTYNREEVLEMERSVLNHLHFELTGPTTKSFLRRFVRAAQAGQKSPTLQLEFLGNYLAELTLLEYGFLHFLPSMIAGAAVLVARVTLNPTWRPWNSTLQHYSGYKASELKECAKAILELQKNTKNCTLPAIREKYRQHKFKCVATLHPPASIPAEYFDDIE

SEQ ID NO: 48365 - protein, 311 aa, Acidovorax sp. JS42
MMSAVPSMPATLVPDAAPGFDFNDWMRAELARVEEALSRWVCHDAPAGLGEAMRYAVLDGGKRLRPLLVLAASHAVGGQPEAALRAACAVELIHAYSLVHDDMPCMDNDVMRRGKPTVHVRFGEARALLAGDALQALAFELLTPEDGVPLAMQARLCRELAQAAGAAGMAGGQAIDLASVGLQLSEDQLRHMHSLKTGALLQASVVMGAVCGQPTGAALQALTDYGAAMGLAFQVVDDVLDVTQDSATLGKTAGKDAASDKPTYVSLMGLQSARAYADVLHAQALAALVASGLTDTRALAALADMVVRRSH

SEQ ID NO: 48366 - protein, 426 aa, Aspergillus nidulans FGSC A4
MANPVTEIDVDLNTQEVLLAASQHDTAKLRRLLRANDAAGNPANVKDPETGYSPLHAAIAACEPDEEEDVKSNGVQTNGDRQTHGQESTVEAAVQTVKLLLQEGAIWNDLDLNNETPGCIARRLGLTELYDMVVDAGVRAELLLNRLDGYEQLSDEEMEEDGEQEQEQQDAAVAADASITNTAEDESVPQLVDTTAAAPPQTADAEPSVTSSRYLNSDLTFQQDRLLDQDQNGVMMAWESDIMAKSAKQLLPTPGLRVLNVGHGMGIVDGFIQEQSPSAHHIIEAHPAVVAEMKRKGWHEKPGVVIHEGKWQDILPGLVAEGVMFDAIYYDTFAESYADFREFFTEQVIGVLEQEGKWSFFNGMGADRQISYDVYQKVVEMDLFEAGFDVEWEEIDVPKLEGEWNGVRRPYWSIDKYRLPLCKYMD

SEQ ID NO: 48367 - protein, 629 aa, Acidovorax sp. JS42
MSMTNYPLLERVNDPADLRRLPRAELKTLAHELRAFVLESVSKTGGHLSSNLGTVELTVALHAVFDTPRDRLVWDVGHQTYPHKILTGRRDRMPSLRQLGGLSGFPQRAESEYDTFGTAHSSTSISAALGMALAAKQRGDERRCVAIIGDGAMTAGMAFEALNNAGVADANLLVILNDNDMSISPPVGALNRYLAQLMSGQFYAKARDMGKSVLKNAPPLLELAKRLEQQAKGMVVPATLFEKFGFNYIGPIDGHDLDSLIPTLENIRGLKGPQFLHVVTKKGQGYKLAEADPVAYHGPGKFDPRVGLVKPATPPKQTFTQVFGQWLCDMADKDKRLVGITPAMREGSGMVEFHQRFPDRYYDVGIAEQHAVTFAAGMACEGVKPVVAIYSTFLQRAYDQLIHDVALQNLPVVFALDRAGLVGADGATHAGAYDIAFVRCIPHMSMACPADERECRQLLTTAYEQDHPVAVRYPRGAGVGVAPLPDLEGLPFGKGEVRRTGQRIAILAFGTLLYPALQAAQALDATVVNMRWAKPLDTQLLLQVAAEHDALVTVEEGCIMGGAGSAVAEALAAAGLQRPLLQLGLPDVFIEHGDPAKLLALQGLDAAGMQRSITERFGALPGAQALAAA

SEQ ID NO: 48368 - protein, 267 aa, Pseudoalteromonas tunicata D2
MHPMLNIAVRAARNAGKVILRACEDLSKLEVSQKGTNDLVTNVDRDAEAVIRDTILKAYPTHSLVGEELGEHKGTDSDYLWVIDPINGTTNFVKGIPHFAVSVALKVKGRTEQAVIYDPIRGEIFSASRGQGAQINSKRVRVSKSNELAGTVLATSWPYRHKHHLEAYSKAFNALFIHATDIRNSGCPALDLAYAAAGRADGYFAIGLKPWESAAGLLLIKEAGGMVVDFAGGNNYEVSGNIICAAPKLSQSMVKEMRPHLTEALLR

SEQ ID NO: 48369 - protein, 482 aa, Lactobacillus johnsonii NCC 533
MKNIPVVMIIFGGSGDLAHRKLYPALFNLYQKGLIHDHFAVIGTARRPWSHEYLQEQVVEAVKESCDNFDEKEAKEFASHFYYQSHDVTDIGHYIALKELAAKLDEKYQAEGNRIFYMAMAPRFFGTIATHINDQKLLGSGFNRLVIEKPFGHDLASAEKLNREIGESFDEESVYRIDHYLGKEMVQNIMPLRMTNPIVKNIWNNDYIANMQVTLAESLGVGTRGGYYETSGALRDMVQNHIFQIITLLAMPEPKGLDSDHIHQAKQELLDSLVIPTPEMVKKHFSRGQYLADDNEVEYLKADQVALDSKVETFVAGEVKFKKGPVADVPIYFRTGKKMKDKVSRIDIVLHHMNNLYGSAHSNNISIIIDPISEIYFTINGKKITAEGLRRENLSYKFSKEEMEQVPDGYERLLHDVFVADRTNFTHWSELKQYWKFVDAVEDVWQDENKDVKQLEQYPSGKFGTESSNHIFEKDSEHWIYR

SEQ ID NO: 48370 - protein, 623 aa, Acidovorax sp. JS42
MRPYLRAQRMTASVVAALAVVTLAACSSPPAAFHYQVPQQPEGSSGYTEKPGWATERFAVAAANPLATDAGYQVLKAGGSALDAAIAVQMVLTLVEPQSSGIGGGAFLLHAAGSKVEAYDGRETAPAAATENLFIGANGKPMAFHDAVVGGRSVGVPGTVRMLEQAHKEHGKLAWATLFEPAIQLAEQGFKVSARLHTLLANEKFLAQDPVARAYFFDAAGQPWPVGHTLKNPELASVLRAIARNGSKALLEGEVAQAIVAKVQGHAGNPGGLSLADLAGYQPKKREALCSDYQIGAKAYRVCGFPPPSSGAIAVAQILGILKNTDATTMPLQEGPQGSADPLGPLPTADWLYLYNEAARLAFADRAQYVADPDFVRPPAGSWMSLLDPAYLASRARLIQPQSMKVAQPGTPGGAQTSMAPMPDQPEYGTSHISVVDARGNAVAMTTTIEDQFGSRQMVSTSSARSGGFLLNNELTDFSFAPRDAQGRPIANRVEPGKRPRSSMAPTLVFDKASGRLLMSGGSPGGALIIHYTAKTIYGIFNWGLTPQQAINLPNFGNLNGPTLLEEKRFTSTTIDNLRARGAEVREMNMTSGLQAITRSEVHGKPMWLGGADPRREGVVMGD

SEQ ID NO: 48371 - protein, 259 aa, Burkholderia mallei ATCC 23344
MNAPAPLKVFITGASSGLGLALAAEYARHGATLGLVARRADALAEFAPRFPKASISIYPADVRDADALALAASRFVAAHGCPDVVIANAGISKGAITGEGDLAAFREIMDVNYYGMIATFEPFIAPMTAARRGTLVGIASVAGVRGLPGSGAYSASKAAAIKYLEALRVELRPAQVAVVTIAPGYIRTPMTEHNPYPMPFLMDADRFAKRAALAISQKTAFRVIPWQMGIVAKLLHVMPRWLYDRLFEKAPRKPRAKAG

SEQ ID NO: 48372 - protein, 327 aa, Bifidobacterium longum NCC2705
MGRMSERNEHNDGNTQTAYFAGGCFWGLERYFQNVDGVTDTTVGYAQSTVESPTYEQVCAGGTDAAETVKVEFDPAQVSLRTLTLLFLEVIDPFSVDQQGEDRGRQYRTGMFYTDETQRAVYVAALEQLVDRQPQRPAVLVEPLRNFYPAEAHHQDYLVNNPGGYCHVPIAAIANVKRRQKYVERIWDLTLEQFAVTQNAATERPFVNEYDEEFEPGIYVDIVSGEPLFSSQDKFDSGCGWPAFSRPIAGDLLTEHEDHRIPGRDRIEVRTSDTQIHLGHVFTDGPADRGGLRYCMNSAALRFVPRSRMAEEGYGDWISVVDGDEQA

SEQ ID NO: 48373 - protein, 438 aa, Streptococcus agalactiae
MAIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLDKCGR

SEQ ID NO: 48374 - protein, 460 aa, Debaryomyces hansenii CBS767
MTVNTSADFASAELEIVQEQQLKEKIVNEEFKIWKKTVPLLYDTIHTHALDFPSLSLQWLPDYTVSENKNYVTVKFLFGTNTSQHSQDYLKLGSLSLPSTLAPDFSEFSPNSQSIPIPMSNIDSSDNFRILSSWKHNGEINKLRISPNNEKVITFDNEGVVHLYDLKSNNKEAIDFKYHKLEGYALEWIDENQFLSGANDSQIALWDVSKPSTPIQRFKSHNAVINDLSHNILEKSLFGSVADDYTYQIHDLRASFQDNPAIRIETSHIQNSFAFNPEIPTLFATGGKENVVSLYDLRNPSEPFRKLFGHNDSVIGIEWNKNNDPNKLISWGLDKRAISWDLSYLSDEFIYPTNEPTEASKKRYTKNVDPCLAFIHGGHTNRINEVDIHPKINGLTATCGDDNLIEIWKSKTIQLENDEDEDEEEEEDAEKAPSPVENDNEKSKTGAPNNLENEDTEMKD

SEQ ID NO: 48375 - protein, 271 aa, Arabidopsis thaliana
MADNHSLDQFLAAAIDAAKKAGQIIRKGFYETKHVEHKSQVDLVTETDKGCEELVFNHLKQLFPNHKFIGEETTAAFGVTELTDEPTWIVDPLDGTTNFVHGFPFVCVSIGLTIGKVPVVGVVYNPIMEELFTGVQGKGAFLNGKRIKVSAQSELLTALLVTEAGTKRDKATLDDTTNRINSLLTKVRSLRMSGSCALDLCGVACGRVDIFYELGFGGPWDIAAGIVIVKEAGGLIFDPSGKDLDITSQRIAASNASLKELFAEALRLTGA

SEQ ID NO: 48376 - protein, 289 aa, Samanea saman
MEGKEQDVSLGANKFSERQPIGTAAQSQDDGKDYQEPPPAPLFEPSELTSWSFYRAGIAEFVATFLFLYITILTVMGVSRSDSKCKTVGIQGIAWAFGGMIFALVYCTAGISGGHINPAVTFGLFLGRKLSLTRTIFYIVMQCLGAICGAGVVKGFEGKKLYGDNGGGVNYVHSGYTKGDGLGAEIVGTFILVYTVFSATDAKRSARDSHVPILAPLPIGFAVFLVHLATIPITGTGINPARSLGAAIIFNKHLGWHEHWVFWVGPFIGAALAALYHVVVIRAIPFKSK

SEQ ID NO: 48377 - protein, 211 aa, Oryza sativa Indica Group
MYICMLVCAAKRNIVSTVNLDCKLDLKAIALQARNAEYNPKTQHEVLGDFVTICNIRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQCVLYKYRNNT

SEQ ID NO: 48378 - protein, 265 aa, Aquifex aeolicus VF5
MHAIILTMRVGIVGFGNMGQAFALCFSKKLGKENIIVTDKVQEKRNLATEMGIAFASDVKFLADNSDVVLVAVKPKDSQEVLQKLKDYKGIILSIMAGVSIEKMEKILGKDKKIVRVMPNVNVAVGSGVMAITDNGNLSEEERSKVEELLLSCGTLYRIEERLFDAFTALAGSGPAFVFSFIDALALAGVHQGFSYEQALRIALDTVMGSAKLLKEFQVNPNELIAKVTSPGGTTIEGIKYLEEKGFKGTVMECINRTSQKAKKL

SEQ ID NO: 48379 - protein, 430 aa, Xanthomonas campestris pv. campestris str. ATCC 33913
MTTIAKILAREILDSRGNPTLEAEVTLADGSFGRAAVPSGASTGTKEAVELRDGDKTRYLGKGVRKAVENVNGTIAETLKDFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTDRVGKKVQLVGDDLFVTNPKIFKEGIDSGTANAILIKVNQIGTLTETLEAIAMAHAANYASIVSHRSGETEDTTIADIAVATTATQIKTGSLCRSDRVAKYNQLLRIEQALGSGARYAGRDAFVSLKR

SEQ ID NO: 48380 - protein, 287 aa, Samanea saman
MAKDVEVAERGSYSAKDYHDPPPAPLIDAEELGKWSFYRALIAEFIATLLFLYITVLTVIGYKSQSDTKAGGDVCGGVGILGIAWAFGGMIFILVYCTAGISGGHINPAVTFGLFLARKVSLIRAILYMVAQCLGAICGVGLVKAFQKAYYSRYGGGANTLSDGYSTGTGLGAEIIGTFVLVYTVFSATDPKRSARDSHVPVLAPLPIGFAVFMVHLATIPVTGTGINPARSLGAAVIFNQQKAWDDHWIFWVGPFIGAAIAAFYHQFILRAGAAKALGSFRSNPSV

SEQ ID NO: 48381 - protein, 354 aa, Thermococcus kodakarensis KOD1
MLRCSRCGKTYPETFMLKCDCGGTLFVEREYFDFFGSLMPYLDARRYINFLPVSGNLLPPPVPAITPTVELQVGPVTALFKLDYLQPSGSFKDRGTWVTVAKLMEEGVSEVVIDSSGNAALSFALYSLPARIRVHTFVSYDAMPAKISLLQRLGAVIHFVDGDRMEVHKEAIEFAKREGITYVTHWLNPYFIEGTKLIAYETYEQVGVPDYAFAPTGSGTLFLGLWKGFRELREMGEINEAPRLVAVQAEGYESLCERSVMKNRLADGIAIPEPPRKEDMLRALEESNGLCVSVGEAETREALEWLINAGFLVEPTSAVVLAGMWKLVDSGEIPEGSKVLLPLSGSGLKITEGI

SEQ ID NO: 48382 - protein, 462 aa, Nocardioides sp. JS614
MNSLLDLIGNTPLLRLSTSMGSLNGAKGPIVLAKVEYLNPGGSVKDRIATRMIEAAEASGELQPGGTIVEPTSGNTGVGLAMVAQAKGYRCVFVCPDKVSEDKRNVLKAYGAEVVVCPTAVEPEHPDSYYNVSDRLASQPGAWKPDQYSNPHNPRSHYETTGPEIWAQTEGRVTHFVAGVGTGGTISGTGRYLKEQNSSVQVIGADPAGSVYSGGTGRPYLVEGVGEDFWPEAYDRDVADRIIEVSDADSFAMTRRLAREEALLVGGSSGMAVHAAVQLAHELAGTPEGEDAVIVVLLPDSGRGYLTKVFNDDWLAQYGFPVDGAERSVQSVGEVLRGKSGRLPDLVHTHPNETIAEAVAILQEYNVSQMPVVRAEPPVVAAEVVGSVSERTLLDLLFTGSAKLTDSVGEHMAPPLPTIGSTEPASEAVAALEGADALLVHEDGKPVGVVTRHDLLAYLARG

SEQ ID NO: 48383 - protein, 467 aa, Leptospira interrogans serovar Copenhageni str. Fiocruz L1-130
MNKGKIKQIIGSVLDIEFENGELPEIYNALEIETNVSGKKETIIAEVQTHIGGKAVRAIALSSTDGLIRGQEVSNTGKPISVPVGDATLGRIFNVLGKTIDEGPAITVKETRPIHRAAPSFDELTSKTEVFETGIKVIDLLAPYIKGGKTGLFGGAGVGKTVLIQELINNIAKQHGGFSVFAGVGERTREGNDLWREMKESGVIDKTVLCYGQMNEPPGARLRVALSALTMAEHFRDSIGTDVLLFVDNIFRFSQAGSEVSALLGRMPSAVGYQPTLSTEMGALQERITSTKKGSITSVQAIYVPADDLTDPAPANAFAHLDATTVLSRAISDKGIYPAVDPLDSTSRVMNAQVLGEEHYLVAREVQRILQRYKDLQDIIAILGMDELSEDDKVLVARARKIEKFLSQPFHVAEVFTGAPGKYVKLADTVRSFKEVISGNYDHLPEQAFYMVGSIDDAIEKAKGYKG

SEQ ID NO: 48384 - protein, 163 aa, Xanthomonas campestris pv. campestris str. ATCC 33913
MSFNFRIGQGYDVHAFGPGDHLMLGGVRMAHSHGVLAHSDGDVVLHALCDAMLGGLALGDIGVHFPPSDARWKGADSAQFVQHCDQLLRDRGWRVGNADITVICERPKVGPHALAMRERIAGLLAIELDAVSVKATTSEKLGFTGRSEGIAAQAAVLLGKIAA

SEQ ID NO: 48385 - protein, 293 aa, Oryza sativa Japonica Group
MSKIGQPSKASCSQGENGPSQIERVSTSDEARKSCTLFQGHSGPVYSAMFSPIGDFLLSSSADSTIRLWNTKLNANLVCYKGHNYPVWDVQFSPVGHYFASASHDRTARIWSMDKIQPLRIMAGHLSDVDCVQWHVNCNYIATGSSDKTVRLWDVQTGECIRMFIGHRSMVLSLAMSPDGRYMASGDEDGTIMMWDISSGRCVSPLVGHNSCVWSLAYSCEGALLASGSADCTVKLWDVASSTKTLKMDDTKGGSANRLRMLKALPTKSTPVYTLQFSRRNLLFAAGAPSLGS

SEQ ID NO: 48386 - protein, 491 aa, Mycobacterium sp. JLS
MTQTVQEHKTTWDKLFIGGQWVAPSTSDVIEVFSPATGQKVGQVPLAAEADVNAACAAARKAFDEGPWPRMSPDERAAVLGAAVKLMEERGAELKYLLAAETGQPQTIVDMMQYGAAMSSFTYFAGAADKFQWSEIRDGIYGQTLVTREPIGVVGAITAWNVPFFLAANKLGPALLAGCTVVLKPAAETPLSVFAMAQMFAEAGLPEGVLSVVPGGAETGRALTANPEIDKYTFTGSSAVGKEIGKLAAEKLKPCTLELGGKSAAIVLEDADLDSTLPMLAFSGVMNSGQACVAQTRILAPRSRYDEVVEKLANFVSAMPVGLPDDPNAAIGPLISEKQRERVESYIKKGTEEGARIVTGGSRPEGLDSGWFVQPTVFADVDNSMTIAQEEIFGPVLAVIPYETEDDAIRIANDSVYGLAGSVWTTDNKKALEVASKIRTGTYAVNMYAFDPGAPFGGYKNSGIGRENGPEGIEQYCQAKSTLLPFGYTPE

SEQ ID NO: 48387 - protein, 496 aa, Vitis vinifera
MELNTFLLLCMPLILCFFLLQFLRPSSHATKLPPGPTGLPILGSLLEIGKLPHRSLARLAKIHGPLITLRLGSITTVVASSPQTAKLILQTHGQNFLDRPAPEALDSPQGTIGWIPADHVWRSRRRVCINHLFTSQSLDSLQHLRYKKVEQLLQHIRKHCVSGTPVDIGLLTSAINLNVLSNAIFSVDLVDPGFESAQDFRDQVWGIMEGAGKFNISDYFPMFRRFDLLGVKRDTFSSYKRLYEIVGGIIKSRIKCRASNPMSRNDDFLDVILDQCEEDGSVFNSDNIQVLIVELFYAGSDTSTITTEWAMTELLRNPRLMQKVRQELSEVIGAGQMVRESDMDRLPYFQAVVKETLRLHPAGPLLLPFKAKNDVELCGFTIPSNSHVIVNMWAIARDPSYWEDPSSFLPERFLGSKIDYRGQDYEYIPFGAGRRICPGIPLAIRMVQLVLASIIHSFNWKLPEGITPLTIDMQEKCGATLKKAIPLSAIPFIEEN

SEQ ID NO: 48388 - protein, 263 aa, Acidovorax sp. JS42
MLARLRSDVQCILERDPAARSTWEVITCYPGLHAIWLHRPAHWCWTNGFKWLGRFISHFARWFTGIEIHPGAKIGERVFFDHAMGVVVGETAEIGDGCTIYQGVTLGGTSLYKGTKRHPTLGKNVVVSAGAKVLGGFEVGDGAKIGSNAVVIKPVPAGATAVGIPARIIPSKEGQSADVTEPHKPEEAKFSAYGVTSLQDDPLTQAMRGLIDSAATQEHQISLLWQAIEKLSRSTPQSGGCVPDEAVRCEQFQAAKLNDIIGK

SEQ ID NO: 48389 - protein, 123 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTEKKSKFGANAILAVSLANAKAAA

SEQ ID NO: 48390 - protein, 529 aa, Thermosynechococcus elongatus BP-1
MDALALWQHYQDWLYYHPELEFYVDVSRMGLTPEVVHRLEPAFERAFEQMKELEAGAIANPDEGRMVGHYWLRDPDLAPSPELRSQIRDAIAQVKQFSQQVHSGAIAPPQGGHFTEILSIGIGGSALGPQFVAAALAPVHPPLNIHFLDNTDPAGFERVFAELGDRLRTTLVLVISKSGGTPETRNGMLEAQARFQRAGLAFADHAVAVTLPGSGLAQVAESNGWLAIFPMFDWVGGRTSELSTVGLLPAALQGIDIDDLLMGAKLMDQATRVPNIRQNPAALLALAWHHAGKGRGEKDMVILPYKDSLLLFSRYLQQLVMESLGKETDLNGNIVHQGIAVYGNKGTTDQHAYVQQLRDGLPNFFVTFIEVLRDGQEPSIEVEPGITAGDYLSGLLLGTRQALYEKNRPSLTVTIPEVTPKTVGALIALYERAVGLYGFLVNINAYHQPGVEAGKKAAAANLALQRQIVKVLEQSDEPLDLGAIAGAINAPDQLERIYLILRHLAANDRGIEQLGDPAQPSQLQFRWQR

SEQ ID NO: 48391 - protein, 366 aa, Acidovorax sp. JS42
MTAMMKAAVFVEKGRIELADKPIPDVGPNDALVRITTTTICGTDVHILKGEYPVAKGLTVGHEPVGVIEKLGSAVQGYQEGQRVIAGAICPNFNSYAAQDGYPSQDGSYLVPRGLCGCHGYKATAGWRFGNLIDGTQAEYVLVPDAQANLAPIPDGLTDEQVLMCPDIMSTGFKGAENANIKIGDTVVVFAQGPIGLCATAGARLLGATTIIAVDGNDDRLAVAKKMGADVTLNFRNVDVVEEVMKLTGGKGADGSIEALGTQATFAQAMKVLKPGGTLSSLGVYSEDLSIPLAQFAAGLGDHTIRTALCPGGKERMRRLMNVIAANRLDLGLLVTHQRKLDDIVEAYDLFAHQRDGVLKIAIKPH

SEQ ID NO: 48392 - protein, 548 aa, Acidovorax sp. JS42
MLPTDRPAASSRPRAGHTFLAGLAIAGLLVPEAVAYAAIAGVPPAHALVAALVGLLVYPFIGTSRFATLSVTSSAAAIFASVVAAEGTGGAFALVGVTGGLFIVAALARADFLAAFVSRPVLRGFAWALAVTIVVKQLPGLTGVPAQGTHTPGLLWDWLGGLGNAQGLTAALGCGALALWLALQRAQARHAWVQPSVLVLALGIALSAALPLAAHGVVLVGPVTLQGLQWGWPRLDWDHWVRAAQVAPALMMILFAESWGSARSLALQAGDRVHARREMLALGAANIGSSLLQGLPVGAGFSASSANYEAGGRSRWTGLVAAAAIALALGLAQGALALVPQPVLCAVVIGILSHKLGPRPLWATLRWNGDAWMALAAAAGVLVLGVLFGMLLAVGLSLLLALRRFAQPAASELGRLPGTHDFVALKLHPHAQRTPGVLVLRPDEPLFFANAEAMAHIVATHAGAQGVRAVVLSVESSDDMDVTTLEALQELQAHLARRGLALLLARIKDHPRAALQRAGLTHIPLFWSVDDAVGAAQGMAIPEQSTQP

SEQ ID NO: 48393 - protein, 103 aa, Lactobacillus johnsonii NCC 533
MVDEITDATFEEETSEGVVLIDFWATWCGPCKMQSPVIDQLSEEMDDVKFTKMDVDQNQETARNLGIMAIPTLLIKKDGKIVDRLTGYTPKEKLEQILDQYTD

SEQ ID NO: 48394 - protein, 730 aa, Chlamydomonas reinhardtii
MEAKSRQWSPEDPEGNIILTVAENRISSDIVRERLSQAAADFPEEALTYQGLARLLERTFMKGISVDPDQLSVSAGAGAVIENLFHCIAGPGDIVLIPAPYYPAFDNDLQVKCGVVPWPFHLDEDRPLGPQLNAAAEAAAAGSNGAPESGSESNGSRRPRVAALLYTSPNNPLGTMYRRDTVVELLRDEIYGNSVFGEGASFTSAEVIARQEAAGLPHPARLPDLLHVVWGLSKDFCASGLRVGCLHSRNTQLNKALDNLGYFCAVANPVQWGLAAALADGDWLRHFLDTNRARMAAAYGQLEAALNEAGIPHVKADSAMFCWVDLRAWLPAPTWEGEAALWEEMCTACRVLLTPGEQCHAAEPGFFRVCWAWMPGDSLPVAVRRLAAHFGAKKDKEDKAHASAGAASSKGLSLTISPGKARPLGLSAAPAAGANVIRGGRSSGRDGFVYVPRSYHPGRPSPLAVMLHGAGGRADPQSGNWSFGGLQALEESRLIVVVPESAGRTWDAVRGGAFGPDVAGLDAALAAVFGAYAVDPGRVALAGHSDGASYALSLGLGNPQLFTHLVAFSPGFMRPPPAAAAWLDAAVAAAAAVAGTAATASAVGNSTTARLALPTPEAGGSTPGATDAAQAAAKAQAQAQERVMAETATLTTAKPLGVSAVAPAKAAAALETVARQADEILPVRCSHRIVSRLRAAGLDVVYKEFHGLHVLTRDTAATGLEFILEPAAVA

SEQ ID NO: 48395 - protein, 527 aa, Pseudomonas putida
ASVHGTTYELLRRQGIDTVFGNPGSNELPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 48396 - protein, 479 aa, Dialypetalanthus fuscescens
STLEKKNLGRIVQIIGPVLDVAFPPGKMPNIYNALVVKGRDTVGQPINVTCEVQQLLGNNRVRAVAMSATDGLTRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLE

SEQ ID NO: 48397 - protein, 187 aa, Chlamydomonas reinhardtii
MASMTASLRSSTLASTSAPSAVRPVMGSRARSVRVHASDAFCRDKVSAVRGVESKGISYKVTFVGADGETREISCPDNQYILDAAEAQGLDLPATCRGGICGACVARVAKGTIDPSDIADLTFTLDEEEQAKGMALLCMTRATSDLTLETQSDWGYSLGVGEWKGATGKFSSRPEPTMGKGWAELQK

SEQ ID NO: 48398 - protein, 358 aa, Oryza sativa
  misc_feature (28)..(28): Xaa can be any naturally occurring amino acid
MAEARTIGSISVPNVQELAGTCNGIDEXEIPERYIRPEVSSDEVIKNNHGDMSIPIIDLDKLISPQSSQEECVKLISACQYWGFFQLINHGVPDEVIANLKNDLVEFFSQPLDAKKEYSQLPNNLEGYGQAFVVSDNQKLDWADMLYLQVCPTDSRDLRFWPNYPASFRHSIDAYSSETENIGLCLLQFMAKAVGVEPKSLLSVFEGQARGLRMNYYPPCLKADKVLGLSPHTDPGGLTLLLQVNDVQGLQINKDGKWFSVNALNGALIVNIGDTLEILSNGKFRSVEHRAVVHPSRERISAALFYYPCQDMVISPLPDFVKDGKVKYKTISYQDLLTEYFTAELDGRNRLKKMKLEP

SEQ ID NO: 48399 - protein, 487 aa, Bacillus thuringiensis serovar konkukian str. 97-27
MVEKLKAEWFSNVRADILAGIVVALALIPEAIAFSIIAGVDPIVGLYASFCIVVIIAFVGGRPGMISAATGAMALLMVPLVKEHGLNYLLAATILTGVIQIIFGVCKVARLMKFIPRAVMIGFVNALAILIFMAQVPHFIGISNLTYVFVAITLAIVYIVPRFIKSIPAPLIAIVLLTAITIYMHLDLRTVGDLGAIKRTLPSFFIPDVPFTFETLQIILPYSIALAIVGLLESLLTASIVDDMTGTDSNKNQESRGQGIANVINGFFGGMAGCAMIGQSVINVKSGGRGRLSTLIAGLFLMFLIIVLGDLVVQIPMPVLVGIMIMVSIGTFDWSSFSYLVKAPRSDATVMLVTVIIVVATHDLSKGVIAGVLLSTIFFVAKISKIKVTKQQDGSNMRFDVDGQLFFASVEGFVESFDFNVKNRSIVIDFSNTHVWDDSAVGAIDKVVIKYQENQNIVTIKNLNSSSKKLVEKLAVYNNPNRKASSH

SEQ ID NO: 48400 - protein, 317 aa, Corynebacterium glutamicum ATCC 13032
MNDLIKDLGSEVRANVLAEALPWLQHFRDKIVVVKYGGNAMVDDDLKAAFAADMVFLRTVGAKPVVVHGGGPQISEMLNRVGLQGEFKGGFRVTTPEVMDIVRMVLFGQVGRDLVGLINSHGPYAVGTSGEDAGLFTAQKRMVNIDGVPTDIGLVGDIINVDASSLMDIIEAGRIPVVSTIAPGEDGQIYNINADTAAGALAAAIGAERLLVLTNVEGLYTDWPDKSSLVSKIKATELEAILPGLDSGMIPKMESCLNAVRGGVSAAHVIDGRIAHSVLLELLTMGGIGTMVLPDVFDRENYPEGTVFRKDDKDGEL

SEQ ID NO: 48401 - protein, 151 aa, Zea mays
MASEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 48402 - protein, 391 aa, Corynebacterium glutamicum ATCC 13032
MSTLETWPQVIINTYGTPPVELVSGKGATVTDDQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLKAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVARKGELFKELLAKVDGVVDVRGRGLMLGVVLERDVAKQAVLDGFKHGVILNAPADNIIRLTPPLVITDEEIADAVKAIAETIA

SEQ ID NO: 48403 - protein, 319 aa, Corynebacterium glutamicum ATCC 13032
MTSQPQVRHFLADDDLTPAEQAEVLTLAAKLKAAPFSERPLEGPKSVAVLFDKTSTRTRFSFDAGIAHLGGHAIVVDSGSSQMGKGESLQDTAAVLSRYVEAIVWRTYAHSNFHAMAETSTVPLVNSLSDDLHPCQILADLQTIVENLSPEEGPAGLKGKKAVYLGDGDNNMANSYMIGFATAGMDISIIAPEGFQPRAEFVERAEKRGQETGAKVVVTDSLDEVAGADVVITDTWVSMGMENDGIDRTTPFVPYQVNDEVMAKANDGAIFLHCLPAYRGKEVAASVIDGPASKVFDEAENRLHAQKALLVWLLANQPR

SEQ ID NO: 48404 - protein, 453 aa, Aquifex aeolicus VF5
MWELDPKTLEKWDKEYFWHPFTQMKVYREEENLIFERGEGVYLWDIYGRKYIDAISSLWCNVHGHNHPKLNNAVMKQLCKVAHTTTLGSSNVPAILLAKKLVEISPEGLNKVFYSEDGAEAVEIAIKMAYHYWKNKGVKGKNVFITLSEAYHGDTVGAVSVGGIELFHGTYKDLLFKTIKLPSPYLYCKEKYGELCPECTADLLKQLEDILKSREDIVAVIMEAGIQAAAGMLPFPPGFLKGVRELTKKYDTLMIVDEVATGFGRTGTMFYCEQEGVSPDFMCLGKGITGGYLPLAATLTTDEVFNAFLGEFGEAKHFYHGHTYTGNNLACSVALANLEVFEEERTLEKLQPKIKLLKERLQEFWELKHVGDVRQLGFMAGIELVKDKEKGEPFPYGERTGFKVAYKCREKGVFLRPLGDVMVLMMPLVIEEDEMNYVIDTLKWAIKELEKEV

SEQ ID NO: 48405 - protein, 478 aa, Durio zibethinus
  misc_feature (6)..(6): Xaa can be any naturally occurring amino acid
  misc_feature (60)..(60): Xaa can be any naturally occurring amino acid
STLEKXNLGRISQIIGPVLDVAFPPGKMPNIYNALVVKGRDTIGQQINVSCEVQQLLGNXRVRAVAMSATDGLMRGMEVINTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNKQNVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGKEHYETAQRVKQTLQRYKELQDIIAILGLDEVSEEDRLTVARARKIERFLSQPFFVAEVFTGSPGKYVGLAETIRGFQLILSGELDGLPEQAFYLVGNIDEATAKATNL

SEQ ID NO: 48406 - protein, 313 aa, Arabidopsis thaliana
MEAQIHILEQEAYSAVLRAFQAQADEFSWDKATVMTNLRKELRISDDENRQLLNNVHNDDLIKRIRDSRPRGGNQVVRHQSLDVHPSPTFSASRKKQKTFQSYPSIGSTRSKSFNNRVVSANEPAEALIGRKVWTKWPEDNSFYEAVVTQYNANEGRHALVYDINTVNETWEWVDLNEIPTKDIRWDGEEDGVTLNVGHGGGTTRGNRRTLSHGGRGRGPRTQPRREHLATENGGGRKFFGEIELFNTDSLVKEVERVFDSNLPDPHELDKAKKLLKEHEQALIAAIARLTDASDYESDGEEPYSHELPMLLG

SEQ ID NO: 48407 - protein, 448 aa, Burkholderia mallei ATCC 23344
MSTHATDDWVARSLRAVWHPCTQMKHHERLPLIPVARGERAWLFDRAGNRYLDAISSWWVNLFGHANPRINAALKQQLDTLEHAMLAGCTHESAIELAERLAARTQHTLGHAFFASDGASAVEIALKMSFHAWRNRGRGDKREFVCIANGYHGETIGALGVTDVALFKDAYDPLIRAAHVVASPDARGARDGETAADVAARALGDVRRLFAERGEKIAALIVEPLVQCAAGFAMHDPSYVRGLRALCDAHDVHLIADEIAVGCGRTGTFFACEQAHVWPDFLCLSKGISGGYLPLSLVLSRDAIFDAFYDDDVTRGFLHSHSYTGNPLACRAAVATLELFDTDDVLAENARKSALMREALAPLASHPHVRHLRERGTIFAFDVALEGDAARTFPRRFFEHALARETLLRPIGTTVYLMPPYILDEGEIEWLASRTRATLDATLSEAHA

SEQ ID NO: 48408 - protein, 393 aa, Arabidopsis thaliana
MITDLPKDLIEEILSRVSMTSMRVVRLTCKSWNTLSNSESFKKMHIGKVTSTREGESRVIMLIDYNLFLMSAVLMDDVDPSIEFKGKLSCLKEQVKISQVFHCEGLLLCILKDDTRIVVWNPYRQETRWIIPRYSHRPYVMNNIRYALGYENNKSGRSLKLLRFIDYCYTEKHICWHEIYDFDSDLWTTLDVTPHWYILSNWSCVQGVSLKGNTYWCAREENSDGYNHIICFDFTRERFGPLLPLPVNVIDNEYEYVTSSCVREGKIAALFQHNDSYPYELEIWITTKIEAEMVSWNKFLRIDIEPNNNIMVPFIYGGFFIDEEKKKVALGFDEEFGRKTFNIIGEDGYFREFDRITFNIIEEAGERAGVNCGSYVCSYVPSLVRIKKPDSKQ

SEQ ID NO: 48409 - protein, 571 aa, Karenia brevis
MRSSLLVLTCAFCVGHARRVQTPNFQQQVKQVAEQMAANGEKLDVKSLATLLLASSPSSAFVASGAGAHLPTSNRHDGIRMSTNPDAPIKLGVNGFGRIGRQVVRIAMDRDAFVLKHINSPMSPEYMKYLLNHDTVHGRFDGTVEISDDGLIINGLPVSLSATRDPTEIPWKSAGVEYVCESTGAFTTTEGCLKHIESGAKKVIISAPAKDADTPTIVVGVNTDDYKTDMQVVSCASCTTNGLAPLVKVVHENYGIKEGLMTTVHAMTATQLTVDGPSRGGKDWRGGRCASQNIIPSSTGAAKAVAKAYPVMKGKLTGMAFRVPTVDVSVVDLTCELEKETTYDDIKAEVKLASETYAKGVVGYTEDQVVSSDFIGETCSTVFDAEAGIMLTPTFVKLVSWYDNEWGYSTRLVDLVGLMAAADGVTTKEKALAYFTARAVEDTRQSKRSGDVRMEDWAQAMEEADEKLKKVIAAVLDVSESKIVPDATFESLGVQQDEIDPDEMFNPKWLDIIMTLEEELDLEVVPSRYFDMKTVGSLIDYYVETTKDKLDEKEGMSPWYGEGEGPPPEML

SEQ ID NO: 48410 - protein, 248 aa, Triticum aestivum
QPCRCIQPFQLQSSRAQGPPFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 48411 - protein, 468 aa, Escherichia coli
MSKQQIGVVGMAVMGRNLALNIESRGYTVSIFNRSREKTEEVIAENPGKKLDPYFTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCFTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKSVSYAQGFSQLRAASEEYNWALNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 48412 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGAPCVTYIGADGAGHYVKMVHNGIEYGDMQLIVEAYSLLKGGLNLSNEELAQTFTEWNNGELSSYLIDITKDIFTKKDEDGNYLVDVILDEAANKGTGKWTSQSALDLGEPVSLITESVFARYISSLKDQRVAASKVLSGRQAQPAGDKAEFIEKVRRALYLGKIVSYAQGFSQLRAASEEYNWDLNYGEIAKIFRAGCIIRARFLQKTTDAYAENPQIANLLLAPYFKQIADDYQQALRDVVAYAVQNGIPVPTFAAAVAYYDSYRAAVLPANLIQAQRDYFGAHTYKRIDKAGVFHTEWLD

SEQ ID NO: 48413 - protein, 593 aa, Arabidopsis thaliana
MFQNMKEMEFFTEYGDANRYRILEVIGKGSYGVVCAAIDTQTGEKVAIKKINDVFEHVSDALRILREVKLLRLLRHPDIVEIKSIMLPPSKREFKDIYVVFELMESDLHQVIKANDDLTREHHQFFLYQMLRALKYMHTANVYHRDLKPKNILANANCKLKVCDFGLARVSFNDTPTTVFWTDYVATRWYRAPELCGSFCSKYTPAIDIWSIGCIFAEVLTGKPLFPGKSVVHQLDLITDLLGTPKSETIAGVRNEKARKYLNEMRKKNLVPFSQKFPNADPLALRLLQRLLAFDPKDRPTAAEALADPYFKCLAKVEREPSCQPISKMEFEFERRRLTKDDIRELIYREILEYHPQLLKDYMNSEGSSFLYPSAIGHLRKQFAYLEENSGKSGPVIPPDRKHASLPRSAVHSSAVNSNAQPSLNASDSRRVSIEPSRNGVVPSTSAYSTKPLGPPPRVPSGKPGRVVESSVTYENDRNLKESSYDARTSYYRSTVLPPQTVSPNCYFLPNTMNQEKRSGTEAASQPKPQFVPTQCNSAKPAELNPNPYVQSQHKVGIDAKLLHAQSQYGPAGAAAVAVAAHRNIGAVGYGMS

SEQ ID NO: 48414 - protein, 322 aa, Escherichia coli
MRGSHHHHHHGSALPILLDCDPGHDDAIAIVLALASPELDVKAITSSAGNQTPEKTLRNVLRMLTLLNRTDIPVAGGAVKPLMRELIIADNVHGESGLDGPALPEPTFAPQNCTAVELMAKTLRESAEPVTIVSTGPQTNVALLLNSHPELHSKIARIVIMGGAMGLGNWTPAAEFNIYVDPEAAEIVFQSGIPVVMAGLDVTHKAQIHVEDTERFRAIGNPVSTIVAELLDFFLEYHKDEKWGFVGAPLHDPCTIAWLLKPELFTSVERWVGVETQGKYTQGMTVVDYYYLTGNKPNATVMVDVDRQGFVDLLADRLKFYA

SEQ ID NO: 48415 - protein, 100 aa, Arabidopsis thaliana
  misc_feature (76)..(76): Xaa can be any naturally occurring amino acid
RPRVRASSMLSSATMVASPGQGNKVAPFNGPKSSGAFPGNRKGNNDITSNISNGRRVNCMQVWPPIGKKKFETLSXLPDLNESELAKGIDQLIRNKLNPC

SEQ ID NO: 48416 - protein, 289 aa, Oryza sativa Japonica Group
MATPPEPSSWLSLKVFFLRVSRCEVNESMLDSVTVTHAPLTPDTVLEVSGGSVASNGHVSLRLDRAGGVGAAATEGGDSCTFVSTADVRVSGSARFDVQCRGERLVVGILDTRDAGAGGGGWVMKCQVAAQRGSGLVRRGSKEAKPPVVEVYVAGLARGAPVVFTRAMQLRFRRRRHVKAFMEPIPEHGEPAEDSKETLPPKHETEVSEYRCYKPEQDAGDADYDGFYVKPAGEEDDDGDFSWFTAGVRVGVGISVGICLGIGIGAGLLARSYHSTSRSLRSRLISSLF

SEQ ID NO: 48417 - protein, 816 aa, Solanum lycopersicum
MNIESEKEQFLKEFGSYYGYANSPKNIDEIRATEFKRLNDTVYLDHAGATLYSESQMEAVFKDLNSTLYGNPHSQSTCSLATEDIVGKARQQVLSFFNASPREYSCIFTSGATAALKLVGETFPWSSNSSFMYSMENHNSVLGIREYALSKGAAAFAVDIEDTHVGESESPQSNLKLTQHHIQRRNEGGVLKEGMTGNTYNLFAFPSECNFSGRKFDPNLIKIIKEGSERILESSQYSRGCWLVLIDAAKGCATNPPNLSMFKADFVVFSFYKLFGYPTGLGALIVRKDAAKLMKKTYFSGGTVTAAIADVDFFKRREGVEEFFEDGTISFLSITAIQHGFKIINMLTTSSIFRHTTSIAAYVRNKLLALKHENGEFVCTLYGLLSSEMGPTVSFNMKRPDGTWYGYREVEKLATLAGIQLRTGCFCNPGACAKYLGLSHLDLLSNIEAGHVCWDDRDILHGKPTGAVRVSFGYMSTFEDAMKFVNFVESNFVISSFNRCALQPRSISLPIEGIAEAAARHFLTSITVYPIKSCAGFSVDQWPLTSTGLLHDREWILKSTTGEILTQKKVPEMCYISTLIDLNLGKLFVESPRCKEKLQIELKSSSLVTERDEMDIQNHRYEVTSYNNEVDIWFSRAIDRPCTLLRNSDSQSHSCINKNGSPGMCRDVGARLNFVNEAQFLLISEESIKDLNSRLKSNGRRRNGGQAVQVGVMRFRPNLVASSGEPYAEDGWSNINIGGKYFMSLGGCNRCQMININPEAGEVQRFTEPLATLAGYRRAKGKIMFGILLRYENNTKTESDTWIRVGEEIIPNGDRH

SEQ ID NO: 48418 - protein, 475 aa, Chamerion angustifolium
  misc_feature (4)..(4): Xaa can be any naturally occurring amino acid
EKKXLGRIAQIIGPVLDVSFPPGKMPNIYNALVVKGRDTVGQEINVTCEVQQLLGNNRVRAVAMSATDGLTRGMEVIDTGGPLSVPVGGATLGRIFNVLGEPVDELGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGDDHYETAQRVKETLQRYKELQDIISILGLDELSEEDRLTVARARKIERFLSQPFFVAEVFTGSPGKYVGLAETIRGFKLILSGELDGLPEQAFYLVGNIDEATAKAANL

SEQ ID NO: 48419 - protein, 517 aa, Candida albicans
MKNFNALSRLSILSKQLSFNNTNSSIARGDIGLIGLAVMGQNLILNMADHGYTVVAYNRTTAKVDRFLENEAKGKSILGAHSIKELVDQLKRPRRIMLLVKAGAPVDEFINQLLPYLEEGDIIIDGGNSHFPDSNRRYEELAKKGILFVGSGVSGGEEGARTGPSLMPGGNEKAWPHIKEIFQDVAAKSDGEPCCDWVGDAGAGHYVKMVHNGIEYGDMQLICEAYDLMKRVGKFEDKEIGDVFATWNKGVLDSFLIEITRDILYYNDPTDGKPLVEKILDTAGQKGTGKWTAVNALDLGIPVTLIGEAVFSRCLSAMKAERVEASKALKGPQVTGESPITDKKQFIDDLEQALYASKIISYTQGFMLMNQAAKDYGWKLNNAGIALMWRGGCIIRSVFLAEITAAYRKKPDLENLLLYPFFNDAITKAQSGWRASVGKAIQYGIPTPAFSTALAFYDGLRSERLPANLLQAQRDYFGAHTFKVLPGQENELLKKDEWIHINWTGRGGDVSSTTYDA

SEQ ID NO: 48420 - protein, 719 aa, Zea mays
FWFIASVLPPPSPPLAPPLPSPLLSSLPEPNQTPPTPTPRFSECCTSVSPYRGRQKSDLSAVSGGHTAARLTNPPRIEPQTPAVPARGPQAGPGRSMGSRSAGAALRLWLLALLLGCCQGRFVVEKNSLKVTAPDGLKGTYECAIGNFGVPQYGGTMVGFVAYPKANRKACKSFDDFDISYKAKPGAFPTFLLVDRGDCYFAKKAWNAQKAGAAAILVADDKDEPLITMDNPEEGGNTDYLENITIPSALITKSFGDRLKKAIDSGDMVNVNLDWREALPHPDERVEYEFWTNSNDECGPKCDSQIDFVKSFKGAAQVLEKKGYTEFTPHYITWYCPEAFILSKQCKSQCINHGRYCAPDPEQDFSKGYDGKDVVVQNLRQVCVFKVAKEHKKPWLWWDYVTDFAIRCPMKEKKYTKECADGVIKSLGLDHKAIDKCIGDPDADEENHVLKAEQDAQIGKGSRGDVTILPTLVINNRQYRGKLDKGAVLKALCAGFRETTEPAVCLSDDIQTNECLENNGGCWQDKAANIIACKDTFRGRVCECPVVKGVKFVGDGYTHCEASGSGRCEINNGGCWKDTKNGRTYSACTDDGCRCPDGFKGDGKHKCEDVDECKERTVCQCEECRCKNTWGSYECGCSGGLLYMKEHDTCISKNGASEAGWGFLWAVVFGLVAAGIAGYAVYKYRIRRYMDSEIRAIMAQYMPLDSQGDVQSHAHHIEM

SEQ ID NO: 48421 - protein, 231 aa, Arabidopsis thaliana
MATSSTQLLLSSSSLFHSQITKKPFLLPATKIGVWRPKKSLSLSCRPSASVSAASSAVDVNESVTSEKPTKTLPFRIGHGFDLHRLEPGYPLIIGGIDIPHDRGCEAHSDGDVLLHCVVDAILGALGLPDIGQIFPDSDPKWKGAASSVFIKEAVRLMDEAGYEIANLDATLILQRPKISPHKETIRSNLSKLLGADPSVVNLKAKTHEKVDSLGENRSIAAHTVILLMKK

SEQ ID NO: 48422 - protein, 386 aa, Gossypium hirsutum
MDQVQHPSVMQKVAGQLFRSSHSQDFQGYNGSFRSPALYQRRAAYGNYSNAALQHPVRAFGDLSMVPSTASAICVQAPAEKGFSSFAIDFLMGGVSAAVSKTAAAPIERVKLLIQNQDEMIKSGRLSEPYKGIGDCFKRTIKDEGFGSLWRGNTANVIRYFPTQALNFAFKDYFKRLFNFKKDRDGYWKWFAGNLASGGAAGASSLLFVYSLDYARTRLANDAKAAKKGGERQFNGLVDVYRKTLKSDGIAGLYRGFNISCVGIIVYRGLYFGMYDSLKPVLLTGSMQDSFFASFVLGWLITNGAALASYPIDTVRRRMMMTSGKAVKYKSSLDAFSQILKNEGGKSLFKGAGSNILRAIAGAGVLAGYDKLQLIVFGKKYGSGGA

SEQ ID NO: 48423 - protein, 585 aa, Bordetella bronchiseptica RB50
MSVDAFATGQSATSTYTAHRPVIAANRHAVSSGHYLASHAAFQILESGGNAVDAGVAAGLVLGVVHSDQVNIAGVAPMMIYLAAEDRVITIDGLGSWPAAASCERFEREFGGVVPEGLLRTVIPAAPGAWITALQRYGTRSFAEVAQYAIRFAREGFIMYPFLADRLQEAEAKYRRWPSNAAIYLPGGRPPRVGERFVQSDLAASLQYMADQETATAGSRVRKLQAARDAFYQGDIASKIVAFHQENGGLLTAADLAGYAPTIEAPLSTRYGDMDVYACNFWCQGPALLQALNILKSFDLKEMGHNSTRYIHHVAEALKLTFADREHYYADPRFIDVPAQTLLSDAYARQRAQLVRADRAWPEMPPCGEIAGYETLRAIHGNISREIDPPLDTSYVCVVDRYGNAFSATPSDVSSDTIVIPGTGLCPSSRGSQSRADASHPASLAPGKRPRLTPNPAMAIQRGKRILPLGSPGGDSQVQAMLQVLLNITLFGMDPQTAIEAPRFISYSHPDSFAPHAYYPGRLSVEGRIPAQTEQTLAALGHDMQRWPDWLWRAGGVCAIDADLEQGIYQAGADPRRAAAYALGW

SEQ ID NO: 48424 - protein, 316 aa, Bifidobacterium longum NCC2705
MKLIEGQLIHRRYRLDSRLAQGGMGEVWKGYDIQLGREVAIKALRSDVTNAEAKLRRLRAEAHNSANLAHPNIAALFEYYEHDGIGFLIMEYVPSKSLADLFHSKGAMDPIELLPILIQTARGLFVAHSHGVIHRDVKPANIMVSDTGEVKITDFGVSYSTGQGQITQDGMVVGTAQYISPEQAQGQQATPQSDIYSLGVVAYEGLAGHRPFTGTTPVDIAAAHVNNPVPPLPDSVDVQLREFVMSMLAKDPLDRPKDALVVSRTLARIERRLLDQQTEMANTAMATSGNRLPRRVTSTPRIVLEAPASRLGGNKQ

SEQ ID NO: 48425 - protein, 356 aa, Methanopyrus kandleri AV19
MNVDAVVLAGGFGTRLRPLTWDTPKPLVPILGKPLIEWVIRSLPRDVVHVHIAAGFSSEKLERYVESDPLPRKLHLKVEPKPLDTAGAIKFACRDSTADAFVAFNGDIVSSLDVRQMLKFHREHDGIATIALYPVPEDEVSRFGVVDLDDDDRILDFVEKPEPEEAPSNLINAGAYVLDREVLDYIPEGRPVSIEREIFPKLAEEGLLYGFKFEGYWVDVGLPETYLEAHRVLMEHECSGKSVVGARITDTDLKPPVVAAPMTELRSSEIGPYVYVGERTEINGSVIENSVILDDVEIIDSEVRNTIVAEGCKIENARLDGCVLGHDAEVCGCNLKGVRVAPGKEAERDLEDEWVI

SEQ ID NO: 48426 - protein, 582 aa, Aspergillus oryzae
MAHITARINVAEYVFHRLRQLGVCSIYGVPGDFNLVALDYVRPSGLHWVGCSNELSAGYAADGYARVKGLAALMTTSGVGELSALNAIAGAYAEKVPLVHIVGTPPTYLQDQNAILHHSLGDGNSRLYASIYRSFTCAQANLTLASHAPVLIDETLRQCLLHSRPVYIEIPANMAKVIISASRLEEGIDTSLSLNEGSEVEQTVVKELLKSLYSASQPLIILDGWVSRYGLEQEADDIVRLAGFPVVTTPFGKGTANETYPNFCGVYTGAAGNSDFMRWVKSRDLVIRFAPMNADTNTFGFTALTSEAITIELHKFTINIRGENYLNMNTKSILRKIISELDPSRFAYDESCIEPRRLNMTGALDSPRPEASITQDIFWRYVSQFFHSDDIILTETGTPYAGGCDFVLPPNAKIINSALWLSIGYTLGASCGAALAQREMVKQGLRNKGRTILFEGDGSFQMTAQVLSDIIRNRLDLIIFLINNDGYTIERYIHGMEAYYNDIQPWRYLESPWYFGARKDDLEYPVFTKQVRTWADLERVLQSEHIIRGRGLSMIEVILEKDDAHPLLKRQMKIAKDQNGNS

SEQ ID NO: 48427 - protein, 276 aa, Leifsonia xyli subsp. xyli str. CTCB07
MVFKRSLYKTPGQLRAMVAPGRATAASLDAVARAVAAGTTTLELDGIAERAVEAAGGKPNFKLEAGYHHTICASVNDEVVHGLPGFRILQPGDILSVDSGAILDGWNGDAARTFVLPDPARPDLVAERQTLSEVTEQSLWHGIARLARARHLNEVGEAIEDYILSRGEYGILTDYIGHGIGRRMHEEPPVFNYRVRAKGPEVKPGLVVAIEPMVVLGDQDTYVKDDGWTVATEDGAAAAHWEHSVAVHADGIWVLTAEDGGAAGLAPFGLTPRPIP

SEQ ID NO: 48428 - protein, 649 aa, Corynebacterium diphtheriae NCTC 13129
MAHSVVMPELGESVTEGTITQWLKSVGDAVTADEPLLEVSTDKVDTEVPSPVSGVLLEIKFEEDDTVDVGDVIAIIGEEGDAPAAKEEPAEEPKAEAPKAEAADSTDVVMPELGESVTEGTITQWLKSVGDTVDVDEPLLEVSTDKVDTEVPSPVAGTILEILFNEDDTVDVGDVIVRVGTPGSAPAAKEEPAKEPKAETPKEEPKAEAPKAEAADSTDVVMPELGESVTEGTITQWLKSVGDTVDVDEPLLEVSTDKVDTEVPSPVAGTILEILFNEDDTVDVGDVIVRVGTPGSAPAAKEEPAKEPKAETPKEEPKAEAPKAEPKKEAPAKTINNENVPYVTPLVRKLADKHGVDLTTVEGTGIGGRIRKQDVLAAAGVGAAPAAQVAPAQPVSAASTKSVDPEKQKLIGTTQKVNRIREITARKTVEALQISAQLTQLHEVDMTKVAELRKANKPAFQEKHGVNLTYLPFFAKAIVEALVAHPNVNASYNAETKEMTYHADVNLSIAVDTPAGLLTPVIHKAQELSLPELAKAIVDLADRARNNKLKPNDLSGGTFTITNIGSEGALSDTPILVPPQAGILGTGAIVKRPVVITEDGIDSIAIRQMVYLPLSYDHQIVDGADAGRFLTTIKDRLETANFEGDLELS

SEQ ID NO: 48429 - protein, 476 aa, Aquifex aeolicus VF5
MIEKKMLIGGEWVDKEEKIEVIYPYTRKPIGRVPKGDEKDVEKAIERAKEGFKEIFSLTAYERYEILMRAAQLLKERAEEFAKTLVLEVGKTIREARTEVQRAIQTLIFSAEEAKRVNGETFPIDAHPNGKGKLGFYIRVPVGIVSAITPFNFPLNLSMHKVAPALAAGNAVILKPSERTPLTPLMLGEILLEAGVPPKALSVIPGYGDVGKAMTTHPDVRVVSFTGSRKVGDIIARQVGIKKLVLELGSNSAIILHKDGNLEKAVEKTVQGGYAIAGQVCISVQRVFVHEDLYDEFIKRLKERVSKLKVGDPMNEDTDLGPMIAPSELERIQEWISEAVQKGAKIEAGGLRCAEDETIFSPTIVSLVPEDSKLFKEEAFAPVVAVNPYKDIEEAIRWVNSSDYGLQVGVFTNDVKLAWKCIKEIEAGGVLINEGPTFRADHMPYGGVKYSGIGREGPKFAIEDYTEIKTVIFDLT

SEQ ID NO: 48430 - protein, 341 aa, Thermococcus kodakarensis KOD1
MTVIENIVGRVTVLRGGRYSVEVDVITSSGFGRFAAPVDENPDLYIAEAHRAVSEVDEIIGPELIGFDATEQELIDSYLWEIDGTEDFSHIGANTALAVSVATAKAAASEKNLPLYTYLGGTFTTELPVPILEFASDSEFDYYVMVRDLMEITDVVDAVNGVLSNLKEATVEGYSEATEKASSELGLDVALGLAQKAPMDMEKLLTLVEDNNVAYLKPMGDEELFLELIAGTHGVFIDGEYLFRQKDILDRRYYNALSIKPINLGTLTDLYNLINDAKSERIVPILAEARFESSDEALAHMAVGFRCPAVVLRKDSIAKLNELIRIAEDLGERGRVITFEG

SEQ ID NO: 48431 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGRQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 48432 - protein, 65 aa, Thermococcus kodakarensis KOD1
MIVPVRCFTCGKVLADKYYEFKKRVEAGEDPGKVLDDLGVERYCCRRTLLSHVELIDQVMVYKVY

SEQ ID NO: 48433 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASNVLTGRQAQPAGDKAEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 48434 - protein, 388 aa, Triticum aestivum
  misc_feature (342)..(342): Xaa can be any naturally occurring amino acid
  misc_feature (376)..(376): Xaa can be any naturally occurring amino acid
MASAALLKSSFLPKKAEWGATRQAAAAKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGXPENVAAAQEALLLRAKANSLAQLGKYTSDGEAAXAKENMFVKNYSY

SEQ ID NO: 48435 - protein, 505 aa, Vitis vinifera
MRLLQFGLILALASGFAAIIIYINGLANILLGRSLNSSIVDMGLIQAFLKKDGDLGSKELQIVNYRTCWVGDARDVEEILISMLKYGVCFLKEAGDCYIDILGGLKEFHRDIAHAVGVILSSNGLGLQAARGRDYCQVTIKFPSDTVPKWKDPKTGELEGLSFDFNLCEAVATWEQVRNSTTILTKEFIDALPNGWTDYAWRRINKGILLNNCKNKTLCMEKLSLVLPETPPYFPRQFDRCAVIGNSGDLLKTRFGKEIDGYDAVIRENGAPIENYTAYVGKKSTFRLLNRGSAKALDKVVELDETRKEALIIKTTVHDIMNKMIQEVPIHNPVYLMLGASFGSAAKGTGLKALEFALSICESVDMYGFTVDPGYKEWTRYFSESRQGHTPLHGRAYYQMMECLGLIKIHSPMRADPNRIVTYVPSHSTVTAARTASEKLLRRVGAGSGEPLHACSIIKKQLQREPIGISSIRKAAVDHKNFVKGATMYPLEHSPGHGLLCTVPN

SEQ ID NO: 48436 - protein, 403 aa, Vitis vinifera
MVRPLTSDVAGKNEGDSPLDIHICWNMLRDANIDPPIQALYFLAGGVTILTFISFTFPLHRLMAAIFFLDPTSSALLLRRVKISFAENIPLLRQASRNTARNVVHWTRRGSALQALLVISVGTITLLALTGLLVFVLFFLATTFNAIVISLLMSLATIGGYLALFFACITAICIEALSRPRMTALQESLNVESPPRHDAGNVFQPFPSFFSPGYRICAGCNCEIGYGRYLSCMDAVWHPKCFRCCACGLSVFEPEFSMSGSHPYHKSCYKEQNHPRCDVCRNFIPTNAVGLTEYIAHPTVPHTSMMELLGVVVVNEQEQVTTTASRSHKLLVHVQQIEVALPPLEKSILAQRSHIHFAYTDGSNWHASIPNEQNHFNYHDLPRFIMDSYEECRDPPRSHLLSK

SEQ ID NO: 48437 - protein, 362 aa, Mycobacterium sp. JLS
MATPKVPPVRLARAVERLRHVLDRAHQRSAPPSAVMLEKILGAWISQGITVAADLRVADALADGPLPIGELARRVGANPDALARLMRALIGEGVFTQRRDGRYALNALGRTLCTEATMSVAGMARMIGHPAHREHWSQLLDAIRTGEATVPKLRGMPGFEYLSENRELGEIFNDAMTNLSETAVAPLTAAYDFRGFGTIVDVGGGHGRFLSAILAATPSARGVLYDLPQVVEGATELLGSHGVADRLEIVGGSFFDSIPAGADAYVAKNVIHDWPDADALTILRNIRSAAGTGATLLLAEFVIPDHHRAFIGNWTDMEMLMATAARERTEAEYRKLYQQAGFRLTRVVPTVAPISLIEGKAV

SEQ ID NO: 48438 - protein, 862 aa, Vitis vinifera
MEEGGNWREMVTKMLPPGASLPDEVSDLDYSIAIEYEGPPVSYKLPTVEPLDVNSSAIPTASIAETLSESQRSVSLTGAPVIEPIPLPVSCIAGVTSSPAQSPRVSGSSESVVSVLQNPDFSSASPSVSPGSVHNPQSNATKQVVSEVKRVPVVTFNTVDRSERKVVEVEKPVFAEYVGVSKGKRERKKKRVCYRCGKGKWETKEACLVCDAKYCSSCLLRAMGSMPEGRKCVTCIGEPIDESKRLKLGKHSRLLSRLLSPLEVKQIMKAEKECSANQLRPEQLIVNGFPLKPEEMAELLGCALPPRKLKPGRYWYDKESGLWGKEGEKPDRIISSNLSFSGKLSPDASNGNTEDFLKASQLVSYVDAYLLANVQCPRDTHFWVYDDGRYEEEGQNNIRGNIWEKASTRFVCALFSLPVPHGALEGLRDEASNYTTVPNYLEQKKVQKLLLIGLHGSGTSTIFKQAKFLYGNRFSAEELQDIKLMIQSNMYRYLSILLDGRERFEEEALSKLKASDSQDQIAEAGEELESSEAGQCIYSINPRLKHFSDWLLDIIATGDLDAFFPAATREYAPLVEEVWKDPAVQETYKRKDELHFLPDVAEYFLSRAVEVSSNEYEPSERDILYAEGVTQGNGLAFIEFYLDDRSPMSETYTDNQEAPLQPVTKYQLIRVNGKGMSEGCKWVEMFEDVRAVVFCVSLSDYDQMSIGTENSGSGTQLQNKMMQCKELFETMVRHPCFKETPFVLILNKYDVFEEKVNRVPLSSCEWFNDFSPVRPHHNNQSLAHQAYYYIAMKFKDLYASLTSQKLFVAQARARDRVTIDEAFKYIKEVLKWDDEKEETYYGGVEDSFYSTDISSSPFIRQE

SEQ ID NO: 48439 - protein, 461 aa, Brassica napus
  misc_feature (289)..(289): Xaa can be any naturally occurring amino acid
MGSIAEPWGISESENANGTPKGLSRELRHGKTAHNMSSSSLRKKSDLRLIQKVPCKSLKNVLSNLQEVILGTKLAVLFLAIPLAVIADYYHYGRPLIFGLSLTGLTPLAERVSFLTGQLAFYTGPTVGGLLNATCGNATELIIAILALANNKVAVVKYSLLGSILSNLLLVLGSSLFCGGIANIRREQRFDRKQADVNFFLLLMGLLCHLLPLLLKYAATGEASASLINKMSLSLSRTSSIVMLIAYIAYLIFQLWTHRQLFEAQEDDEDDTYNDEVTVEENPVIGFWXSGFAWLAGMTLVIALLSEYVVATIEDALDSWGLSVSFISIILLPIVGNAAEHAGAIIFAFKNKLDISLGVALGSATQISLFVVPLSVIVAWIMGIKMDLNFNILETSCLALAIIITAFTLQDGTSHYMKGLVLMLCYVIIAACFFVDQIPQPKGTGLGMQPKNSVGGGFVSA

SEQ ID NO: 48440 - protein, 126 aa, Vitis vinifera
MAVDHGNDREVLFHGQRRPMRTRVSEGRDHEGVELEGPSDTDARNWNADRNGNSGRGRCQSREDGVRDWLNELGLGRYAPVFEIHEVDEQVLPMLTLEDLKDMGINAVGSRRKMYCAIQKLNKGFS

SEQ ID NO: 48441 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVVPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSVLDLGEPLSLITESVFARYISSLKDQRVAASKVLSGRQAQPAGDKAEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 48442 - protein, 358 aa, Triticum aestivum
MSAYCGKYKDELIKNAAYIGTPGKGILAADESTGTIGKRFASINVENVEDNRRALRELLFCTPGALQYLSGVILFEETLYQSTKGGKPFVDILKEGNVLPGIKVDKGTVELAGTNGETTTQGFDDLGKRCAKYYEAGARFAKWRAVLKIGPTEPSQLSINQNAQGLARYAIICQENGLVPIVEPEILVDGPHDIDRCAYVTEMVLAACYKALNDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWAGKAENEEKARKAFLVRCKANSEATLGTYKGDATLGEGASESLHVKDYKY

SEQ ID NO: 48443 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGRQAQPAGDKGEFIEKVRRALYLGKIVSYAQGFSQLRAASEEYNWDLNYGEIAKIFRAGCIIRARFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 48444 - protein, 642 aa, Salmonella enterica subsp. enterica serovar Paratyphi A str.
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKALDVEQIRHQLEHILNEEHIAHEPRALQLLSRAADGSLRDALSLTDQAIASGDGQVSTQAVSAMLGTLDDDQALSLVEAVVDANGERVMSLINEAAARGIEWEGLLVEMLSLLHRIAMVQLSPAALGSDMAAIEQRMRELARTVPPGDLQLYYQTLLIGRKELPWAPDRRMGVEMTLLRALAFHPRMPLPEPETPRQSFAPVAPTAVMTPPQVQQPSAPAPQTSPAPLPASTSQVLAARNQLQRAQGVTKTKKSEPAAASRARPVNNSALERLASVSERVQARPAPSALETAPVKKEAYRWKATTPVVQTKEVVATPKALKKALEHEKTPELAAKLAAEAIERDPWAAQVSQLSLPKLVEQVALNAWKEQNGNAVCLHLRSTQRHLNSSGAQQKLAQALSDLTGTTVELTIVEDDNPAVRTPLEWRQAIYEEKLAQARESIIADNNIQTLRRFFDAELDEESIRPI

SEQ ID NO: 48445 - protein, 367 aa, Rhodococcus sp. RHA1
MTTEQLEGTTVRMPALGESVDEGTITRWLKQPGDHVTAEEPLLEVATDKVDTEIPSPVTGILQRHLAEENDVVAIDAELAIITESGGTAAAPAAPPIPAPTADPAQTPPPPEPDTATPPATLGTAASLPATGSTTEKLPRIRRTIAKRMVESLQTAAQLTTVLEVDVTAIARLRATHKDAFLQRTGIKLSFLPFFAQAAVDALAEHRVLNASLNTDVTEVTYYDHCHLGMAVDSAKGLMVPVIRDAQQLGIEGLAQAIADKADKVRTGTITADDLTGGTFTLTNTGSRGALFDTPIINQPQTGILGVGAVVERLVPSRQDGELRIDVRSMAYLSISYDHRIVDGADAARFLTTVKARLENGFTPNDL

SEQ ID NO: 48446 - protein, 1358 aa, Mycobacterium sp. JLS
MDGTPFGRYLLVELVGRGGMGEVWRAHDTATNRTVALKVLPAHLVHDTEYRVRFQREARAAARLSDPHIVPIHGFGEIDGRLYVDMRLIEGRDLEHLLREGPLDPARAVMIIDQVAAALEAAHEVGLVHRDVKPSNILVGKFDFTYLIDFGIARPIDDTGLTSVNRAVGTFHYMAPERFRDGRGDPRSDTYALACVLYQCLTGSRPFHGDSLEQQIAGHLMTPPPRPSTVQPGVPAKFDAVIARGMAKNAAERYRSAIDLAHAARTVITTTLAPPTESASKPASPLGFPALPDTGAHIRTGSSIDELLDHAVSAINRGGDVVDRHAPAFEAEPAYADGEDLLVAPGEPGEIRRLTIMFADLVDSTVLSTEVEPETYRLLVGRYRDQVLRIVGEYEGHVGSTKGDGLLVVFGYPIAHENDVRRAVQAGLEITRDVARLSDQAQRRFGLRINVRVGVHRGLVYLDTAQDDVFGLAANMAARVSGLAPPGSVVVSDSVEPLIKDAFELETLPPAPVKGVKGLISHSRVISERAESSRGPTGPLVGREREMARLRRGWVRAQARTLTTPGVVIRGEAGIGKSRLVTGVVELVEADGGVVLDLAGSPFHADVGLQPVRALLERRCGITRLTEPSRRVELLREEIMLRTLDPDPLIGLLAPVLGIAPEHGYEPVPFEGRKLQESIAAAVLQYLSACHGGRSGLVVVEDGHWLDPSTLELVGDLLRTADGGLLVVITGRHGGWLPGDWPAKVLDLQPLTDEQVDALVVALDPTVTAEECAAVRERCDGVPFYIEQVVSGLGQTDPEENRPSVPDPLYEPLFARLLTRPNVVPVVEAAAVIGRQVDRGLLIAVSGLSEDDVDDVIDELEDAQVLEPRGAGGWRFRHELLREVAAELAPPSVRRELHGRVADALLRGAVGDPDWRLVASHYENAGRYTDAASAYREASAAARLRGALTEARNYLTHALSELEKSPPGAARDRLEIRPRLERGFLAAAMEGYQSVSVADDFERCLELVGTDLRDDEVWSTLVSVSSYYLSRADLDRAAQILGLVESAPDTGREWLRPAVNGALGTIAFVRGEMAVARDYFGKALVSVAIEDRQRMGELWYVPHDPVSMAHEHLAMDRLWHGDLAGAEAAMSAARERAEELGVPLGPYNVVNAIDMEIWLRVDAGQFDRARALVAEMIEKAENYGFDFWQLFGATEQCMVDAEIALSASAPDRATLETLIAALTEFVSFWRAVGLYVYQTHYDCVLAKLLTAAGRRDEARERISTALAIAVETGMHFHDAELLRARARTHSEEVSRAADLASARRLAREQDAPLFELRAALDEFEWRGAGARDVLDAAARRLPADGALPEIARARDLLG

SEQ ID NO: 48447 - protein, 269 aa, Zea mays
  misc_feature (261)..(261): Xaa can be any naturally occurring amino acid
MLLMLHETLPFVRPSSCRDPKLSEKSASALHGKLGCSAVCSSAEGHRVQKPHIVHSYKVSFTRTSHHLCKSLNERTTRHCLHRFHVNASPDDDDFRSSRNIAISLFKRYKNVIDRGGGENLNEFVSAGVTAYALGCTDEGLRKELMDIEDSGLEIEGLGSLGGTSLKFKVHSFEIRECILWLSIVFVTILCTPQLTVIRWSPNPPVSADVLHQWKGFCALIANAYYVKGMAWLPVKTLQLEQMAVTGSSEKPSVVASRMQXVSPQWPRV

SEQ ID NO: 48448 - protein, 207 aa, Vitis vinifera
MLNIASERDVDGDLLLGDMGQGLGLRPGVIDGAISISAVQWLCNADKSSHEPRLRLKAFFTSLYRCLARGARAVLQVYPENVAQRELILGFAMRAGFSGGVVVDFPHSTRSRKEYFVLTCGPPSLSTAVPKAKGEDGESCSDDESSGDEENQTVSISDRHRPRKKQKITKKGRGREWILKRKEHMRRKGNTVPPDTKYTARKRKARF

SEQ ID NO: 48449 - protein, 626 aa, Geobacter sulfurreducens PCA
MSRILDRVDSPSDLKGLTTAELGILAEEIRQEIITVCSRNGGHLAPSLGVVELTLALHRVFTSPEDKIVWDVGHQAYAHKLVTGRRDRFATLRTLGGISGFLKRAESPHDVFDAGHASTSISAALGLAAARDLAGRNNKVVAVIGDGSMTGGIAYEGLNHAGHLNRDLVVVLNDNEMSIAENVGALSNFLSRTVTSEFVHTLKKDVETFLGGLDRIGRNVLKVAKRAEESLKGLFTPGMLFEAFGFEYIGPIDGHDIGRLTETFEKVKRFDDAVLIHVLTKKGKGFAPAEAKPSLFHGVGPFDPVSGEIVKGKGGATSYTGVFGQALTRIADEDERVVAITAAMPDGTGLGSFSARHPGRFFDVGIAEQHGVTFAAGLAAEGYRPVFAIYSSFLQRAYDQLFHDVCLMNLPVTFAIDRSGVVGSDGPTHHGLFDLSYLRTLPNMVVMAPKDENELQHMLKTAIDHNGPAAVRYPRGNGLGVPLDQSLAPIPLGTSEVLRAGSGTCVVLAVGAMVGPALEAANTLEGEGIDLTVVNVRFVKPLDRELILSYVGRAGTLVTIEENVLQGGFGSAVLELLADEGVGGVAVHRFGYPDRYVEQGEQHELRSRYGLDAEGIAGRIRTLSAR

SEQ ID NO: 48450 - protein, 79 aa, Vitis vinifera
MSSRPELQAPPEIFYDDTEARKYTSSSRIIEIQALFSRKEHWSCLLCPMMEFPDYSLTLVVDLDLVGRHCLRMDTNGLV

SEQ ID NO: 48451 - protein, 322 aa, Pseudoalteromonas tunicata D2
MRRLPPVLLEDGCSRELLSLIRTILAACKEISFRVGQGALSGVLGSTLDENIQGETQKKLDVLSNQLLKDILLETGYVKAIASEEEDYTVAGNPDAKFIVAFDPLDGSSNIDINSLVGTIFSIMEAPEGSDANDPSIFMQPGDKQVAAGYVLYGPSTMLALTVGKGTRIFTLDKTHGSFLLTHDFAQIPAKTNEFALNMSNQRHWQPAMQNYVADLLAGEDGPRKENFNMRWIAAMVGDVHRVLTRGGFFSYPADTKDPKKPYKLRLLYEANPMAMLIEQAGGIASTGTERIMSIQPDAIHQRVAVILGSKDEVETCLSYHN

SEQ ID NO: 48452 - protein, 297 aa, Geobacter sulfurreducens PCA
MDLKGYLKERCALVDEALERHLPAEDELPSSVHRAMRYSVFAGGKRVRPILMLAACDAVGGDTALALPAACAMEMIHTYSLIHDDLPAMDDDDFRRGRPTNHKVFGEAIAILAGDALLTEAFILISSPSYAAAVGSDRLLPVIHEIALCAGSRGMVGGQVVDMESEGNKEIDLATVQYIHTRKTGALIKASIKAGAVLGGANADAVKAVTRYGEAIGLAFQIADDILDIEGTTEQIGKDAGSDEARGKATYPAVLGLAESKRRAQELLDLAIEALSPFDHRADPLREIARYIVSRKS

SEQ ID NO: 48453 - protein, 974 aa, Rhodopseudomonas palustris CGA009
MTSLDPRTEMRARPSSHRTSRQGTMNPVKALEKHGQAIWLDFLARGFIAKGDLKKLIETDGVKGVTSNPSIFEKAIGASDEYDGAIGEALKKGDRSVGDLYETLAVEDIQNAADVLRPVYDKLEHRDGFVSLEVSPYLAIDTKGTLAEAERLWRAVNRENLMIKVPATREGLPAIKQLVSKGISVNVTLLFSQKVYVQVAEAYIAGLEALIASGGDPAHVASVASFFISRIDSAVDAALDDKIAKANDPSEKERLEELKGKVAIANAKLAYQDYKRLFSGDRWAKLEACGAKPQRLLWASTGTKNKAYSDVMYIEELIGQNTVNTVPPATLDAFRDHGEPRNSLEKDLDEARAVIKGLASTGVSLDAITDKLVTEGVQLFADAFDKLLGAVAFKRETVLAGRVGKQTLSLPGELANSVKQHTEAWRSAGKIRKIWSRDESVWTDHDEGKWLGWLHAPSVAKTKLTEYQDFAKWVKSQGFTDAVVLGMGGSSLGPEVIAETFPQQDGFPKLHVLDSTDPAQVRALEASVKLASTLFIVSSKSGGTTEPNVMKAYFFARVTEAIGADQAGRHFVAVTDPGSSMEKVATEQKFAKIFHGDPTIGGRYSVLSPFGLVPAAAAGIDLAKLLDSALAMVRSCGTDVPPQQNPAVQLGLVMGCAGLEGRDKVTITSSKAIADFGAWAEQLIAESTGKEGKGLIPIDGEPLADPSAYGNDRLFIDLRTEAETDAAHEAKLAALEAAGHPVVRIVLKSTEAIGQEFFRFELATAVAGAVLGINPFDQPDVESAKIKTRELTAAFEKSGALPAETPALSTAEADLYTDAGNAAALRKAGADGTVASWLKAHLSRVSAGDYVALLAYIERNAAHIEALQDIRLKVRDHRKVATCAEFGPRFLHSTGQAYKGGPDSGVFLQITADDAADLPVPGQSASFGVIKAAQARGDFDVLTERGRRALRVHLKGDLGAGLKSLGTAIKQALE

SEQ ID NO: 48454 - protein, 458 aa, Silene dioica
KKALSVDEKYSQWKSLVPILYDWLANHNLVWPSLSCRWGPLIEEATYKNRQRLYLSEQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDRRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVAACSPTPTK

SEQ ID NO: 48455 - protein, 466 aa, Pseudomonas syringae pv. tomato str. DC3000
MLGYFAKSGNLFQSFPYDFDLYVIGAGSGGVRAARFSAGFGAKVAVAESRYLGGTCVNVGCVPKKLLVYGAHFADDFENSRGFGWTPGEAKFDWATLIVNKDSEINRLNDIYRNLLVNSGVTLHEGHAKIIDPHTVEVNGERHTAQNILIATGGWPQIPDIPGHEHAISSNQAFFLKELPKRVLVVGGGYIAVEFAGIFHGLGAKTTLLYRGDLFLRGFDGAVREHLQVELTRRGMDLQFNSDIERIDKQADGSLKATLKDGRQLEADCVFYATGRRPMLDNLGLENTGVKLNKKGFIEVDELYQTAEPSVLALGDVIGRVQLTPVALAEGMAIARRLFKPEQYRPVDYRMIPTAVFSQPNIGTVGMTEEDSREAGHEVVIFETRFRPMKLSLTECQERTLMKLVVDAKTDKVLGCHMVGPDAGEIVQGLAIALKSGATKRDFDETIAVHPTSAEEFVTMRTPVGS

SEQ ID NO: 48456 - protein, 164 aa, Zea mays
  misc_feature (131)..(131): Xaa can be any naturally occurring amino acid
CLVHNTEYISIFTSALLQRPLSVVSSSTYYNSSTLVLTMWLAMACLLRDQHEQWKHKYENPCRSVKIFRCQLPQNNAFYSAQPPKHDGSDKPLCPGAPVCHWCGTSAPATLCSSCKKARYCSKKHQIDGSXIAGSLALHWRTGHKNDCLQIISSAAGIYFLPPV

SEQ ID NO: 48457 - protein, 504 aa, Rhodopseudomonas palustris CGA009
MTTQANSNQVPEGCAFVIFGATGDLTHRLVIPALYNLAEANLLPEKFCVVGVTRKEMSSDDLRDSLMQGLRKYATRPVDDKVADQLLYCVTAVSADPSEPASFERLRERLEKLEANRNTGGNRLFYLATPPDAFAPIATELGRAGLLKETSGAWRRLVVEKPFGTDLASAKALNDHLLSIISEHELYRIDHYLGKETVQNILVLRFSNGMFEPIWNREHIDHIQITVEEKLGVGHRGSFYDKTGALRDMVPNHLFQLLSLVAMEPPAHFNAHAVRSAKADVLAAIQIQTEEEALRNSVRGQYTSGKIGDTDIPDYRSAKDVAADSTTETFAALTLSIDNWRWAGVPFYLRTGKALSGKRTEVAIKFKEAPFSMFRCTPVQELSQNFLVIGIEPVEGISLQFNTKVPGPMIAIDGVEMTFRYKDYFKVAPSNGYETLLHDCMIGDNILFQRADGVEAGWRAVQPFLDAWKKAGAHGLQIYRAGSDGPEDADELLGRDGRNWRKPT

SEQ ID NO: 48458 - protein, 244 aa, Brassica napus
  misc_feature (222)..(222): Xaa can be any naturally occurring amino acid
MSTAGHFIRCLAAVAWEAGKPLVMEEVEVAPPQKHEVRIKVHFTSLCHTDVCFWEAKGQTPLFPRILGHEAGGVVESVGEGVTDLQSGDHVLTIFTGECGNCRHCHSEESNMCDLLRINTDRGGMIPDGESRFSTNGKPIHHFLGTSTFSEFTVVHSGQVAKINPEAPLDKVCIVSCGLSTGLGATLNVAKPKRGQSVAIFGLGAVGLAAAEGARISGAGRXIGVDLNPNRFEGAKKFGCGPIL

SEQ ID NO: 48459 - protein, 618 aa, Spinacia oleracea
MASSLSNLYSSTSLKPKISHLPTITKNPISGPKSLSFKPISSVARDTPADLSTSSSSSTNNLPSLQKKKADGSLEKDPRALWARYVEWLYQHKDLGLYLDVSRIGFSDEFVKEMEPRFEKAFKHMEGIEKGAIANPDEGRMVGHYWLRNSSLAPTTFLKNQIDVTLDRVWQFANDVISGKIKAPTGERFTHILSVGIGGSALGPQFVAEALAPDNPPLKIRFIDNTDPAGIDHQIAQLGPELATTLVMVISKSGGTPETRNGLLEVQKAFRDAGLVFAKQGVAITQENSLLDNTARIEGWIDRFPMFDWVGGRTSEMSAVGLLPAALQGIDIKEMLAGAALMDEATKIPVLRSNPAALLAMSWYWASDGVGSKDMVVLPYKDSLLLFSRYLQQLVMESLGKEFDLDGNKVNQGLTVYGNKGSTDQHAYIQQLRDGVHNFFATFIEVLRDRPPGHDWELEPGVTCGDYLFGMLQGTRSALYANNRESISVTVQEVTPRSVGAMVALYERAVGLYASLVNINAYHQPGVEAGKKAAAEVLALQKRVLAVLNEASCKDPVEPLTIEEVADHCHCPDDIEMIYKIIAHMAANDRVILAEGDCGSPRSIKAFLGECNVDELYA

SEQ ID NO: 48460 - protein, 481 aa, Flagellaria indica
  misc_feature (10)..(11): Xaa can be any naturally occurring amino acid
SGVSTMEEKXXGSIIQIIGPVLDVNFPSGKLPNIYNALVVKGRDTVGHQINVTCEVQQLLGNNRVRAVAMSATDGLTRGMEVIDTGAPLSVPVGGATLGRIFNVLGEPVDNLGPVDTSATSPIHRSAPAFIELDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRVLAAKGIYPAVDPLDSTSTMLQPRIVGDEHYEIAQRVKETLQRYKELQDIIAILGLDELSEEDRLTVARARKIERFLSQPFFVAEVFTGSAGKYVGLAETIRGFQLILSGELDGFPEQAFYLVGNIDEATAKAMNL

SEQ ID NO: 48461 - protein, 607 aa, Pseudomonas syringae pv. tomato str. DC3000
MDTHSLIEMLIYLGSAALIVPIAVRLGLGPVLGYLLAGCLIGPWGLKLITDVESILHFAEIGVVLMLFIIGLELDPKRLWAMRRMVFGGGALQMLACGAAIAAFCAALGLNWTAALLVGLTLSLSSTAIAMQAMNERNMTSTAVGRSSFAVLLFQDIAAIPLVAMIPLLAANGGTPSGAELALSIAKIVGAVVAVVLLGRYVSRPVLRFVARSGLREIFSAVALFLVFGFGLLLEEAGLSMAMGAFLAGVLLASSEYRHALESDIEPFKGLLLGLFFIGVGMSIDFGTLIDEPLRVLTLTLGFIVIKLVMIKLLGRFLNVPSDQRSWQAVFLGQGSEFAFVVFGAATVAGILIEPWGKSLTLAVALSMCVTPLLILLLNYLESSKKQDSKEADTIDQSNPRVIIAGFGRFGQIAGRLLMSCGFEVVVLDHDPDHIETLRKFGVKVFYGDATRLDLLHAAGAAQAVVLINAIDNQDDNLLLTKLAQEHFPSLKLVVRARDMGHIITLRQMGIEAVERETFESALSLGRRALEHLGVGRYEARERADTFRRLNLEMLEEMAAQPVDDTEFRYDAYKRANVLLTELFNEDRTHPIDGEAKKNDPTTLRDR

SEQ ID NO: 48462 - protein, 443 aa, Zea mays
QYYNILHQSPELVYRFYQEASCLGRPAGTGADGMGIDRAEIKAVDAQESLCGGVSVLVMGHLTGRNSVSRQFVQSFFLAPQEKGYFVLNDILRYVGEGGGDEGAEKQPAPEVAADAEKTTSAPILANGTVGGDATTVPQDASPQPECQVAEPALNPKEEVLNGEVCNSLSDVEKPVAEETPVPDVINEVPNNVAVAPPISSPPVPLKEAPKKSYASIVKVMKEHRPLAPAVPSRPAPPITEKQASPAPTPVTEAPAFSPNPQSGGFQDPEVDAHAIYVRSLPLNATPQQLEEEFKRFGTIKHEGIQVRSNKIQGFCYGFVEFEDASAVQAAIEASPVTIGERQCFVEEKRTTGSRGGGSRGGRFPPGRGGNFRGEGIRGRGTYNGGRGYGRGEFSYRSDYGGRGGGRGGSLHGGDVGYQRVDYSGTSSGRGARAPSAAAAMAK

SEQ ID NO: 48463 - protein, 261 aa, Nicotiana tabacum
LRVLGYAKLANLDPQYGLYSSFGPPLVYAFMGSSRKIAIGPVAGGSLLLGSMLQAELDPVKQKLEYQRLAFTATFFAGITQFILGFFRVGFLIDFLVHAAKVGFMAGAAITISLQQLKGLLGIKKFTKETDIVSVMRSVFAAAHHGWNWQTIVIGVSFLAFLLVAKFIGKKNKKYFWVPAIAPMISIILSTLFVFIFHAEKHGVQIVRHIDRGINPPSLKQIYFSGENLTKGFKIGAISGLIALTEAAAIGRTFAAMKITS

SEQ ID NO: 48464 - protein, 1002 aa, Aquifex aeolicus VF5
MKVVIVGNGIAGTALVEEILRLSSGKDIRIQVFGDEKFIGYNRVLITEVLAGRKTLSEIYIKRWQWYEEKGVRLEIGKKVERLFPNKKILVTKDGEFYRYDKAIIATGSKPFIPPSIKGVNKKGVFTYRTAKDVFEILDYARVSKRAVVIGGGLLGIEVTKALRDIGLEVFLVHILDTLMEQQLDKTASELLRKDLEDMGIKVLLKKVTEEILGEKKAEGVRFSDGDELLADFVIIATGIRPNVEVGVNSGLKVNKGIVVNDYLETSASDIYAVGECIEHRGKTYGLVAPIMEQVKVCAHNVVHGNEKKYTGSLTYAMLKVAGVNLFSAGEINEKDGDEVVAFLDNGRSLYRKAVIRNNKIVGTILYGDVRGNNYLLDLIKSGKDISEERPYFLIKHILPKGTTGVEELKDNDIVCNCNAVTKGEIVKCIKEGCKTLEEIQERTKASTSCGSCIELVEEILKHYVKEKPKRVNKIEVIKKELHPFDLEFKKRLEKYFSEGELENIPEEDRDVRLKWYGIFYRKATPGYFMVRIRVPNGRLSYEQAKVVSHISEKFCRGEVEITSRQQLQIRWIKLKDLPEILEALNRVGLSTLQTGMDNVRNVTGDPLTGLAEDSLIDTLRLSQEITNIFLGKKKYADLPRKLNVAVLGSQTDCINALFNDVCFYLSEKDGKLGFNLYLGGKIGSGGPKKAIDMDMFVEPYEVPEVFKATLDIYSTFGNRENRSKNRLYFLLQEWGVERFREELEKRLYKAIPSKGKDLVNKTGEREGIINLRNGTYAVCVVVPAGKIKAKDFRQIAELARKYGSRELRLSVYQNIYIPNIPEENLNPLLGEEIFEKFSTVSSPFTMHLIACAGSDTCSFGVIPNKSDAVRVAKYLSERLKLDIPVRMHWSACAKGCGQHGSGDIGFVGTKTKLNGKAVLAVDVFVGGSPTKEGFKVIQGLPLDKVEEASYLLLNYYLENRLEGESFADFAHRVGVDKLKVVLTSLLQEGECKLLKPESISK

SEQ ID NO: 48465 - protein, 411 aa, Campylobacter jejuni RM1221
MNLKEEALKYHLGGKIDIVPSKPMATSHDLSLAYSPGVAEPCLEIAKDNELAYTYTNKANLVAIVSDGSAVLGLGNIGAQASKPVMEGKACLFKKFANVNAYDIEIDVHSVEEIVNFCKALAPTVGGINLEDIAAPKCFEIEAALQDLGIPVMHDDQHGTAIISTAGLMNAMEISGKKFKDIKVVVSGAGAAGIASAKMYRNLGVENIILVDSKGVISKDRNDLTPQKLEFAVDSKEKTLKEVLKGADVFLGLSAPKILDDEMVLSMAKDPVIFALANPIPEVMPEDVARLRKDAIVGTGRSDYPNQINNVLGFPFIFRGALDVRASKITENMKVAAAKALADLAKLPVSDAVKKAYNLSTLEFGRDYVIPKPFDERVKAAVSTAVAAAAVKDGVAKVKNFDEKAYFESLK

SEQ ID NO: 48466 - protein, 260 aa, Exiguobacterium sibiricum 255-15
MKQLEGKVALITGAASGIGLEIAEEFAQEGAKVVIVDLQENAAKQAAETLQSKGFEAFAVAGDVTSETAIQSSIEQTMNHYGRIDIVINNAGMQHVSPIEEFSTEKFDLLQSIMLRAPFLYTKYVFPIMKKQGFGRILNMSSINGLIGFAGKAAYNSAKHGVIGLTKVAALEGATSGITVNAICPGYVDTPLVQKQLSSLAETRNVPLDRVLEEVIYPLVPQHRLLQVKEIADYAIFLASDKAAGVTGQAVVLDGGYTAQ

SEQ ID NO: 48467 - protein, 369 aa, Arabidopsis thaliana
MVSDQDLAKGVETLLRQSDPSSLTSLSSIVQQLEAKLGLDLTEKTTFIRDQINILLRAHQNPSASVASASSVQQSHPPPPPSSHQQQNLHSGVNVPPMAKGHFTLSHPSQFSVSSQSQQYPSHFALQPPYHSYDLNFRQPYPVYMPPQQHQHQQQSPRQQQSSVMLSHGGNASLSVNQAPKESAPAGTKRKGGPGGLNKVCRVSPELEVVVGEPALPRTEIVRQLWAYIRKNNLQDPSNKRKIICDDALRVVFETDCTDMFKMNKLLAKHILPLDPSKDSGQAKKAKTEVETKTETTEPISSTAISSTVTLSEPLGKFFGTGETEMADEEIIRRVWEYIKLNNLEVMILILKSSGFSLLLRIFFLFAAN

SEQ ID NO: 48468 - protein, 535 aa, Bradyrhizobium sp. ORS278
MVERCIRGRAASEGLAMGPAVIRRALEGASRAKGSIAEEHAALAAAVARARDAVAELIASLQGDAAELIGFQLALLEDDALTEAAFAQIERGTAAEDAWRAAMAQEIAGYESADDEYFRARASDLADIRDRVVRHLFGLADDGQLPSGAIIVARDLAPSAFLGVDWSKGGGIALGEGSPTSHVAMLARGRGVPMVVGLGRGWERLAGELLVDGTRAEVVVDPDPERIAAARREIDEFRRRKAEAIARQHEPALTRDGTPVAVLVNISGPNDMAIAPASAGDGVGLARTEFLTANLLHDEEAQYRAYAELMRWADGRPVTIRTLDAGGDKPIPGYTIDGESNPFLGLRGIRLSLRHPEIFRVQLRALSRAAALGPLKVMLPMVTNAGELDAARGHLRAVLDDLAKDSLAFAEPAFGIMIEVPAAALAAQDFAADFFSIGTNDLTQYATAASRDGAEVADYADVLHPGVLAMIAHVVRAARARGVDVSICGDAAGDVSAIPALLRAGVRALSVSPGLLPQVKAAIRELDLARPVGSA

SEQ ID NO: 48469 - protein, 433 aa, Listeria monocytogenes EGD-e
MSWSPKTEAWQELKNTVPYIQKGKIHTVQEQVYISKGPQVKIGDTVMVGENKVLCEVISIEKENNMLLPFNQSDKVAYGDWVYVTDTKITIPADEFLLGKVLNASGDILNEEAGMAKFKQKMPLEAPPIHAFSRAEITDTLETGIKAIDGMLTIGIGQKIGIFAGSGVGKSTLLGMIARNAKADINVIGLVGERGREVKDFLRKDLGEDGLRKSVIVAATSDESHLMQLRAAKLATSIAEHFRDQGKTVLLMMDSVTRFADARRSVDIAVKDLPIGGKTLLMESYMKKLLERSGKTQNGSITGIYTVLVDGDDMNGPVPDLARGILDGHIVLTRELATKNHYPAIDVLGSVSRVMEEIVPENQWKTASKIREWMSIYQENELYFKLGTIEQTSDNAAIFTSKEKSYFIHQFLKQLRDESVTLEETSKLMETLV

SEQ ID NO: 48470 - protein, 233 aa, Glycine max
MAAKPDLKLLGMSVSPFVIRVRMALHMKGVSHEYIEQDLFNKSELLLESSPVEKKVPVLIHDGKPVCDSPAIVQYIDEVWAATGPPILPADPYERAVARFWTAYVDDKLFPAYAGTAKAATEEERTQQINEMFAVMGQLEEAFAQCSNGKAFFAGDSIGNLDIAVGCNLLLLEVLRSMYGVEFVDTGRTPLLAAWAKRFGETDAAREVVPDVHVAVEYAKKRQAYWAAAAATK

SEQ ID NO: 48471 - protein, 129 aa, Thermosynechococcus elongatus BP-1
MSLSKSTTDCLHLSGMRYYGYTGALPEEQILGQWFEIDIRLWFDMTTAAASDRLEDTLDYRPLLQAIEQLMQQQRFQLIETLAAAIMNLCLAPPQVQRAAVRVTKLAPPVPNFTGQISVEMVRPHAESP

SEQ ID NO: 48472 - protein, 126 aa, Chlamydomonas reinhardtii
MNFNSKRSVTDEQNERHKRMLAAILKEEGNKSCADCKTRNPTWASVNLGVFVCLTCSGIHRSLGVHISQVRSCNLDTWLPKQVEFCRVMGNVKGNRYWESRLPKDFRRPPSGNPNPELAAFIRAKY

SEQ ID NO: 48473 - protein, 524 aa, Rhodococcus sp. RHA1
MQERDPLAASSDGGLGEALIGNSGQVTEPVSMVIFGITGDLARKKLVPAIYDLAHGCQLPPDFDLVGFARDGAHTEARLREAVIAHARTPFDPAVWAGLVERIHVVQGSFDDTAAFARLSARLAELDVRRGKPGNYVFYLSVPPSAFATVCDQLAITGLHRGDRGWRRVVVEKPFGHDLASSQTLGVALERVFPPSSIYRIDHYLGKETVQNILALRFANGMFEPLWNNRHIDHVQITMAESVGVSGRAGYYDGVGAARDVIQNHLLQLLALIAMEEPVAFDADSIAAEKIKVLSATGLLGPLAETSARGQYGAGVENGVPVTGLADEAGFPADSTTETFAALTVGIATRRWAGVPFFIRTGKRLARRTGVPFFIRTGKRLARRTAEIAVTFTPPAHGSPAARAAAVSNVLVLRVQPDDGIELHIGAKRPGGGMHIQPVSLGMDFRSVFDPAPEAYERLICDVLRGDATLFPRREEVEWSWRVIDPLLEHWAALGRPDNYPSGASGPESAERILSRTGREWRSL

SEQ ID NO: 48474 - protein, 254 aa, Zea mays
MAQESITASQSQKMKQRSGCRKTGGGVDRVGARDRVRARPICLQCTQQQTKDGAKFGYTGSVGPDHWGALSPSFRQCATGTKQSPIDISTAQAVSNPALQPLHRDYTVANATLVDNVVNVALRFDGDGGAGSVSVGGKLYTLKQVHWHSPSEHTVDGRRFPVELHMVHASDDGNVTVVAMLYRFGRPDPLLWQIQDKLAALHAEGCRADKGAPVAAGDVSLWSLRLYSHTYYRYVGSFTTPPCTENVIWSVLAQ

SEQ ID NO: 48475 - protein, 458 aa, Silene diclinis
KKALSVDEKYSQWKSLVPILYDWLANHNLVWPSLSCRWGPLIEEATYKNRQRLYLSEQTDGSVPNTLVIANVEVVKPRVAAAEHISKFNEEARSPFVRKFKTIIHPGEVNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVENAHNADLHCVDWNPHDENLILTGSADSSINLFDRRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTVVSVSGDCSSSAGGGTLQIWRIIDLLYRPEEEVLAELDKFRSHVAACSPTPTK

SEQ ID NO: 48476 - protein, 458 aa, Silene noctiflora
KKALSVDEKYSQWKSLVPILYDWLANHNLVWPSLSCRWGPLLEEATYKNRQRLYLSEQTDGSVPNTLVTANVEVVKPRVAAAEHISKFNEEARSPFVRKFKTIIHPGEVNRIRELPQNSNVVATHTDSPDVYIWDLESQPNRPVNLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADNSINLFDRRNLTASGVGSPVHKFQGHDAPVLCVQWSPHNRSIFGSAAEDGLLNIWDYEKVSKMETESGGKKSNHPAGLFFRHAGHRDKVVDFHWNSIDPWTLVSVSDDCSSSAGGGTLQIWRIIDLLYRPEEEVLAELDKFRSHVATCSPTPTK

SEQ ID NO: 48477 - protein, 318 aa, Silene latifolia
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMQTGLKGSMEPLLEEADIDKDGRISLAEFRRLLRSASMSS

SEQ ID NO: 48478 - protein, 318 aa, Silene latifolia
NFLFKSPKEDSPLKATDFGLSDFINRSRKFTDIVGSAYYVAPEVLKRKSGPESDVWSIGVIMYILLCGRRPFWDKTEDGIFKEVLRNKPDFRRKPWPSISNSAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 48479 - protein, 84 aa, Oryza sativa Japonica Group
MGRLEPVESRVKNNKRGLGSKEPKLKPKVDEDGEKDPKKPKLEAPKKKAKLAAKRIRKMQEEEKRLQEREFEMAFFREFWPDNV

SEQ ID NO: 48480 - protein, 434 aa, Arabidopsis thaliana
MYCSSSMHPNANKENISTSDVQESFVRITRSRAKKAMGRGVSIPPTKPSFKQQKRRAVLKDVSNTSADIIYSELRKGGNIKANRKCLKEPKKAAKEGANSAMDILVDMHTEKSKLAEDLSKIRMAEAQDVSLSNFKDEEITEQQEDGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTKTFLSALFLIIILQVPFIELEYLANYLAELTLVEYSFLRFLPSLIAASAVFLARWTLDQTDHPWNPTLQHYTRYEVAELKNTVLAMEDLQLNTSGCTLAATREKYNQPKFKSVAKLTSPKRVTSLFSR

SEQ ID NO: 48481 - protein, 166 aa, Magnetospirillum magnetotacticum MS-1
MRVHKEFAALEVYRVAHWLWHQGRATLALHMQSRISEVFGCDIHPAARIGSGVFIDHATGVVIGETTVVADDVSILQSVTLGGNGKESGDRHPKIARGVLLSVGAKVLGNIKVGEGAKVAAAAVVLHEVPAHTTVAGVPARVVSRLRSDEEPAQTMDQSFGFGDGI

SEQ ID NO: 48482 - protein, 90 aa, Oryza sativa
YSDGGVKKAACGGGGAAANAQITGSGSRGRRSAAQTPAPQRRGGWSSHSSAGPAPNPPDAAIPDAATLREQWLFAVRQYSRWYSHAWGTA

SEQ ID NO: 48483 - protein, 333 aa, Brassica napus
TLSKTTKGYIRPPTKSWIVSFGEMLIDFVPTVSGVSLSEAPGFIKAPGGAPANVAIAVARLGGRAAFVGKLGDDEFGHMLAGILKQNGVSAEGINFDTGARTALAFVTLRSDGEREFMFYRNPSADMLLRPDELNLDLIRSAKVFHYGSISLIVEPCRSAHLKAMEVAKEAGALLSYDPNLRLPLWPSKEEAKKQILSIWDKAEVIKVSDEELMFLTGSDNVDDETALSLWHDNLKLLLVTLGEKGCNYYTKSFRGSVDPFHVDAVDTTGAGDSFVGALLCNIVDDRSVLEDEARLREVLRFANACGAITTTKKGAIPALPTVSEVQTLLNGN

SEQ ID NO: 48484 - protein, 187 aa, Bifidobacterium longum NCC2705
MTLLQHELTDFKVNAFQNNEFHEVTKDDVLGHWSLFFFYPADFTFVCPTELEDLAENYAKFKEIGCEIYSVSCDTHFVHKAWHDANEKIAKIEYPMLADPTALLAKDLDTYNEADGVAERGDFIVSPEGKVVAYEVISSNVGRNAEELLRRVQASQFVYEHGDQVCPANWTPGEETIEPSLDLVGQL

SEQ ID NO: 48485 - protein, 498 aa, Vitis vinifera
MDLMSYLLCLLVAWTSIYIVVSARRSKSGAGKLPPGPVPFPIIGNLLNLGNKPHESLANLAKIYGPVMSLKLGCVTTVVITSATMAKEVLQKKDQSFCNRTIPDALRALNHNQISMVWLPVSTKWRTLRKICNSHIFTNQKLDSSNYLRHQKVQDLLANVEQSCQAGDVVDIGQEAFRTTLNLLSNTTFSVDLVEPSSDTVQEFKELVRHMMEEAAKPNLADYFPVVRKIDPQGIRRRMAIHFGKMIKVLDKKVKQRLRSRQVQGWMASSDVLDTLLNISEDSNNFLDITHIDHLLLDLFVAGTDTTANTLEWAMAELLHNPETLLRVQAELRQTIGKDKLVKESDIARLPYLQAVVKETFRLHPAVPFLLPRKVEVDTEMCGFIVPKDAQVLVNVWAIGRDPNLWENPNLFMPERFLGSDMDVRGQNFELIPFGAGRRICPGLLLGIRMVQLMLASLIHSNDWKLEDGLTPENMNMEEKFGFTLQKAQPLRVLPIHV

SEQ ID NO: 48486 - protein, 235 aa, Thermococcus kodakarensis KOD1
MSDPREIAQRVLEEWEPKTKLGRLVKEGQITDIHEIFRKGYQIKEPEIVDVLLPEVNLRENQEVLDIALTVRMTDSGRRIRFRVLAAVGNRDGYVGLGIGHGREVGIAIRKAINYAKMNIIEIKRGCGSWECRCRRPHSIPFAVEGKEGSVRVKLMPGPRGLGLVIGDVGKKILTLAGVQDVWSQTLGETRTTVNFAKAVFNALYNTNRVAIKPEDIERYGIVVGRAMPTTFEVE

SEQ ID NO: 48487 - protein, 507 aa, Karenia mikimotoi
MCSRLLALTCAFCVCHARKMQTPSYQQQVKYVAEQMSAKDDKLDLNSLATLLLASIPRSAFAASGAGAHLPTPNRHDGIKMSTNPDAPIKLGVNGFGRIGRQVVRIAMDREAFVLKHINSPMSPEYMKYLLNHDTVHGRFDGTVEISDDGLIINGLPVSLSATRDPTEIPWKSAGVEYVCESTGAFTTTEGCLKHIESGAKKVIISAPAKDADTPTIVVGVNTDDYDPSMKVVSCASCTTNGLAPLVKVINEKFGIKQGLMTTVHAATASQLTVDGSMKGKDWRAGRAASANIIPSSTGAAKAVAKAYPVMKGKLTGMAFRVPTVDVSVVDLTCELEKETTYDDIKAEVKLASETYAKGVVGYTEDQVVSSDFIGETCSTVFDAEAGIMLTPTFVKLVSWYDNEWGYSTRLVDLVGLMAAADGVTTKEKALAYFTARAVEDTRQSKRSGDVRMEDWAQAMEEADEKLKKVIAAVLDVSESKIVPDATFESLGVQQDEIDPDEMFNPK

SEQ ID NO: 48488 - protein, 462 aa, Oryza sativa Indica Group
MATNGSSPRARETESSLEKVKRQLSSGSGRYLLQGPLLKRSETLRKWNERWVILDPTSGKMEYKIRRNETAIKGTIIFDASSTITLSPVNFHATQLVLQAHKEAVNSLAGNGSPATLGTVATAVANANATALEATKEIEAAMKVSMRAALGLGANNPKEGQLDDLTIMKETLRVKDEELQNLAKDIRARDATIKEIANKLTETAEAAEAAASAAHTMDEQRRLLCSEIERLRQAMERQMEQSMLKLRQSEEKVISLSKEKDQLLKERDAALQEAHMWRTELGKAREQAVIQEATIARADEKVRASEADAAARIKEAAEKLHAVEKEKEELLSLVGILQSQVQREQSSTKQVCEERSESCSGTDNSPPLTKHVDASDDDVDKACVSDSRSVLVSNDNTEVQLAVDGVDIRPIGDAEWGSFQQSEALIADVREVSPESEGGSLDIPVVNPPPVSDHIQGGATHP

SEQ ID NO: 48489 - protein, 307 aa, Karenia mikimotoi
RIGRLVFRAAMSNPDVKVVGINEPFMDLTYIVYQLKYDSVHKRFAGTIAMKQDGDKDFLIVNGMEIAVFHEKDPTAIPWGACGACYICESTGIFTAKEKAELHIKGGAKKVIISAPPKDSVPIYVVGVNHTEYKTSDTVVSSASCTTNCLAPLAKVVHENYGIKEGLMTTVHAMTATQLTVDGPSRGGKDWRGGRCASQNIIPSSTGAAKAVGKCLPALNGKLTGMAFRVPTPDVSVVDLTCALEKGAKYDDIVAKVKEAAAGPMKGVLDWTDEEVVSTDFVTCPASSVFDVKAGISLNENFVKLVT

SEQ ID NO: 48490 - protein, 314 aa, Fragaria x ananassa
MAVASTSLASQLSGPKSLSQPYSGLRRSCPKLDQSHSSLFQHLSLSSSSRKASRAVVAMAGTGKFFVGGNWKCNGTKDLISKLVSDLNSAKLEPDVDVVVAPPFLYLDQVKSSLTDRIEISGQNSWVAKGGAFTGEISVEQLKDIGRKWVILGHSERRHVIGEDDQFIGKKAAYALNEGLGVIACIGEKLEEREAGKTFDVCYEQLKAFADAVPSWENIVVAYEPVWAIGTGKVASPQQAQEVHVAVREWLKKNVSAEVASKTRIIYGGSVNGGNSAELAKEEDIDGFLVGGASLKGPEFATIVNAVTSKKVAA

SEQ ID NO: 48491 - protein, 422 aa, Karenia mikimotoi
MAVRLGINGFGRIGRLVFRAAMENQSVTMAAINEPFMDLDYMKYLLAYDTVHNKFKGTVETKKDNSGEYLVVNGMSVRAFHEKDPGSIGWGAVGAAYICESTGVFTTQEKAALHLKGGAKKVIISAPPKDAVPMFVMGVNHEKYTADLTVVSNASCTTNCLAPLTKVIHDNYGLVEGLMTTVHAMTATQLTVDGPSRGGKDWRGGRAASENIIPSSTGAAKAVGKVIPEMNGKLTGMAFRVPTPDVSVVDLTCRIAKPAKMADICAKIKEASETTMRGIMGYTDKEVVSCDFTTDPRSSIFDASACIALNDTFIKLISWCDNEWGYSNRLVELASHMAMVDGVVPRPAKVVSVKAREIFDSRGNPTVEVDLLTDMHLFRAAVPSGASTGIYEALELRDGDKKRLLGKGVLKAVENVNTIIGP

SEQ ID NO: 48492 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHEATSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 48493 - protein, 302 aa, Karenia brevis
RIGRQVVRIAMDREAFVLKHINSPMSPEYMKYLLNHDTVHGRFDGTVEISDDGLIINGLPVSLSATRDPTEIPWKSAGVEYVCESTGAFTTTEGCLKHIESGAKKVIISAPAKDADTPTIVVGVNTDDYESSMQVVSCASCTTNGLAPLVKVINEKFGIKQGLMTAVHAATASQLTVDGSMKGKDWRAGRAASANIIPSSTGAAKAVAKAYPVMKGKLTGMAFRVPTVDVSVVDLTCELEKETTYEDIKAEVKLASETYAKGVVGYTEDQVVSSDFIGETCSTVFDAEAGIMLTPTFVKLVS

SEQ ID NO: 48494 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHENTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 48495 - protein, 318 aa, Silene dioica
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 48496 - protein, 258 aa, Vitis pseudoreticulata
MITDSITSAAASISKEFGKKKRTNRTAKLKQCKLDARREQWLSKVKNNGCRGESEGIPESSMHKRNESNEINRSLENLEVRPRGGENDGSVHHDSDSESPANSPTSHISSILGSTDSGTNYHASSSSSSSSGGCCSGSITEEEEEEEEGNDECLDDWEAVADALAAVDKQKIPVQEGHVEQESHVEQKPVVRSGSPGGISKDTGLGIEIHKPEHVGMVPRAPANGQRAGLMMLQTSEFTNLSGSIASHASDAYVMEGH

SEQ ID NO: 48497 - protein, 294 aa, Rhodococcus sp. RHA1
MTILQLTLNNEITMPALGFGVYQTPPDDTVAAVEAALETGYRHIDTAAAYQNEREVGEAIRRSGIDRSDIFVETKIWITDYGYDATLHAFDKSSRKLGIDQIDLLILHQALPGGFALTVEAYKALETLLADGRVRAIGVSNFMSDHLTRLRDETSVVPAVNQIEVHPYFRQSDVLTANAEHGIVSQAWSPIGGITFYRNGSHGSTLDDPTLQSIAAAHGKTPAQTMLRWHLQQGRQVIPKSVTPSRITENFEVFDFDLTADQLAAIDALDTGVRGGPEPDDITRETFGLEIPEA

SEQ ID NO: 48498 - protein, 318 aa, Silene dioica
NFLFKSPKEESPLKATDFGLSDFINRSRKFTDIVGSAYYVAPEVLKRKSGPESDVWSIGVIMYILVCGRRPFWDKTEDGIFKEVLRNKPDFRRKPWPSISNTAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 48499 - protein, 655 aa, Debaryomyces hansenii CBS767
MSYSDTSSFRDTAAATGSEDFDKSSKVREHDGSEDIPQGYNEQSIPMVVKSTSKSYGIRRSEILVEQFTHPAFSILFLFCVFICAYAYSLDGTVRFTYQGYATNSYDQHSLLAAINVIRSVIAAASQPTYARLSDIFGRLELLIFSIILYAMGTVIESQAYDIYRFAGGSVLYQAGYSGVMLILQVILADFSNLNWRLLCSLIPATPFIINTWVSGNVTESALATYSWNFCIGMWAFIFPLACIPILGCLIAMQVKARKTPEWRQIRAEEKESNRWRSWKDNVIVDLFFKIDVIGILFIICILGFILVPMTIAGGKTDDGAVREAWKEAKIIVPLVIGFVLIFPFILWEYKFSKYPVVPFQLMKDRGVWSALFIAIMINFVWYLPNDFMYPVLLVAMRASIKAGTRITSLYSFVSTITGVLFGLLIVPWARRLKPFIIFGGLCWIASMAILYSYRGANDGIESEKYLNGVIGGLCFMGFGAGLFTYPTQVSIQTCTNHEHMAIVISLYLAFYNIGSAFGSCVSGAVWTNTLYKYLLDKFTEAGLDTSAAELAYGKPYDFIAIYTWGTPERVAVVLAYAQTQRLLCIIGLCLSVILFIATFLLRDHKLESVQSLELAHEEGIKAEDGEVVVNDYDNDLVFSKIKSLFKRKEKNDAI

SEQ ID NO: 48500 - protein, 318 aa, Silene diclinis
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLDEMRQALAKDLPWKLKDSRVMEIVEAIDSNTDGFVDFNEFVAATLHVHQLHELDNEKWQELSQRAFEKFDVDKDGYITPDELRMHTGLKGSMEPLLEEADIDKDGRISLAEFRRLLRSASMSS

SEQ ID NO: 48501 - protein, 221 aa, Triticum aestivum
MAMAAYSNQAQAMMRDYLLADPLVPYTSVLIGVFLCKMAYDLTRILSSFYFKGYSSLTKIQRVEWNNRGMSSAHAIFIAAVSVYLVASTDLFSDRLNGPITFRSSIISTSALGVSVGYFITDLAMIFWLFPSLGGMEYVLHHTLSLVAIAYTMLSGEGQFYTYMILISETTTPEINMRWFLDTAGLKKSSAYLINGILIFVVWLVSISLNCLECSVNKEKS

SEQ ID NO: 48502 - protein, 318 aa, Silene diclinis
NFLFKSSKEDSPLKATDFGLSDFINPGRKFHDIVGSAYYVAPEVLKRRSGPESDVWSIGVITYILLCGRRPFWDKTEDGIFKEVLRGKPDFGRKPWPTISNSAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGKISLAEFRRLLRSASMSS

SEQ ID NO: 48503 - protein, 217 aa, Magnetospirillum magnetotacticum MS-1
MVISSDPCANALKIITRFPRIEGLPVAFFANQPLVLPGVLDSNASRKPARFVRFCNAFSIPIVTFVDVPGFLPGTAQEYGGLIKHGAKLLFAYSQATVPLVTIITRKAFGGAYDVMASKHVGADLNYAWPTAQIAVMGSKGAFEIIFRAEMGDEGKIAERTKEYEDRFLSPFVAAERGYIDEVIMPHSTRKRIARALGMLRTKEMEQPWKKHDNIPL

SEQ ID NO: 48504 - protein, 516 aa, Corynebacterium glutamicum ATCC 13032
MTILFMLITLLLATVIVVAIGDKTGLPWPALMTIVAAGGALLPFLPEFTIPADLMLPIFIPPLLWALARKSSWAVIRSQMSTIITMSVLLVFVTIAALTGASMLLLPGIGLAGAIMLAAAIAPPDPVAVDAVAEPAGIPKRITTTLQTEGLFNDAASIVAFHVALAALVAGEDLSWSTGVLEFLWSCLAAVILGLVIGRAAAWFTDHVSSVEARNAFTWVLPFAIYVVAEEIGGSGVIAIVIAAVEMNSRASIGAEDRLTGSAFWGTIEVLFTGVAFGLIGLNVRAAIDEVGSELWHAVVVGIVLSVVAIVVRGVWMFAAYKRNRFKIDKKGATNSSLRAPLRLQESLLMTWAGMRGLVTLALVLSIPEDIFPYHHELQVIALVVLLITMVGPGLTLPWLMRKLSLDKGPDAAGDESIAALTERAHKAATTYLVDTTELPMEQMVAIKNWFSQEIDADELQENVDKLHQRAHHARVGAIKAAQEELLKARRERGVNPAYVDEVLTNIDRMLVAAER

SEQ ID NO: 48505 - protein, 261 aa, Zea mays
MQLLIANFTEFQLATVITFLLHETVFFLSGLPSLLFERFGLFAKYKIQKRSNTSAYQNRCVLRLILYHVSVNLPVMILSYPAFKFMGLRSSLPLPHWTVVVSQVLFYFVLEDFIFYWGHRALHTNSLYKHFLVNDSMNPCEYATPFGLTSEYAHPAEILFLGFATVVGPALTGPHLFTLWLWMVLRVLETVEAHSGYHFPWSPSNFLPLYGGSDFHDYHPRVLYTKSGNYASTFVYMDWLFGPAKDFRKAKPFEEKKGKNL

SEQ ID NO: 48506 - protein, 318 aa, Silene vulgaris
NFLFKSSKEDSPLKATDFGLSDFINPSRKFTDIVGSAYYVAPEVLKRKSGPESDVWSIGVITYILLCGRRPFWDKTEDGIFKEVLRNKPDFRRKPWPSISNSAKDFVRKLLVKDPLVRLTAAQALSHQWVREGGSALDIPIDISVLHNMRQFVKYSRMKQFALRALASTLNDDELANLRDQFDAIDVDKSGTISLDEMRQALAKDLPWKLKDSRVMEIVEAIDSNTDGFVDFTEFVAATLHVHQLHELDNEKWQELSQRAFEKFDVDKDGYITPEELRMHTGLKGSMEPLLEEADIDKDGRISLAEFRRLLRSASVSS

SEQ ID NO: 48507 - protein, 394 aa, Coccidioides immitis RS
MPPKKQVKEEKVPLGRPGNNLKSGIVGLANVGKSTLFQAITKCSLGNPANFPYATIDPEEARVIVPDERYDWLCEHYKPKSQVPANLTVYDIAGLTRGASTGAGLGNAFLSHIRAVDAIFQVVRCFDDAEIIHVEGDVDPVRDLEIISEELRIKDIEFVEKALEALSKQTRRGGQSLEMKKLKEEEATVAKLLQFLKDGKDIRKGDWSPKEVEVINPLFLLTAKPVVYLINLSEKDYIRQKNKYIPKVAEWIKKNSEGDPIIPLSVAFEERLTRFESDAAAEEECKKLGTKSALPKIIVTMRQALNLGSFFTTGADEVRQWTIRKGTKAPQAAGVIHSDFEKTFIQCIVFNYNVLKEHGDEAAVKAAGKVLTKGKDYVVEDGDIILIKAGAAKG

SEQ ID NO: 48508 - protein, 628 aa, unidentified eubacterium SCB49
MSKRVLFVMGVSGCGKSTVGKLLAQELEIPFIDGDDYHPEANIKKMASGQALNDADRKGWLETLNDLAKQQLSKEGCVIACSALKQKYRDTLSQSIAHQVEWIYLSGTIAQIFERLKSRSDHFMPSTLLQSQFDTLEVPNKALHIDIGLSPEIIIKTIKNKLMIPSDFGLFGLGVMGKSLCRNLANNGFKISMFNRHVDGVEEQVAVNFKAQFSELSTAAAFDDISAFVNSLQQPRKIMLMVNAGKTIDFVIEDLLPHLSKNDILIDGGNSNYLKTKERFDYLKDKGIHFIGTGVSGGEEGALKGPSIMPSGAAEAYEDVKPFLETIAAKDQNGLPCCTYVGTEGSGHFIKMVHNGIEYVEMQLLAEVCSVLKHAGKNLDEIADILETWKETANSYLLEITVDILRKKEGDHYLVNQILDKAGNKGTGNWTTIASTQLGVPSTLIATALFARYTSFYKDERVANNEHFRITTDTTIDITINEMLEGYQFARIMNHYQGFKLISEASKSFNWDLNLSEIARIWTNGCIIRSTLMEDLVTVFKNTTNIIMDENFAAAIKAYKPSVKKVVSQCILNDVSVPCLGESIQFFNGITTANSSANMIQAQRDYFGAHTYKRIDDYGVKSHHTNWK

SEQ ID NO: 48509 - protein, 345 aa, Yersinia pestis CO92
MKYIKLTVLAGIFVGISSPVFALPNITLLATGGTIAGGGDSATKSNYTAGKLGVDALVEAVPAIKDIANIQGEQVVNIGSQDMNDDVWLTLAKKINKDCTKTDGFVITHGTDTLEETAYFLDLTVNCDKPVVIVGAMRPATALGADGPLNLYNAVVVASDADSAKRGVLVAMNDMVFTGRDVVKTNTTSVQTFQSPNTGPLGYIYDGKVNYLHQPAARQLAFDISKLNTLPKVGIIYNYANASDIPAKALIADGYQGIVSAGVGNGNLYHTVFDTLATAASHGVAVVRSSRVPSGSTTEGAEIDDAKYGFVAAGALNPQKARVLLQLALTQTQKPQEIQKLFHTY

SEQ ID NO: 48510 - protein, 510 aa, Aquifex aeolicus VF5
MQRRPILVVNFGSQYVQLIARRVRELGVYSEIVHWDTPVEEIKKKNPYGIIFSGGPASVYAEGAPLPDKRIYELGVPILGICYGLQVITHQLGGKVVRSEKQEYGRARLRIIKEDVIFEGIPKESDVWMSHADKVVELPEGFEVLAVSENSPYAVIANREKKIYGFQFHPEVTHTVFGKEMLANFIYGVCKAEKNWEMGDFIHEKIEEIRKTVGDAKVIAALSGGVDSTVAAVLTHRAIGDKLHCFFIDHGLLRYKEREEVEKNLRSLGLPLTVVDASEEFLEKLKGVEDPEEKRKIIGRTFIEVFEREAKKIEGAEFLLQGTLYPDVVESAGIKGSAKIKTHHNVGGLPERMNLKLLEPFRELFKDEVRKIGKLLGVPEEILRRHPFPGPGLAIRIIGEVNKKDLEILRKADYIFIQELKKEGLYDRVWQAFAVLLPVKSVGVMGDVRTYEKVVALRAVESVDGMTADWARLPYDFLDRVMRRIINEVEGVNRVVYDISSKPPSTIEWE

SEQ ID NO: 48511 - protein, 429 aa, Oryza sativa Indica Group
MVPAIPSYPSDAGMRVTVAQALWPRRYTAHHLPPSSTALLKATNVLPILPNLAVAPPNRRTYPRRPPTPLPLPSRLATVACLVATSAASPRPPDLGGLRCREAAELVLEEAAVGAHILLGLRREEAAALELEEAVINLQRKVAAAKSKQPHRGGEWNGAEPSPRPTRVAAAAGEQVWSGGDAAVESRSRVRIESKGVSSVKKRGGMAMTGYKYQAQELMRDYLLADPLVPYTSVLVGIALCKMLNELVLTEEDLFSDRLKGPITFRNSIISTFALGVSVGYFIADLAMIFWLYPSLGGMEYIVHHTLSLVAIAYTMLSGEGQFYTYMVLISETTTPEINLRWFLDTAGLKKSSAYLVNGILMFVAWLVARILLFIYVFYHIYLHYSQVMQMHAFGYYLTFIVPSVLFVMNTMWFMKILKGVKKTLGKWS

SEQ ID NO: 48512 - protein, 377 aa, Corynebacterium diphtheriae NCTC 13129
MKVIIEADGGSRGNPGIAGSGTLIYNADRSQVLKEYSYVVGKATNNVAEYHGLLNGLRGAAELGATEVSVRMDSKLVVEQMSGRWKIKHPDMKELALECKKVASSIGSVSYEWIPRSENSHADALANKAMDALAEGAAVGFLELEEPAAKTDSEEKVVETATSPAVWNGATTQATRFVLLRHGQTAMSAARQYSGRSNPELTSVGLEQARRAAAFIGRRGGIDAIVASPLQRCQQTAHEVSEQLGGMPVRTIDGLIEMDFGQWDGLSFSQAHEADPELHSAWLDDSRTAPPGGESLQQVHRRVKKVREELERKYAGKTIVVVSHVTPIKSILRQALDASASMFHRMHLDLASISVAEFYSDGPTCVRSVNDTHYLYG

SEQ ID NO: 48513 - protein, 307 aa, Karenia brevis
RIGRLVFRAASANPAVKVVGINEPFMDLEYMVYQLKYDSVHNRFAGTIATKQEGGKDFLIVNGKEICIFHEKDPTQIPWGACGASYICESTGVFTAKEKAELHIRGGAKKVIISAPPKDAVPIYVVGVNHTEYKTSDTVVSNASCTTNCLAPLAKVVHENYGIKEGLMTTVHAMTATQLTVDGPSRGGKDWRGGRCASQNIIPSSTGAAKAVGKCLPALNGKLTGMAFRVPTPDVSVVDLTCALDKGASYDAIVAKVKEAAAGPMKGVLDWTDEEVVSTDFVTCPASSVFDIKAGISLNDNFVKLVT

SEQ ID NO: 48514 - protein, 350 aa, Zea mays
MAAGLGARPSATFVAGRFRPLAAPLRPVRSGKFVVPKRCFIVSSRLAWVEDELMEIQKSQEQSSVKSKKRPPLRRGKVSPQLPVPGHIPRPSYVGAKGLPELCKGQLHDAQGITGMRAACKLAARVLDFAGTLVKPSITTNEIDAAVHNMIIEAGAYPSPLGYHGFPKSICTSVNECVCHGVPDSTQLQNGDIINIDVNVFLNGYHGGTSRTFACGQVDDSIKHFLNAAEECLEKGISICRDGVNYRKIGKKISKLAYFYGYYVVERFVGHGIGTMYHFEPLILHHANENSGRMVEGQTFTIEPILTMEKTECVTWEEGWATVPADGSWAAQFEHTLLVTRDGAEILTKV

SEQ ID NO: 48515 - protein, 223 aa, Listeria monocytogenes EGD-e
MSKKLICPSMMCADFSGLEREVEELDKAGSDVFHVDIMDGAFVPSFGMGLQDFEEIRQKTQKLVDVHLMIMNPGDYVEMFADKGADIIYIHPEADLHPARTLDKIRNKGKKVGIAINPGTAIATIKELLPLVDNVMVMTVNPGFAGQKYLDYVDVKIAELVELKKDYTFEIMVDGAISPEKISKLSQLGVKGFVLGTSALFGKKESYAEIIKKLKQEKMEELR

SEQ ID NO: 48516 - protein, 561 aa, Pseudomonas aeruginosa
MTHLKITGMTCDSCAAHVKEALEKVPGVQSALVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSRRLIGVQAVAPEAGELIQTAALAIRNRMTVQELADQLFPYLTMVEGLKLAAQTFNKDVKQLSCCAG

SEQ ID NO: 48517 - protein, 236 aa, Triticum aestivum
  misc_feature (41)..(41): Xaa can be any naturally occurring amino acid
  misc_feature (95)..(95): Xaa can be any naturally occurring amino acid
  misc_feature (106)..(106): Xaa can be any naturally occurring amino acid
AEYFFWANLGWVTHLTVGPPLGVSWVGEKRPLPQRKFLIWXGAPKNAVCSKIFSRILWGEVDHPFGEAPPGKIEGRNFNCPGPKTPQSCGGIIVXTPPQVFLIKVXKGINFCKKVGGPMFGVLENMSGLRQGFPDLKFVKPGFPGEIKAPGWGVDYIKGKGPEVFSVVACREVFYNNKGGPEKIFQEMGVPFLGKVPMEPQLCKATEEGRLFFPDQRFRASAPGLKSIIDKVVQTQ

SEQ ID NO: 48518 - protein, 306 aa, Exiguobacterium sibiricum 255-15
MQIGITGGAGFIGAALALRLQASGHTVHVIDAFTDYYDVELKLTRAKQLQANGIDVFDGNVHEDLATWCANHSFAALFHLAALPGVPGSLTEPHRYIEDDIAMTVTVLEAARTHGIPHVFFASSSSVYGEQTGALLEQQATGNVMSPYAAAKYSAETFCRTYHNLYDMNVTIFRFFTVYGPSGRPDMALFRFIEQALDGQPLTVFGDPVRDFTYIDDITRGMEQALEAKATGIFNLGANRPESVRDLAAMLSERFNVPVRSAPARIGDVSMTWSNTDAARQTFGYVPSFTLADGIEQMIRWHLERR

SEQ ID NO: 48519 - protein, 349 aa, Rhodococcus sp. RHA1
MKATYMFGAGDVRVIDVPDHTIQSSTDALVRIVRACVCGSDLHPYHSMDAEPAGRSMGHEFIGVVEAIGSDVRTLRVGDFVIAPFAVSCGTCVFCTAGLQTSCVRGGFWNDASLGTAGGQAEAVRVPLADGTLVTVPVGEDADDALLNSLLTLSDVYGTGWHAAVRGGVGAGSVVTVIGDGAVGLSAVLSARLLGAEQIVLMGRHQRRTDLGREFGATDVVAKRGEEGIAKVRELTGGLGSAVVLEAVGHRPAYDQAVGVVRAGGVISRVGVPQYEDAPVGFGSLFGPNVTLTGGPAPVRAYIEQLLPAVLDGTVQPGKVFDRTVGLGQTPEGYAAMDARDALKVAVRP

SEQ ID NO: 48520 - protein, 307 aa, Karenia brevis
RIGRLVFRAAMENQSVTMAAINEPFMDLDYMQYLLSYDTVHSRFKGTVSTKKAGGAEFLVVNGMSVRVFHEKDPASIGWDKAGAAFICESTGVFTTQEKAALHIKGGAKKVIISAPPKDAVPMFVMGVNHEKYTADLTVVSNASCTTNCLAPLTKIVHDNFGLVEGLMTTVHAMTATQLTVDGPSRGGKDWRGGRAASENIIPSSTGAAKAVGKVIPEMNGKLTGMAFRVPTPDVSVVDLTCRIAKPASMKDICAKVKEASETTMKGIMGYTDKEVVSCDFTTDPRSSIFDASACIALNETFIKLVS

SEQ ID NO: 48521 - protein, 803 aa, Cryptococcus neoformans var. neoformans B-3501A
MSAIVTLRAIPTEADTGALKSIVSRDVRRAYISPETLRTHKVAAGDWMRFKSGSTFIMAQAWPKASIDDDVVALSSAQINNLCGSEVEMHHFKAGQSQGRLVSIVLKEVPLTEAPSSSKLNVVTRPPINLDSPREWVWCKAAIKEALTSLHYVRTGYSLIVGDTEKAPRKFEIISVEVSPKDIEKRLASIEDGMEELAIDEENQRLYEMHWKTSVSLEGEKLQENKEVREAIPDEKKVLSTKDFSKMSTSSVPHYINFFTPAESPVSAYTFLGGLQSQIDQIKTLLDLPMLHPDLYIKFGLNPPRGILLHGPPGTGKTALARAVASSAGCSCIVVNGPELSSAYHGETEERLRGVFTEARKRSPCIVVLDEVDALCPRRDGGEGGEVERRVVATLLTLMDGMSHESLEGERVFVVAATNRPNSIDPALRRPGRFDREIEVGVPDVKGRREILDIMLSKIPHSLSEKDLSSLAARTHGYVGADLFSLVRESASAAISRFHLSPSSTLSEPVLTNADILSTLPSIRPSAMREVFIETPTVRWSDIGGQQDVKQKLRECIEWPLMHRDTFKRLGVEAPRGVLLYGPPGCSKTMTAKALATESGINFIAVKGPELLNKYVGESERAVREIFRKARAASPSIIFFDEIDALGSARSDDHAHSGVLTSLLNEMDGVEELSGVTVVAATNRPDVLDSALMRPGRLDRILYVGAPDFETRKDIFRIRLATMAVEPGVNVEQLAEITEGCSGAEVVSICQDAALAAMNESLDAPYVKASHLVNSAHTVRRRITPEMIAFFEEWRDLSGVRSA

SEQ ID NO: 48522 - protein, 380 aa, Ralstonia solanacearum GMI1000
MAKRDYYEVLGVGKNASDDEIKKAYRKLAMKYHPDRNPDSKEAEEKFKEAKEAYEMLSDADKKAAYDQYGHAGVDPNMAGGFGAGAQGFGGFAEAFGDIFGDIFGQAQQGGRRGAGPQMYRGADLRYSMEITLEQAAHGYDTQIRVPHWDECDHCHGKGAEPGSSVETCPTCHGAGQVRVSQGFFTMQQTCPKCHGNGKYIPKPCSKCHGQGKVKSQKTLEVKIPAGIDEGMRIRSSGNGEPGINGGPPGDLYVEIHIKAHSVFERDGDDLHCQMPISFAVAAMGGDIEVPTLGGRVTFNVPEGTQAGKTFRLRGKGIKGVRSGYAGDLYVHVVIETPVRLTEHQRELLRQFDKSVHEGGSRHSPQEQSWLDKVKNFFSS

SEQ ID NO: 48523 - protein, 199 aa, Geobacter sulfurreducens PCA
MLVPIVVEQTGRGERSYDIYSRLLKDRIIFLGGPVDDHVANLVIAQMLFLEAEDPDKDIHLYINSPGGVVTSGMAIYDTMQYIKAPVSTICVGQAASMGALLLSGGEKGKRFSLKHSRIMIHQPLGGFQGQATDIHIHAQEILKLKKRLNEILAENTGQQLAKVEADTERDYFMSGAEAKDYGIIDNIIERNTPSGGTR

SEQ ID NO: 48524 - protein, 277 aa, Asparagus officinalis
ACENWGFFELLNHGISIELLDKVEGMTKGHYKKCMEQKFKEFAKQALERGEELDMISNMDWESTFFLKHLPQSNITGIPDLEDEYREVMKEFALELEKLAERLLDLLCENLGLEQGYLKNRFGGSNGPTFGTKVTNYPPCPRPELFKGLRAHTDAGGLILLFQDDKVTGLQLLKDANWVDVPPMTHSIVVNLGDQLEVITNGKYKSVMHRVVAQTDGNRMSIASFYNPGGDAVIYPAPALIKEEEEEKENEVTTYPKFVFEDYMKLYVAQKFQAKEP

SEQ ID NO: 48525 - protein, 514 aa, Rhodococcus sp. RHA1
MRGGPCGGYPRRMTAIPDSTVGTNTAVAGLESTFADELGALTVPWQGAHAPDPTLLVLNEQLAASLRLDVQTLRSEDGVGVLSGSTAPAGAKPVAMAYAGHQFGGYAPLLGDGRALLLGELTSSDGQRVDLHLKGSGPTPFSRGGDGFAVIGPMLREYLVSEAMYALGIPTTRALSVVATGQNVHRYGAEPGAVLARVAASHLRVGTFEYAVRQGEVLQPLADYAIARHYPELTELPPGRDGNRYLSFFEAVVEAQASLVAKWMLTGFVHGVMNTDNTTISGETIDYGPCAFLDAFDPAAVFSSIDHGGRYAFGNQPVVLKWNLARLAETLLTLFDSTPDDAITAVSAVLATFDERYDGHYAAGMAAKLGLAGELVDRALVDDLLTLLEEHGADWTGTFRALADELRGHSTPLDGLVPREHIGPWLERWRGDLTKHGRGAAETADAMDCVNPLYIPRNHQLDAALRAATDGRLAPFEKLLEVVTHPFDRRDEWSDYTTPAPPSFSKSFQTFCGT

SEQ ID NO: 48526 - protein, 207 aa, Salmonella enterica subsp. enterica serovar Paratyphi A str.
MSYSGERDNLAPHMALVPMVIEQTSRGERSFDIYSRLLKERVIFLTGQVEDHMANLIVAQMLFLEAENPEKDIYLYINSPGGVITAGISIYDTMQFIKPDVSTICMGQAASMGAFLLTAGAKGKRFCLPNSRVMIHQPLGGYQGQATDIEIHAREILKVKGRMNELMAHHTGQSLEQIERDTERDRFLSAPEAVEYGLVDSILTHRN

SEQ ID NO: 48527 - protein, 93 aa, Zea mays
NVVAIAGDDYSIIASDTRLVNGYQIYTRNQSKLFKVTNNTVLGSTGCWCDVVTFNRILETQVKMYSYDHNQEMSCQAAAQLISIMLYNRRFFP

SEQ ID NO: 48528 - protein, 178 aa, Glycine soja
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRCWTMWKLPMFGCTDASQVLKELQEAKTAYPNGFIRIIGFDNVRQVQCISFIAYKPPSF

SEQ ID NO: 48529 - protein, 267 aa, Mirabilis jalapa
PMDTHPHLDDDDDFGGDFTGAHANRRSGIKRSFGDLDDDEDDIFGSNRASSKLDETAPGVATGMILSLRESLQKCKEDLANYEIELEVARSDIQKWNATFQNEPFIPSGTNPEPKLVVNYIQTLSSSEKSLKEQLEKAKKKEAAFIVTFAKREQEIAELKAAIRELRSQLKPLSMQTRRLLLDPAIHEEFTHLKNLVEEKEKKVKELQDNINAVNFTANSKMGKMLMAKCKTLQEENEEIGNQASEGKMQELSIKLALQKSRNSEIR

SEQ ID NO: 48530 - protein, 68 aa, Triticum aestivum
  misc_feature (30)..(30): Xaa can be any naturally occurring amino acid
  misc_feature (39)..(39): Xaa can be any naturally occurring amino acid
  misc_feature (65)..(65): Xaa can be any naturally occurring amino acid
TLSHSSSSLSLSLFSAFDSWSVFFRREWGXTWTFLAGFXVTGALITKMTAGFTEEDLKNSKFVQXHKN

SEQ ID NO: 48531 - protein, 405 aa, Geobacter sulfurreducens PCA
MALVVQKYGGTSMGSIERIRNVAKRVAKTYDAGNDMVVVVSAMSGETNKLVALANEICEFPDTREYDVLVASGEQVSIALLAMCLKSMGYKAKSYHGWQIPIITDSAFSKARIESIDDTKVRADLKDGSIVIVAGFQGVDKDGNITTLGRGGSDTSAVAVAAAFKADVCEIFTDVDGVYTTDPNICQDARKIEKVSYDEMLELASLGAKVLQIRSVEFAKKYNVDVHVRSSFNENPGTMVTKEDKDMEAVLVSGIAYDKNEAKIAVMGVPDKPGIAAKILSPLSDANISVDMIVQNVSGGDLTDFTFTVTKADFKKALAITKEVAKEISAKEVAEDENISKISIVGVGMRSHAGVATKMFQTLAKEGINIQMISTSEIKVSVIVDAKYTELAVRVLHEAFGLSGK

SEQ ID NO: 48532 - protein, 971 aa, Candida albicans
MTSIYTSDLKNHRRAPPPPNGAAGSGSGSGSGSGSGSGSLANIVTSSNSLGVTANQTKPIQLNINSSKRQSGWVHVKDDGIFTSFRWNKRFMVINDKTLNFYKQEPYSSDGNSNSNTPDLSFPLYLINNINLKPNSGYSKTSQSFEIVPKNNNKSILISVKTNNDYLDWLDAFTTKCPLVQIGENNSGVSSSHPHLQIQHLTNGSLNGNSSSSPTSGLLSSSVLTGGNSGVSGPINFTHKVHVGFDPASGNFTGLPDTWKSLLQHSKITNEDWKKDPVAVIEVLEFYSDINGGNSAAGTPIGSPMINSKTNNNNNDPNNYSSTKNNVQEANLQEWVKPPAKSTVSQFKPSRAAPKPPTPYHLTQLNGSSHQHTSSSGSLPSSGNNNNNNSTNNNNTKNVSPLNNLMNKSELIPARRAPPPPTSGTSSDTYSNKNHQDRSGYEQQRQQRTDSSQQQQQQKQHQYQQKSQQQQQQPQQPLSSHQGGTSHIPKQVPPTLPSSGPPTQAASGKSMPSKIHPDLKIQQGTNNYIKSSGTDANQVDGDAKQFIKPFNLQSKKSQQQLASKQPSPPSSQQQQQKPMTSHGLMGTSHSVTKPLNPVNDPIKPLNLKSSKSKEALNETSGVSKTPSPTDKSNKPTAPASGPAVTKTAKQLKKERERLNDLQIIAKLKTVVNNQDPKPLFRIVEKAGQGASGNVYLAEMIKDNNRKIAIKQMDLDAQPRKELIINEILVMKDSQHKNIVNFLDSYLIGDNELWVIMEYMQGGSLTEIIENNDFKLNEKQIATICFETLKGLQHLHKKHIIHRDIKSDNVLLDAYGNVKITDFGFCAKLTDQRNKRATMVGTPYWMAPEVVKQKEYDEKVDVWSLGIMTIEMIEGEPPYLNEEPLKALYLIATNGTPKLKKPELLSNSIKKFLSICLCVDVRYRASTDELLEHSFIQHKSGKIEELAPLLEWKKQQQKHQQHKQETSDTGFA

SEQ ID NO: 48533 - protein, 364 aa, Aquifex aeolicus VF5
MKKYKIAVLKGDGIGPEIVEQALRVLDKIGEIYGVEFEYREGLIGGEAIDKTGDPLPEETLKICKESDAILLGAVGGPKWDNLPTDKRPEKGLLRIRKELDLYANLRPAKVWDALISSSPLKEEVVKGTDMIVIRELTSGIYYGEPRGIFEENGKRYAINTMKYTEDEIRRIVRKGFEIARKRRKKLTSVDKANVLEVSALWRQIVEEEKENYPDVELEHLYIDNCAMQLVRRPTSFDVIVTGNIFGDILSDEAGVVVGSLGMLPSASIGDRYALYEPVHGSAPDIAGKGIANPIATILSAAMMLKYSFNMDKAHDLIEKAIEETLNQGYRTPDIYSEGCIKVGTKEITDKILENLERLKDAYT

SEQ ID NO: 48534 - protein, 416 aa, Alternaria brassicicola
MGDLANRKVFKVFNQEFIVDERYNVTKELGQGAYGIVCAATNNQTGEGVAIKKVTNVFSKKILAKRALREIKLLQHFRGHRNITCLYDMDIPRPDNFNECYLYEELMECDLAAIIRSGQPLTDAHFQSFIYQILCGLKYIHSANVLHRDLKPGNLLVNADCELKICDFGLARGFSMDPEENAGYMTEYVATRWYRAPEIMLSFQSYTKAIDVWSVGCILAELLGGKPFFKGRDYVDQLNQILHYLGTPNEETLSRIGSPRAQDYVRNLPYMQKISFQSLFKNANPDALDLLDRMLAFDPSSRISVEEALEHRYLQIWHDASDEPSCPTTFDFQFEVVEEIPEMKKMILDEVSRFRQMVRVQPGAGAGANQAPQVPIPNNYDRAGYEDPRPQEAFNQGGWNGSDLERDLQGLDGRMR

SEQ ID NO: 48535 - protein, 503 aa, Zea mays
MMLAILARRRAAEAVLRRPQAAAGAAVSAWRAYAAAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLSSPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDTSGDGVKLTLEPAAGGEQNILEADVVLVSAGRTPFTSGIGLETLGVETDKAGRILVDKRFMTNVKGVYAIGDAIPGPMLAHKAEEDGVACVEFIAGKEGHVDYDTVPGVVYTHPEVASVGKTEEQVKALGIAYRVGKFPLLANSRAKAIDDAEGVVKVIAEKETDKILGVHIMAPNAGEIIHEAVVALQYGASSEDVARTCHAHPTVSEALKEACLQTFDKAIHI

SEQ ID NO: 48536 - protein, 330 aa, unidentified eubacterium SCB49
MLRLSTERHLRFSQAKTFAATYGGGEFNVAVSLANYGVPVEFITRLPDNEIGACATKEMRKFNLESKHVVYGGDRLGIYYLETGAGTRGSKVVYDRSNSSMATIEKGTIDWETVLKDVTWFHWSGITPAISASAAEVCLEAVQAAHKLGVTISSDLNYRSKLWQYGKEPKEVMPELLKYSNIILGDIDTALFMLGKDKVDPNYQNETSLPVLYDQIFNVCPNLQTVATTLRYSVSASHQRIGGVLYDGKTICHADIKEVTPVVDRVGSGDAFMGGLIYGLLKDRNNKQRALNIAVAACCLKHTISGDYNLITLDEIEKLLNGDASGKVSR

SEQ ID NO: 48537 - protein, 484 aa, Corynebacterium glutamicum ATCC 13032
MTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 48538 - protein, 172 aa, Catharanthus roseus
MPNPRVFFDMSVGGQPAGRIVMELFADTTPRTAENFRALCTGEKGTGRSGKPLHYKDSSFHRVIPGFMCQGGDFTAGNGTGGESIYGAKFADENFIKKHTGPGILSMANAGPNTNGSQFFICTAKTEWLDGKHVVFGQVVEGMDVVKAIEKVGSSSGRTAKKVVVEDCGQLS

SEQ ID NO: 48539 - protein, 86 aa, Listeria seeligeri
TITLAAKALREAGATKVYACCSHPVLSGPAMKRIEESPIEKLVVTNSIALPEDKWIDKMEQLSVAPLLGEAIVRVHENASVSSLFE

SEQ ID NO: 48540 - protein, 619 aa, Populus tomentosa
MICWNDLYNVLSAVIPLYVAMILAYGSVRWWKIFSPDQCSGINRFVAIFAVPLLSFHFISTNDPYAMNFKFIAADTLQKIIMLIALGIWTNFTKNGSLEWMITIFSVSTLPNTLVMGIPLLTAMYGTYSGSLMVQIVVLQCIIWYTLLLFLFEYRGAKMLIMEQFPETAASIVSFKVDSDVVSLDGRDFLETDAEIGDDGKLHVTVRKSNASRRSLGPGSFSGMTPRPSNLTGAEIYSLSSSRNPTPRGSNFNPSDFYSMMGVQGFPGRHSNLGPADLYSVQSSRGPTPRPSNFEENCAPTATLSSPRFGFYPAQTVPTSYPAPNPEFASTVTTKTAKNQQQQNSKANHDAKELHMFVWSSSASPVSEGGGLHVFGGTDFGASEQSGRSDQGAKEIRMLVADHPRNGETKTIPQQDGDFAGEDFSFAGRGEGDDVDQREKEGPTGLNKLGSSSTAELQPKAAEAPDSGGSRKMPPASVMTRLILIMVWRKLIRNPNTYSSLIGLTWSLVAFRWHVEMPKIIKQSISILSDAGLGMAMFSLGLFMALQPKLIACGNSVATFAMAVRFLTGPAVMAAASIAVGLRGTLLHVAIVQAALPQGIVPFVFAKEYNVHPAILSTA

SEQ ID NO: 48541 - protein, 185 aa, Forsythia x intermedia
SYPHKILTGRRDKMHTLRQTNGLSGFTKRSESDYDCFGAGHSSTTISAGLGMAVGRDLKGRKNNVVAVIGDGAMTAGQAYGAMNNAGYLDSDMIVILNDNKQVSLPTANLDGPIPPVGALSSALSRLQSNRPLRELREVAKGVTKQIGGPMHEIAAKVDEYARGMISGSGSTLFEELGLYYIGPV

SEQ ID NO: 48542 - protein, 368 aa, Prochlorococcus marinus str. MIT 9211
MSILKRLPRIFDRSHEYKHWPGLIKAYKKWLPVTDKTPIITLQEGATPLIPLKSINELIGKNVKIFVKYDGLNPTGSFKDRGMTMAISKAKEDNCEAVICASTGNTSASAAAYAKRGGMKSFVLIPDGYVAQGKLAQALVYGAEVLAIKGNFDKALNIVQELSNRYPITLVNSVNPYRIQGQKTAAFEIIDSIGEAPDWLCIPMGNAGNITAYWMGFEEYYKAGKSKKLPKMMGFQAIGSAPLVFNKTIENPETIATAIRIGNPVNKEKAFIVKGKSKGKFTAVTDKEIIDAYKLLGKEEGIFCEPASAASIAGLIKLKEEIPPNSTIVCVLTGNGLKDPDCAINNNDASFKNNLEPNSDEIAKAIGF

SEQ ID NO: 48543 - protein, 270 aa, Exiguobacterium sibiricum 255-15
MQYAKLSNGVTIPQIGFGVWQVDEETEAPAAVAEALRVGYRHIDTAAVYKNERGVAKGIKESGVNREDLFLTSKVWNDDIRAGRTKEAFAESLERLETDYLDLYLIHWPVEGYIEAWKAMVELYEAGKIKAIGVSNFKEHHLDTLAEEGLMTPMINQVELHPQLPQHELHEYLQDHSIQVEAWSPLMQGKFLEINDFKEIAEKHGKSPSQVVLRWHLDNGIVALPKSVTPERIAENFDVFDFQLDADDLEKIDRLATDVRLGPDPDEIDF

SEQ ID NO: 48544 - protein, 251 aa, Picea sitchensis
MERVDEHGTSTEDLEKAAVFYKVNVNDLPVDDSRIGGLRNAVKEMLFPDDPFRRFKNQPTTRKWIIGLQYVFPILEWLPTYSFRLFKSDIVSGITIASLAIPQGISYAKLANLPPVMGLYSSFVPPLIYAILGSSTDLAVGTIAVVSILLASMLSHEVSPIHNPELYVRLAMTATFFAGVFQASLGIFRLGFIVDLLSHATIVGFMAGVATIVSLQQLKGILGLRHFTAKTDIVSIVRSVSEQVDKVSQDQ

SEQ ID NO: 48545 - protein, 448 aa, Streptococcus suis
MSNAKAYIQASFEAVKARNPHETEFLQAVEELFSTLEPVFEAHPEYIEENILARIVEPERIISFRVPWTDKYGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYATEKATAKYFEGSVWNYDGKADIALPCATQNEINGEQAAALVKNGVYCVAEGANMPSDLDAIKVYKENGVLYGLAKAANAGGVAVSALEMSQNSLRLSWTREEVDGRLKDIMANIFNTAKETAEKYDLGTDYLAGANIAAFEQIADSMIAQGLV

SEQ ID NO: 48546 - protein, 269 aa, Actinobacillus pleuropneumoniae serovar 1 str. 4074
MAAYDQGAHVTYIDPTSSQIGHKESMKDTARVLGRMYDAIEYRGFKQSVVNELAEYAGVPVFNGLTDEFHPTQMLADVLTMIENCEKPLSQISYVYIGDARNNVGNSLLLIGAKLGMDVRICAPKALLPEDSLVEMCQKFAAESGARITVTDDIDTAVKGVDFVHTDVWVSMGEPLETWGERIDMLMPYQVTPELMKRTGNPKVKFMHCLPAFHNSETKIGKQVAEKYPALANGIEVTEDVFESPANVAFEQAENRMHTIKAVMVASLA

SEQ ID NO: 48547 - protein, 460 aa, Exiguobacterium sibiricum 255-15
MKEHPTELRRDLKTRQLTMIAMGCAIGTGLFLGSGLAISLAGPSVLVSYAIGAFIVLLLMGCLAEMTVAHPTSGSFGTIAEKYIGPYAGFLVRYSYWVANVLAIGVEVSAIAIYMKYWFPDVPGYIWIFVFAAALIYINATTVNTFATFEYWFSVIKISAILMFMILGAYLVFGSSSPEIGPQNFTNDGGFMPFGFSGLWIAVFISLFSFLGTELIAVTAGEAKDPDVAVPKALKATVFRLSTFYVITIALMLMIVPWQQAGGVDESPFVKVMEMLSIPGAAGIMNFIVLTAALSAMNSQLYASTRMMYSLSKATYAPRMFSRLNAKGVPLFALAVSTLGIFLAAVISSQSSVSYPFMMGISMFGAIFTWFMIFISHLYFRKAWERDGGRKLPVRMMGYPYLTALGALLLFALVITTWFTDFQIVLKFGIPWLIFLTIAYVFWKRNHPPQADQTNRSQSL

SEQ ID NO: 48548 - protein, 448 aa, Streptococcus suis
MSNAKAYIQASFEAVKARNPHETEFLQAVEELFSTLEPVFEAHPEYIEENILARIVEPERIISFRVPWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAAEKATAKYFEGSVWNYDGKADIALPCATQNEINGEQAAALVKNGVYCVAEGANMPSDLDAIKVYKENGVLYGLAKAANAGGVAVSALEMSQNSLRLSWTREEVDGRLKDIMANIFNTAKETAEKYDLGTDYLAGANIAAFEQIADSMIAQGLV

SEQ ID NO: 48549 - protein, 309 aa, Cryptococcus neoformans var. neoformans B-3501A
MSLATPAIIRRLAVSSRTAAPLLRAVSSNVTRTFASSSRQQLVASAPRSVGFRSTAVSGLRRKTSLLHMSPIIRQQRRTMFIQTETTPNEASLKFIPGVQVTNGAAHEFLDLRSALQSPLATRLLTIDGITGVFFGPDFVTCSKDDSYSWSILKPEVFAVLMEHFSSGASLFKEGSGESQAEDTRILDTDSEIVGMIKELLETRVRPAIMEDGGDIEYRGFDEDTGLVKLKLKGSCRGCSSSSVTLKNGIERMLTHYVPEVQSVEQVLDEEELIALDEFAKLEARLEKEQGGDKAGKSGKGDMSSYLSV

SEQ ID NO: 48550 - protein, 357 aa, Pseudomonas fluorescens
MSKFHSLTIKDVRPETRDAVSIAFDVPAELADSFRFTQGQHLVMRTQLDGEEVRRSYSICTGVNDGELRVAIKRVAGGRFSAYANESLKAGQRLEVMPPSGHFHVELDPARHGNYLAVAAGSGITPILSIIKTTLETEPHSRVTLLYGNRSSASALFREQLEDLKNRYLQRLNLIFLFSREQQDVDLYNGRIDADKCGQLFSRWIDVKALDAAFICGPQAMTETVRDQLKANGMAAERIHFELFAAAGSAQKREARESAAQDSSVSQITVISDGRELSFELPRNSQSILDAGNAQGAELPYSCKAGVCSTCKCKVVEGEVEMDSNFALEDYEVAAGYVLSCQTFPISDKVVLDFDQI

SEQ ID NO: 48551 - protein, 337 aa, Yarrowia lipolytica
TAVADTGAPITIPVGRGTLGRIINVCGEPIDERGPIEASKYLPIHADPPTFAEQSTSAEVLETGIKVVDLLAPYARGGKIGLFGGAGVGKTVFIQELINNIAKAHGGFSVFCGVGERTREGNDLYREMKETGVINLEGESKVTLVFGQMNEPPGARARVALTGLTIAEYFRDEEGQDVLLFVDNIFRFTQAGSEVSALLGRIPSAVGYQPTLATDMGALQERITTTQKGSVTSVQAVYVPADDLTDPAPATTFAHLDATTVLSRGISELGIYPAVDPLDSKSRLLDIDVVGKEHYDVASNVQQTLQAYKSLQDIIAILGMDELSEQDKLTVERARKI

SEQ ID NO: 48552 - protein, 364 aa, Cryptococcus neoformans var. neoformans B-3501A
MTFSFLEKGALQHILIALAWLAIARADSIDAIADSADSSCASGDVAGHYDLGLHIASVFVLLVASGLGVFLPVILGEKGSRSVWFGNTFFVLKYFGTGIIISLAFCHLLQESFKTFSNECIGELAYEPTAPAIAMGSMFVIWLIDFFGSRRLANRKALSSLDVHQSCEPCEPSSPDTKSPVADLCCDSGLKSVAETSDRANRRAHWDVQLLEGGIVFHSIMIGVSLGAQTDGFSATFAALIFHQLFEGLGLGARISLLIWPSGITSSVKKHLLCLAYTLTTPVGIAIGIGVHQSFNENGEAELLAIGVLNSVSAGILLYSGLCQLLYSEWVVGDMRDASNMRVAVALIALVSGLFGMSLIGKWT

SEQ ID NO: 48553 - protein, 337 aa, Clavispora lusitaniae
ASVTDTGSPISVPVGRETLGRIINVVGEPIDERGPINSKKRNPIHTEPPSFVEQSTSAEVLETGIKVVDLLAPYARGGKIGLFGGAGVGKTVFIQELINNIAKAHGGFSVFTGVGERTREGNDLYREMQETGVINFEGDSKVALVFGQMNEPPGARARVALTGLTIAEYFRDEEGQDVLLFVDNIFRFTQAGSEVSALLGRIPSAVGYQPTLATDMGALQERITTTKKGSVTSVQAVYVPADDLTDPAPATTFAHLDATTVLSRGISELGIYPAVDPLDSKSRLLDASIVGKEHYEVASNVQQTLQAYKSLQDIIAILGMDELSEADKLTVERARKI

SEQ ID NO: 48554 - protein, 135 aa, Zea mays
MDSSDIITVVLVMHGTPCFRGYGRRNVERRRNSVRGCIVSQDLSVINLVIVKKGEKDLPGLTDTEKPRMRGPKRASKMRKLFNLSKDDVHKYVNTYRTFTTKNGKKRKRARITDKKKKIAKESEAAEYQNLLARG

SEQ ID NO: 48555 - protein, 510 aa, Burkholderia mallei ATCC 23344
MTQQNRYDLLVVGGGINGAGIARDAAGRGLSVLLCEQDDLASHTSSSSTKLIHGGLRYLEYKEFGLVRKALQERETLLRAAPHIMWPLRFVMPHMPNLRPAWLIRIGLFLYDHLAKRELLPGSRGIDMRRHPAGAPLVDSIKRGFVYSDGWVDDARLVVLNALDAQERGARILTRTKLVSAERRDGQWHARLQRADGSTLDVRARAIANAAGPWVGEVLHGALGRGAQHSVRLVKGSHIITPRLFDHDHAYIFQNPDKRIIFAIPYERDFTLIGTTDVEYRDDPSRVAIDRDETRYLCESINRYFKRKISPADVCWTYSGVRPLLEDENADNPSAVTRDYRLELDDGEGAPLLSVFGGKITTFRKLAEEATDMLGGALGAARGAWTAGVPLPGGDIANARFAPFAEAFAKRHPWLPAALARRYARAYGTRAERVIGRARSHAELGVQLAPGLYEAELRYLRDVEWAGCADDVLWRRSKLGLHVAPGTLEPVTAALDAWFGAAREAASAAH

SEQ ID NO: 48556 - protein, 453 aa, Debaryomyces hansenii CBS767
MAKVEDLSNSHLMHRSLREEPDVVNNAKGSYIFLQNGQKVFDGCGGAAVIAVGHGNSEVIEAVSKQLSVVSYVHTFEYTTPVAEELANILLKNYSGKIAKVYFVNSGSEANEAAVKVAVQYFYEQGKTSKTQFISRKQSYHGNCLAGMSLSGHVLRRKPFENLVSDKFHKVSEANEYRWKKNDETTGEYVERLANELEAKILEVGPDNIAGFFAETIVGATTGCLTAPKGYFKAIQKICEKYDVLLITDEIMCGSGRTGTFFAWEQEDFVPDITTSGKALGGGYSPLSAVFMNQKVVDVLLNGSASFNNGHTFQCYPLSCAAGIAVQKIIQRDNLLQNVKVMGEYLGQALVKELKDIKIVGNIRGRGLFWGVEFVKDKLTKEAIDPRIRIGQKIQHNALVNGLAIYPGFGTIDGLSGDHILIAPSYDITQDQVNVMVQQVAASIIEMEQKYAT

SEQ ID NO: 48557 - protein, 488 aa, Aspergillus nidulans FGSC A4
MVASAVRMRVPSASFISKGACSLRRPQASYKFTAAIQHQLPALAALSRYYASKSFPPHTIISMPALSPTMTAGNIGAWQKKAGDALQPGDVLVEIETDKAQMDFEFQEEGILAKVLKESGEKDVSVGSPIAVLVEEGTDVAAFESFSLEDAGGEGAGAAPPKETQETPKEAPKASEPSTPQPAAGAYEPDTSGEKLQPSLDREPAISPAAKALALEKGVPIKALKGTGRGGQITKEDVEKYKPTAAAAAAGPASEDIPLTSMRKTIASRLQQSWNQNPHFFVSTTLSVTKLLKLRQALNASSEGKYKLSVNDFLIKACAAALRKVPQVNSSWTEENGQVVIRQHNSVDISVAVATPVGLITPIVKNAQGLGLSSISNQVKDLGKRARDNKLKPEEYQGGTFTISNMGMNPAVERFTAIINPPQAGILAVGTTRKVAVPVETEEGTSVEWDDQIIVTASFDHRVVDGAVGAEWIKELKKVVENPLELLL

SEQ ID NO: 48558 - protein, 253 aa, Oryza sativa
  misc_feature (220)..(220): Xaa can be any naturally occurring amino acid
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCRXLAAKPDVDGFLVGGASLKPEFIDIINSATVKSA

SEQ ID NO: 48559 - protein, 462 aa, Vitis vinifera
  misc_feature (160)..(160): Xaa can be any naturally occurring amino acid
  misc_feature (401)..(401): Xaa can be any naturally occurring amino acid
  misc_feature (450)..(450): Xaa can be any naturally occurring amino acid
MLSERKQSKYVCVIGAGPSGLVTTRELRKEGHCVVMMEQNHDVGGQWLYDPNVEGEDPLGRSKFLKVHSSIYASLRLASPREIVGFSDFPFVVKKGRDTRRFPGHRELLWYLEDFCEWFGLRETIRFNTKVEYVGMLDSDEVGGGLKWVVRSRDVKSEKXVEELFDAVVVATGQYSHPRLPSIKGMEAWKRKQMHSHIYRVPHPFHNEVVVVVGNAASGQDISIELVDVAKEIHLSAKSLDISEGLSRIISKHHNLHLHLQIESLHEDGRVVFVDGSWVVADTIIYCTGYSYSFPFLDTKGIVAVDDDRVGPLYEHTFPPSLAPSLSFVGIPRKILGFPFFESQAMWIAQLLSGRKTLPSFHDMMRSIEDFYQSRDAAGIPKHQTHDIADFEYFDKYGDNXGFPHTEEWRKKLLLSTVGNAQVNLETYRDSWYDHELLQVLSNLIQIIFXSSKVRCKRRKVD

SEQ ID NO: 48560 - protein, 557 aa, Burkholderia mallei ATCC 23344
MPAMNLHSNLSGAPFSWRNPYPTTRVPVFARNVVSTSHPLAAQAGLRMLWKGGNAVDAAIAAAAAITVVEPVSCGLGGDAFALVWDGAKLHGLNASGVAPAAWSVDYFRRRHGEAGNGLARQPVRGWDTVTVPGVIAGWEALHAKFGTLPFADLLEPAIELAERGHAVAAVVAHKWAAAVPELSGQPGFAQTFMPHGRAPDVSERVRLPGHARTLRTIAAEGARAFYEGSLAESIAAFFRDGGGALTLDDLRAYRPEWVEPIGKDFRGYTVHEIPPNGQGIAALIALGIVEHFGLDDLPLDSAQAQHVQIEAMKLAFADVYRYVADPRAMELTPAQMLDDAYLAARAKLIDPRHATHFSFGMPRAGGTIYLSAADERGMMVSFIQSNYMGFGSGLVVPGTGIALQNRGCGFSMDPASPNVVAGGKRPFHTIIPAFVTQQAGSARHAVMSFGVMGGDMQPQGHLQTVVRMLGYGQQPQAACDAPRWKVSRSFTLDVEATFDASVVEALAARGHTIQAIDDPYMDFGSGQFIWRLDRDEPDRGYVAASDSRRDGLAAGF

SEQ ID NO: 48561 - protein, 480 aa, Koeberlinia spinosa
EKKNLGRIAQIIGPVLDVVFPPSNMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMESK

SEQ ID NO: 48562 - protein, 410 aa, Pseudomonas syringae pv. phaseolicola 1448A
MALIVQKFGGTSVGSVERIEQVADKVKKFREAGDDLVVVLSAMSGETNRLIELARQISDQPVPRELDVIVSTGEQVTIALLAMALMKRGVPAVSYTGNQVRILTDSAHNKARILQIDDQKIRSDLKAGRVVVVAGFQGVDEHGNITTLGRGGSDTTGVALAAALKADECQIYTDVDGVYTTDPRVVSQAQRLDKITFEEMLEMASLGSKVLQIRAVEFAGKYNVPLRVLHSFKEGPGTLITIDEEESMEQPIISGIAFNRDEAKLTIRGVPDTPGVAFKILGPISAANIEVDMIVQNVSHDNTTDFTFTIHRNDYQAALQVLESTAREISAREVFGDTKIAKVSIVGVGMRSHAGVASRMFEALAKESINIQMISTSEIKVSVVIEEKYLELAVRALHTAFELDAPRQGE

SEQ ID NO: 48563 - protein, 340 aa, Debaryomyces hansenii CBS767
MISQLAKGEPSIDTSLIEVTDKLPNKPPCRIFIKNEYEQPSGSFKLRGMGHLVAKSIERAHELKKENVETFASSGGNAGLAAAYTSRHYNLSCTVVLPTTAHSGVVEKLEKLGAKVQVHGAHWGEADSYLREIVMKSVDASVYPVYCPPFDDPLLWEGHGTIIDEIVNQNQLSPEECGKVRGIVCSVGGGGLYNGVVAGLLRNAQFKDVPILAVETFQTPTFSEALKAGKVVTLKSINTLVSCLASPYISAQSLANYNKHRTHVQMIDDLEAVKGSIDFYDHFGTLVEPACGATISMAFDNTLYLKCFGNLSDEEIIIFIGCGGAAISVDSLNEYRKLFT

SEQ ID NO: 48564 - protein, 414 aa, Arabidopsis thaliana
MASISETSDDGSNGGVPNQKPEEPHKNPQEEKENQNENPNEADEEDDHQDEEVENVPPIPRKIPPVLIENTIAPLRRCHYPKLSLLSNAFRQVISSEDLFQVRSLIGSTEPVLYTLITFKYPTFEEGRWFILQRRNNTSLKLNCVTSLPPMFLGCTAVTIGHKIYVVGGYNFRYNKTISTVLEIDCRFNTCRHLRNMKRDRCSAVAGVIDGRIYVVAGRQRRFDDWVEVFDVETERWELVPGPFSSFASSSGKFIVHVVLDNKIYIMDGDYCFAYDPRRRRWETWGPESAQRSYWHLSSCVVDDLLYAIVPREIFGASIVVYDPRGIAWRPVMGLEFWPNLVYFESKMANFGGKLVILGCYRSSFDYYRKDVWCVEVALEKHEDGQIWGKVESLSLVNAFPMSPFFELSRTVTI

SEQ ID NO: 48565 - protein, 563 aa, Kluyveromyces lactis NRRL Y-1140
MSEITLGRYLFERLKQVEVQTIFGLPGDFNLSLLDNIYEVPGMRWAGNANELNAAYAADGYARLKGMSCIITTFGVGELSALNGIAGSYAEHVGVLHVVGVPSVSSQAKQLLLHHTLGNGDFTVFHRMSSNISETTAMITDINTAPAEIDRCIRTTYVSQRPVYLGLPANLVDLTVPASLLDTPIDLSLKPNDPEAEEEVIENVLQLIKEAKNPVILADACCSRHDAKAETKKLIDLTQFPAFVTPMGKGSIDEKHPRFGGVYVGTLSSPAVKEAVESADLVLSVGALLSDFNTGSFSYSYKTKNIVEFHSDYTKIRSATFPGVQMKFALQKLLTKVADAAKGYKPVPVPSEPEHNEAVADSTPLKQEWVWTQVGEFLREGDVVITETGTSAFGINQTHFPNNTYGISQVLWGSIGFTTGATLGAAFAAEEIDPKKRVILFIGDGSLQLTVQEISTMIRWGLKPYLFVLNNDGYTIERLIHGETAQYNCIQNWQHLELLPTFGAKDYEAVRVSTTGEWNKLTTDEKFQDNTRIRLIEVMLPTMDAPSNLVKQAQLTAATNAKN

SEQ ID NO: 48566 - protein, 385 aa, Thermococcus kodakarensis KOD1
MELHFDMTYEDAYREVYEMVKPKYKLFTAGPVACFPEVLAIMSVQMFSHRSAEAKAVHVDTLNRLKAFLEADKGEIILFPSSGTGFMEAAVRNTIPRGGKVLVTVIGAFGKRFADVVNANGREAVILEKEPGKAIKPEELDDALRKNPDVHAVTITYNETSTGVLNPLPELAKVVQEHDKLLFVDAVSAMGGADIKFDKWGLDMIFASSQKAFGVPPGLAVAAVSERVFEIAEKMPERGWYFDLPLYKKFNEKKKGTPSTPPLPQIFGLNVVLRIVEKMGGKEAWLDMYRKRSEMIREGVKEMGLGILAEPGYESPTITAVVVPEGMKGVDVYNAMRERGFELAKGYGSVAEKTFRIGNMGYMTFDDIREMLDNLREVIEELKKK

SEQ ID NO: 48567 - protein, 573 aa, Actinobacillus pleuropneumoniae serovar 1 str. 4074
MITGIAASPGVVFGKALVLKEEPIVLNTQKITADQIEAEKAKFFAGREKAAAQLTAIKEKARGTLGEEKEAIFEGHLMILEDEELEEEILGYIADNLVTADVAASKVIDMQASMLAEIDDEYLKERAGDIRDIGNRLLRNILNMHIIDLGDIQEEVILVAYDLTPSETAQLNLDKVLGFITDIGGRTSHTSIMARSLELPAIVGTNDITARVKTGDTLILDAVNNQIHINPSDAALAEFKAIQERVAAEKAELAKLKDLPAETLDGHRIEVAGNIGTIRDVDGVLRNGGESVGLYRTEFLFMDRSELPSEEEQFQAYKEIVEAMDGKQVVLRTMDIGGDKELPYLNLPKEMNPFLGWRAVRIGLTRREILDTQLRAVLRASAFGKLAVMFPMIISVEEIRELKAIVAELKEQLRAEGKAFDENLQLGIMVETPSAAVNARHLAKEADFFSIGTNDLTQYTLAVDRGNEIIAHLYNPLSPSVLNLIKQVIDASHAEGKWTGMCGELAGDVRATALLLGMGLDEFSMSAISVPHVKKLARSINYADAKALADEALAQPTATDIEKLVNDFYAKLN

SEQ ID NO: 48568 - protein, 327 aa, Oryza sativa
MGGGSIRAAAKAAMIGGYRSASAVRRAVLPASPAPQTAPSAAGEGRKAASTYAAIDDWVIPDREVFGPVPTHEEAMAATLDLKESFQFAKSAQLEPLPSGDLDVPTKVGQEGLVHSETPQDLVHSETQGLVDLGASQDLVHSETSQGLVHSESSQGLIHSKTSEHEDNHEISLVSSGAPGRVVQAFTMLQDSPEAQEVVASLASDQNVWNAVMRNEKVMKFYKTYATKLNEDEVEGSESDSVQNSSELGSALQAFMCYVEKMKALVSEMMTNLSSIMQDLVATSDEGQSKGKLKTMILDSKKDFANAPSAFVLLAIASIMVVLLKRA

SEQ ID NO: 48569 - protein, 506 aa, Coccidioides immitis RS
MATEAPSHVNGAYTHHQPAPYHADRYPAANAPHTHQPSNASTPAPPPQEAKNDIPKEEVAWFFVEQYYTTLSRTPEKLHLFYSRKSQFVSGNEAEKVGVSVGQTAIQDRIKSLDFHDTKVRVLNVDSQASFDNILVSVIGELSNRSEPPRKFVQTFVLAEQRNGYYVLNDIIRFLVDDDEEAIADEQDAVEAPAAEAPSEPAEQQAAPQRLETERQADTEAAAQEVDEKLQESVKEVVETKPEEPEAVVEPAQAAEVTTEALQQEKPKEPEPTPIVSPPNAATPAAEKENVPPARPVSMTWASIASSNANKAAAAAVATPVAVPQAAPAAQPKVAAAPPQPAPPANGESAPSQTSSTSSSEWQTAGRGRDDNVLAYIKNVNDKVDAALLKQTLQRFGKLKYFDVSRQRSCAFVEFADAAGYKAAVAANPHQIGTERITVEERRPRATAYGGNASYGPGRGGAGRGRGDRTASQGRGGFQKDSGRFTPRGGRGGTITPKGRPQSQAA

SEQ ID NO: 48570 - protein, 104 aa, Kluyveromyces lactis NRRL Y-1140
MVAQLTSASEFEKALTDDKLVVVDFFATWCGPCKMIAPMLEKFAKEYEGKATFLKVDVDELPDVAKNNDVSAMPTLVFFKSGKEISRVLGANLAAIKQTIAANV

SEQ ID NO: 48571 - protein, 309 aa, Picea sitchensis
MLKEIYSKSACWMKKQLQQQHDATWFDIKVFYIKIDACGFDPAPGSLTVHYAPRSSSTELEINGKRIRPSASAFLTLRRNGIDENASVATYVSTDVTRTTGKVCFDVCVREETLICGTLERKGSVKYDDVTQLRQPSWTVDFCCALDYPSKWSSTKPNINKFPSLELYIAGRAGSSAMVLTGTEQLIPRRKRVRHGVTLDVIPEGNDYENSIFNSADHDRLENEETFMELDDTSIAMMCDAATERLIALFEPWEVQCFKCSQLSWLNAGLRLGVGFVLGACLGLGVGVVILFMRTYEARIRHLRSLNQD

SEQ ID NO: 48572 - protein, 340 aa, Triticum aestivum
MLLTKPHPALTLPSASLPNPNLKAARVRPLASSAPHGRRGLRVSASSSSLAPAQAASAALNRVDVLSEALPFIQRFKGKTVVVKYGGAAMKSPELQASVIRDLVLLSCVGLRPVLVHGGGPEINSWLQRVGVEPQFRNGLRVTDALTMEVVEMVLVGKVNKQLVSLISLAGATAVGLCGKDARLLTARPSPDAAALGFVGEVTRVDPSVLHPIIASGHIPVIATVAADETGQAYNINADTAAGEIAAAIGAEKLLLITDVSGILADRDDPGSLVKEIDIAGVRRMVAEGKVGGGMIPKVGCCVRALAQGVHTASIIDGRVPHSLLLEILTDEGTGTMITG

SEQ ID NO: 48573 - protein, 320 aa, Ashbya gossypii ATCC 10895
MATNAIKLLAPDIHRGLAELVAKRLGLRLTDCKLKRDCNGEATFSIGESVRDQDIYIITQVGSGDVNDRVLELLIMINASKTASARRITAVIPNFPYARQDRKDKSRAPITAKLMADMLTTAGCDHVITMDLHASQIQGFFDVPVDNLYAEPSVVKYIKEHIPHDDAIIISPDAGGAKRASLLSDRLNLNFALIHKERAKANEVSRMVLVGDVTDKVCIIVDDMADTCGTLAKAAEVLLEHNARSVIAIVTHGILSGKAIENINNSKLDRVVCTNTVPFEEKMKLCPKLDVIDISAVLAESIRRLHNGESISYLFKNNPL

SEQ ID NO: 48574 - protein, 305 aa, Oryza sativa Indica Group
MAAAVVLEENQGANNAEWTDENTRIVCELFAEQVRIGNRSNTHLNKVGYDNVIAKFEEKTGLRYQKLQFKNKWSKLRNEYNLWKKLIARETGLGWDQARATIVASDDWWARAKKDLPGCAKFKLRGIQNEHLLQQIFEDLRNTGDDHWNPTSGNLPQSSTQPSSTINVDTEAVNEGDDDDSNDEDFSPPPKRGKAAAGKEAKKPKTSGGHWFYEQMSRFVDNQEKSAASVESLVRREDTSGCAIKDVMALVKECGAVFGTKEHFIATEIFTKKSEREMFMTLDNSEERFAWLTMKHESKMAKYSK

SEQ ID NO: 48575 - protein, 295 aa, Aspergillus nidulans FGSC A4
MNKEAPLSIAERDFILDALREGVRLDGRGADQLRPLTLSFGEEYGHVKVQLGKTSLVVRISAEVAKPHDDRPFDGIFNIAMELTAMGSPAWENGRQGDLETYVTNVLDRVIRHSNALDTESLCILKGVSCWTIRADVHITDYDGNLIDASCIGVMAGLQHFRRPDAVVKDGQVIVYGLDERVPAPLNITHKPLSVTFHTFDDGKLAILDATRKEEQASEADVVIGMNNAGDVCYLSKFQGSPVDALVFITKTSLALEKVKYINGIIDKALQADLAKRSKGGLAEQARAENDRPVA

SEQ ID NO: 48576 - protein, 215 aa, Papaver rhoeas
MSEEAATETGSSSVKRTTPKLNERILSSLSRRSVAAHPWHDLEIGPGAPSVVNAVVEITKGSKVKYELDKKTGMIKVDRVLYSSVVYPHNYGFIPRTLCEDNDPLDVLILMQEPVLPGCFLRIRAIGLMPMIDQGEKDDKIIAVCADDPEYRHYTDIKQLAPHRLAEIRRFFEDYKKNENKEVAVNDFLPSATAHEAIQYSMDLYAEYIMMSLRR

SEQ ID NO: 48577 - protein, 236 aa, Papaver rhoeas
MDPPTEIANDVAPAKNDVAPAKNKTLNAIKAASYSSHARPSLNERILSSMSRRAVAAHPWHDLEIGPGAPTIFNCVVEIPRGSKVKYELDKKSGLIKVDRILYSSVVYPHNYGFIPRTLCEDADPLDVLIIMQEPVLPGCFLRAKAIGLMPMIDQGEKDDKIIAVCADDPEYRHYTDIKELPPHRLAEIRRFFEDYKKNENKEVAVNDFLPAEDASKAIQHSMDLYADYIVEALRR

SEQ ID NO: 48578 - protein, 142 aa, Fragaria x ananassa
MEQDFHAERFKEFLRGGYNNETPAASNIVLFMGAVTKPPNLSIVTEYLSRGSLYRLLHKPGPVLDERRRLNMAHDVAKGMNYLHRRNPPIVHRDLKSPNLLVDKKYTVKVCDLVFPVKGQHLSFIKITAGTPEWMAPEVNRD

SEQ ID NO: 48579 - protein, 324 aa, Candida tropicalis
MSTTPTIPTIKLNSGYEMPLVGFGCWKVNNETAADQIYNAIKTGYRLFDGAEDYGNEKEVGEGINRAIKEGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFKHETIKSIADKHGKSPAQVLLRWATQRNIAVIPKSNNPERLAQNLSVVDFDLTKDDLDNIAKLDIGLRFNDPWDWDNIPIFV

SEQ ID NO: 48580 - protein, 364 aa, Zea mays
MADTQKDVLFKTVQIDALVAIKIATASGKSFPSIATGSIVGMEKNNVLEITNSFPFPDVSPAQADGQNETAANLAAAAPRAKQNIAYSNEMIKFLREVNVDANNVGWYTSTSMGNFVNLNTIENQYFYQSQPNERTVALVYDVSRSSQGTLNLRAYRLSPSFVTAYKEGKFTTESLQKSGLRYHDILVELPVTIHNSHLLTSLLHQLPSSAPKEELKFPPNLAALQQDPNIPQPPLFPNYDSLDLSIDPFLEKTCDLLLESIENHHTEINNYQYYQRSLAREQAKITAWQQKRKAENAARTASKQSLLPEDEWQRLFKLPQEPSRLETLLNSRQVEQYSRQVDGFTAGVTSKMFAVKSNLLPGE

SEQ ID NO: 48581 - protein, 510 aa, Oryza sativa Japonica Group
MGPLWTFILLYPEIFLAIICFFWFSLFRPIRQRQKSNLPVNWPVFGMLPFLVQNLHYIHDKVADVLREAGCTFMVSGPWFLNMNFLITCDPATVNHCFNANFKNYPKGSEFAEMFDILGDGLLVADSESWEYQRRMAMYIFAARTFRSFAMSTITRKTGSVLLPYLDHMAKFGSEVELEGVFMRFSLDVTYSTVFAADLDCLSVSSPIPVFGQATKEAEEAVLFRHVIPPSVWKLLRLLNVGTEKKLTNAKVVIDQFIYEEIAKRKAQASDGLQGDILSMYMKWSIHESAHKQKDERFLRDTAVGFIFAGKDLIAVTLTWFFYMMCKHPHVEARILQELKGLQSSTWPGDLHVFEWDTLRSAIYLQAALLETLRLFPATPFEEKEALVDDVLPNGTKVSRNTRIIFSLYAMGRIEGIWGKDCMEFKPERWVSKSGRLRHEPSYKFLSFNTGPRSCLGKELSLSNMKIIVASIIHNFKVELVEGHEVMPQSSVILHTQNGMMVRLKRRDAA

SEQ ID NO: 48582 - protein, 462 aa, Aspergillus nidulans FGSC A4
MRGVQIFSGNSHPLLTETVCERLGTSPAKVELGKFSNGETNVNVGVSVRNQDVYIIQSGSEKINDSVMELLIMISACKGGSAKSITVAGVDHVITLDLHASQMQGFFSKPVDNLFAEPFIARWIRNNVPGWKEAVVVSKNAGGTKRVTSLADTLKLNFGIVTTDRRRQKPGPTLADSTVFFEALDQETTPLPKEQDPFIARTHIENPDALQSRESQADLNELDSLRPETPSGARRPSELEAVNEYTDVRVRDVITGRLVQGHLVDDDYPPSGPTSMAVSGDATPGQLPSQESEAIPDSMVDSVVSTTSSMPGDHALGGSFDAADSSDEEEGSTKRNVEQEKTITLVGDVRDRTVFLVDDMIDKSGSWIAAAETVVKRGGAKKVYCIATHGLFGDSSLEQLEACESINYIVVTNTFPISPQVARKSRKLIIIDISSLLSESIRRHHYGESDWAVCNLHDYEGR

SEQ ID NO: 48583 - protein, 396 aa, Yersinia pestis CO92
MFEKITAAPADPILGLTDIFRADDRAHKINLGIGVYKDETGKTPVLTSVKKAEQYLLENEATKNYLGIDGLPVFASCTQELLFGANSAIIADKRARTAQTPGGTGGLRIAADFIAHQTSAKRVWVSNPSWPNHKNVFEAAGLEVVEYAYYDAANHALDFDGLLNSLSEAQAGDVVLFHGCCHNPTGIDPTETQWSQLAELSVAKGWLPLFDFAYQGFANGLEEDAQGLRIFAATHQELIVCSSYSKNFGLYNERVGACTLVAADSNVADTAFSQVKAVIRANYSNPPAHGASVVATILSNAALRAIWEQELTDMRQRIQRMRQLFVNTLQEKGAQQDFSFIINQNGMFSFSGLTKEQVLRLRDEFAVYAVNSGRVNVAGMTPDNMAPLCEAIVAVL

SEQ ID NO: 48584 - protein, 480 aa, Oryza sativa Japonica Group
MLSKIATRERTRTTGTKFSRPPPPPLARGAPLVGVLPSLLANGPVEFIRHHYEKMGSVFTVSLLQQKVTFLVGSEASSHFYKGLDSEISQDEVSQFTIPTFGPGVAFDVDYATRHEQFRFFGDIMKPAKLRTYVDLMVAEVEGYFARWGQSGTVNMKQEFEQLVTLIASRCLLGEEVRDKMFDEVSTLLRELNDGMRLVTILFPRLPIPAHRRRDRARARLGEIFSDIVRSRRGSSGGGGGGGGARHDDMLQCLIDARYKDGRATTETEVAGMLVAALFAGQHTSSSTSTWAGARLLTNPDHLRAAVEEQARLLRRHGGDRVDHAALAAMDTLQRCVKETLRLHPPALMLLRHARRSFVVRGGSGEREYEVPEGHTVASPLLLHNALPRVYRDPGEFDPGRFGAGREEGAGGLAYTAFGGGRHACVGEAFAYMQIKVIWSHLLRNFELQLVSPFPETDWTVVMPGPKGKVMVTYNRRKLT

SEQ ID NO: 48585 - protein, 370 aa, Yersinia pestis CO92
MVITLSRLYVHPVKSMRGLQLSHAQVSRSGLAFDRVFMITEPDGMFITARQYPKMVMFTPALMADGLYLTAPDGESASIRFNDFLANPAPTEVWGNHFTALIAPEAINSWLSGYFQRDVQLRWVGTELTRRVKPLPEVPLSFADGFPYLLINEASFKDLQQRCPASIKLEQFRPNLVITGTTAFAEDCWQVIRIGDITFDLVKPCSRCVLTTVSVERGQKHPAGEPLRTLQTFRTAENGDVDFGQNMVARNSGIIRVGDEVEVLITKPPRPYGAGAVVESLSAPQDQSKTVSIEYNGIRFNGNNQQILLEQLEQQNIRIPYSCRAGICGSCRVTLLTGDVAALKKSAVGNDGTILCCSCIPKGDISLSGK

SEQ ID NO: 48586 - protein, 637 aa, Yersinia pestis CO92
MSLISMSGAWLSFSDAPLLDNTELHIEANERVCLVGRNGAGKSTLLKILSKEVALDDGRIIYEQDLIVARLQQDPPRNVAGTVFDFVAEGVQEQAEHLKAYHATLHQVELDPSEKNLNRLAALQEILDHQGLWQLDSRIQEVLVQLGLSADAELSSLSGGWLRKAALGRALVSSPKVLLLDEPTNHLDIETINWLEGFLKEFQGSIVFISHDRSFIRAMATRIVDLDRGKLVSWPGNYELYLASKEEALRVEELQNAEFDRKLAQEEVWIRQGIKARRTRNEGRVRALKALRMERSQRREVMGTAKMQVEETVRSGKIVFDLENVNYQIDGKVLVKDFTAQVQRGDKIALVGPNGCGKTTLLKLMLGQLNADSGKVHCGTKLEVAYFDQHRAELDPERTVMDNLAEGKQEVMVNGRSRHVLGYLQDFLFHPKRAMTPVKALSGGERNRLLLAKLFLKPSNLLILDEPTNDLDVETLELLEEMVDSYQGTVLLVSHDRQFVDNSVTECWIFEGNGQINSFVGGYYDAHQQRAEAKPIRQAALKIEETKASTSVKSPAPAAKKPGKLSYNLQRELDQLPQQLEKLENDISKLQAEVSDTDFFSRPHEETQQVLKTLADTEQALEVAFSRWEELEAQKNG

SEQ ID NO: 48587 - protein, 380 aa, Thermococcus kodakarensis KOD1
MDVFLELALILVVAKLFGYLTVRLGFPAALGQLIGGILIGPSILGIVSYDEAVRLIGELGVVMLLFLAGLETDIEEFKHVGIPAFIVAAMGVLVPFLLGYFGALAWGYSHVQALFLGGILTATSVGLTTSILMEMKKLRTRVGTTILAAAVVDDVLGIIALTILVGINTRGSVYAKDLLIIIGEVALFFLIGLLVGTPAVKEALKASEKITLPETVTAMAIAIMLIFAYLAEQFQIAGITGAYLAGILVATTEEARKVADKTVTIGYSLFIPVFLVSIGIESDVRILTTAGTFALVYALLAVVSKVVGCGLGALFAKFKPIEAIQVGVGMVPRMEVALIMANVALREGVFDRGVFAIPVTMVVITTIVTPFLLKWAFSRE

SEQ ID NO: 48588 - protein, 208 aa, Rhodospirillum rubrum ATCC 11170
MEDILASIRKILSEDEEKAEERAPEPEPEPFVFPEPEPEPEPEPDLGAWGLEEDEEEPLVLDQPAFEPKDEVLELTEDMFVDDEPIPEPEPEPPPPPPPPPPPPPPPPPPPPPEPPPFVSEIEDDPVDERLISATTEVAAGGLLAELASAVARERTIGLGHGGVTLEDMVREILRQLLKDWLDENLPYMTERLVQKEIERLVDRAEKL

SEQ ID NO: 48589 - protein, 335 aa, Debaryomyces hansenii CBS767
MTVNEEVGSNPNKSAAENVSTLGGFLAGGLAACGAVTFTNPIELIKTRMQLQGELSKNSNAPKLYKNPFQAFGLIYRKEGIKGLQQGLTCGYYYQLGLNGCRIGLYEPSRYFLTKILKPSSFKEGEKVPQNLWINVLAGFASGAAGAVLASPFFLIKTRMQSYSGAKAASSEGAQGVGQQTYYKGSADGLLKIYKAEGIVGLFRGVDAAILRTGAGSAAQLPVYNFTKSLLLEYDIVEDNSTGLHFLSGALAGLGVAIVMNPWDVILTRVYNQKGDLYKGPIDCFSKTVRTEGFSALYKGFYAQLFRIWPHSILTLMFMEHCMNAMEKIERKLHS

SEQ ID NO: 48590 - protein, 374 aa, Thermococcus kodakarensis KOD1
MEILLLIAIMLATAKVMGYLFERIGQPVVLGQIFGGLLIGIFFETNPVIAQFSNLGVLLLLFMAGLESELEEFKRVGKQSVFVAGVGVIVAFLFGFGVAYFFVPFHEAVLYGALMTPTSVSITVKVLMELRKLNTREGTTILAAAVVDDVLGILVLTVAISMIKGGSVNYSSLAEVLISVSLLLFFFLYFGPEIADRVFRYVSKIDLPESETAFALVFLIVFAYLAEHLNLASILGAYLTGLALGQIPKKKAIMEHMNVLGYSLFIPLFFVEVGMRIELSYILHAGLFAVLYTTAAIVSKVIGCGLGARLGGFDWAASLRIGVGMIPRMGVELAMLAVAMSSGVISGDALTVAILMIFTTTIITPPLLKWLYSR

SEQ ID NO: 48591 - protein, 213 aa, Triticum aestivum
  misc_feature (27)..(27): Xaa can be any naturally occurring amino acid
  misc_feature (35)..(35): Xaa can be any naturally occurring amino acid
  misc_feature (50)..(50): Xaa can be any naturally occurring amino acid
  misc_feature (61)..(61): Xaa can be any naturally occurring amino acid
  misc_feature (79)..(79): Xaa can be any naturally occurring amino acid
  misc_feature (151)..(151): Xaa can be any naturally occurring amino acid
SPPTFLVVSKINLPCVKDFFGTMGDTXPDLGEHIXRTSAPRLLHINGYPXDKIANPKWEVXKELGTAHNGYVDLLLGEXKHYQTRLDHGGISKELQHLLLDYGIESIAEVLVEGLSRVKRCTDEGRALISLDLQVLINGLQHIVSSNVKPXLQIVETFVKAYYLPETEYVHWARSHPEYSKSQVVGLVNLVATMKGWKRKTRLETIEKIEAAS

SEQ ID NO: 48592 - protein, 351 aa, Vitis vinifera
  misc_feature (346)..(346): Xaa can be any naturally occurring amino acid
MVMCQLSCQFLATPLQVGKSLPTSLHLPRFLKSESFPGASTGVLRCSTETEVSESRNRMFILGMGFVGQFFAQDLKNHGWVVSGTCTSAFKKKKLEERGFNIYLFDANEPELGVLNALKYSTHLLVSIPPVVGIGDPILQHDKFLKSRIMDGDLQWLCYLSSTSVYGNCGGELVDEDYPASPASESAKLRLAAEKGWSSLGSELGLSTQIFRLGGIYGPGRSAVDTIIKQGPLTEGQRKRISRQYTSRVHVADICQALKATIQIPSVGKIYNIVDDDPAPRAQVFAFARDLIEKKWPNHIKESVFPGSARQAEKRVSNARMKKELGVTLLHPTYRSGLQSIIDNMXNPISK

SEQ ID NO: 48593 - protein, 431 aa, Vibrio fischeri ES114
MSFSSQGFAPEIVKALTECGYQKLTPIQQKAIPLARKGHDILANAQTGTGKTAAFALPVIQQLLDSKKSATRRTARALILAPTRELAEQIAVNIADYIKYTSLTVTSVFGGKKMSSQERALEPGVDILVATPGRLQEHIEEENVSIANLEFLVFDEADRMLDMGFVNAIRNIMMEVNTSPQIMLFSATSSAQMNKLASDILRKPKRISVDPENTTASTIAHVVYPVDEERKTELLSELIGRKNWQQVLVFVNYKETANEIVKELKLDGIKAVLCHGDKAQSARRRALEEFKEGKARVMVATDVAARGLDIADLPHVINYDMPFLAEDYVHRIGRTGRAGKKGHAVSFVSREEELTVVQVETLIQQRIRRVEQPGYEPKNRDAYIDKVNTKSAFKNRKGRTNNPNEDQSSAERRMRLKNVIQNKARITKLKK

SEQ ID NO: 48594 - protein, 1629 aa, Oryza sativa
MAIILAITAAVTKIARGGRRRSATDPTCKMPPPPPVVNSIALLRLLPTLFRSGLPAILHELYTKFGSVFTINLAGLLKMTFLVGPEVSAHFFQGLESEISHGNLLEFTVPMFGKEIAHGVDSATRNEQARFFVDALKPARLRIHVDPMVQEVEDYFAKWGQHGTVDLRRELEQLLLLISGRCLLGKEVMGTMFDEVCNLFRDIEGGVNLMSVFFPYTPLIPSNRRRDMARKRLHAIFSDIVRSRKQREGDNVDKDVLQSLIDSSHERFLTAAVDEQDKIAREHSNINGGGRITDDRYGSLMEMRTLHSCIKETLRLHPPVPMLVRTAHKQFTVRTREGHEYAVPAGHTIASPIVISNQVPYIYKDGHLYDPDRFGPAGREEDKVGGKFSYASFGGGRTGCVGEGYAYMQIKAIWSHLLRNFELRLLSPLPKSDFTKFVPEPHGELMRISIPLGHHSILVPAYPNTLYIRSTGIPCRQWCARFYYYDIKFRRQQRQHWPHPRSPYFNNAGVDSSRRNRLPGLYHGTDLGWSINDRKQDAVAITPDDSMSKDPPAVAKNGTSTSYEPEKDPSAAKPCPFDKNHEPTRTTSEVTKPWCPIHKTRKHTLQACWVFLNVQAEIRACKERGIQRTSPTRDVYCPIHKTKNHDFSSCKVLLRAMKTPLSKVVTGPHIVYVAIQIVIGPHIVYAAQMDRTWIHGRQFTPAYMEGQEMHDHIHIFGMSSTYTRWIYHGELVDTEDVEYLEQVHETNHNEGTDVGGYEPEDDNGVPELIGELYTAAEEDGQPPRFARILEDAKQALCPGSNHSRFSFLVRLLHIKSYYRINNTAFTELLKLLSSAFPQCQLPKSYDEAKKYLRELGLGYVSIHVCKNNCVLFLKEYANMDLCPICGESRWEDGVGDRKVPRKVLRHFPLIPRLKRIFASKRTAEDTQWHKIKRKPVDNEMSHAADGEAWKDFDRKYRTFAEDARNMRLAIATDGFNPFGKVSNSYSMWPVLVMPLNLPPWESVDPSNCIMSLLIPGPTSPGKDFDLFLEPLIEELLELWIGVSTYDAFSARKFNLRAAVLWCIHDYPALSTLSGRTTKGYYACIHCDKNPLSRALRNKIGYFGHRRFLPRTHAWRRSHAFDGHHENQVEPGKFSTDEVLEQLEKVKDVRPGKHDTSKKRKRGENEGPLIYSRKVSLWKLPYWKDLLLPHNLDVMHFEKNICDNILGTLLKIEGKTKDTVNSRIDLHDMNKRHNLHLQQDGNSVRIPQARYVLKKEQRIDPGCSLYFYQYPGCQYFESNVQSLLQSSMKAIMEEPVPDGETPRTSAEVVSKVLSRDNSNTTFLKNAGLQMSSKKSVTPTEAALQEELAAEKQSLAILHAEVVELKEQANLANEALAKTQKELAEFKQQQEENNLLLRRILSLSQDLIVGWATTICEIVIDVPISTSDYGSSSSSTPRDVFANGGTSTSAHAIAEVENQAVTPAQHLGTINAILREIPYDPVLNDDLARWTERLRESVANLSNAFEEAATRAQPEQPTAGGADSEPPEQRTSPQRATPPPRGTGDLRDHLNGCRKARRARDNENCSRHRVSSRRRENEERGGRSSENRRHDNRHNRHDRDDREQRTPDDIGRGHRHDGDDNGDRRRDDNGG

SEQ ID NO: 48595 - protein, 216 aa, Triticum aestivum
IHHLPIAVTFAYFGDGNIMVIDPTYKEEAVMGGRMTATINSNGDVCAIQKAGGEGVMSSVIMQCLRIASVKAADITSKIKREVDDYTTEKALQKVKRTPALVAKKVNVPDVTMKESTHSALENQASKAPNDGQQISKGIHTPKEISQLPDPPAIPNDDKHEDTKPMLTESNPEVKSVSNSGTAGESDEFKESRSPKSLIDAIKPKHRRKKKQHGNS

SEQ ID NO: 48596 - protein, 112 aa, Glycine max
  misc_feature (53)..(55): Xaa can be any naturally occurring amino acid
  misc_feature (60)..(61): Xaa can be any naturally occurring amino acid
  misc_feature (85)..(85): Xaa can be any naturally occurring amino acid
GKWASVVAARLNAGGLSCKVLDKEAFQKQMLEKLIWICSVMLVGARHGGVSVXXXKRNSXXNFSAVLDKVASQTQIVRSLYLKSXMEDRWSTYSTALSHFPTAVKEFKWRNG

SEQ ID NO: 48597 - protein, 239 aa, Oryza sativa
MAGGGDELKLLGMWASPFALRAKLALSFKGLSYDYVEEDFKNKSDLLLSSNPVHKKVPVLIHNGKPICESQVIVQYIDEVFPDAGVTLLPADPHDRAVARFWAAYIDEKLFSAWILVFRSKTEEEKAEAVKHTFAVVEKLEGALSECSKGKPFFGGDTVGYVDVVLGGFVAWVHAIEEVYDLNQFDATQTPLLAAWLERFDELDAVKEVMPDIGRLVELAKMRQAQAAGAAAAAAGEAS

SEQ ID NO: 48598 - protein, 621 aa, Ashbya gossypii ATCC 10895
MLRCIRRFSSRGAAASAVATGIPVGREAKRLMSKPLVTRLSVDGPIECPLSGMQLLNSPLFNKGSAFTQKERAAFGLEGLLPPQVNTLDEQVERAYKQLCYLKTPLAKNDFMTSMRMQNKVLFFELVRRHIRELVPIIYTPTEGDAIAAYSHRFRRPEGVFLDITEPDSIEERLASYGEDKDVDYVVVSDGEGILGIGDQGIGGIRIAISKLALMTLCGGIHPGRVMAVTLDVETNNKKLARDELYMGNRFARVRGKQYDEFLDKFIKALKKRFPSAVLHFEDFGVENARPLLDRYRTELPCFNDDIQGTGAVVMASFLAALKHTDRNLLDSKVLVYGAGSAGIGIADQIVNHMVSYGASVDEARSKIFTMDRRGLIMDSMRAGSTRAQQAYAKPDDEWEGVNTKSLVEVVSRIKPTCLIGCSTQAGAFNKAVVQEMHKHNERPIIFPLSNPTRLHEAVPEDLLEWTNYQALVATGSPFHPVNGYRISENNNCFSFPGIGLGAVLARATIISDKMISAAVDQLASLSPLKPGDSRPGLLPPLEVINDTSAKVATAVILQALEEGLARVEHEAVPNSTLGERVRVPRDFDKCLEWVKVQMWKPVYRPLLKVQHDPSVHTFQH

SEQ ID NO: 48599 - protein, 156 aa, Brassica napus
SIVKGHPDLQHLKASHCISEISASFLHNIKALKHLKTLWIDGARVSDSSLLTLTSSCRALTELGVSRCLDVTDIGMMGLARNCSNLKALNLACCGFVTDAAISAVAQSCLNLESLQLESCHLITEKGLQSLGCYSKRLQELDLTDCDGVDDRGLEY

SEQ ID NO: 48600 - protein, 644 aa, Coprinopsis cinerea okayama7#130
MPPISASKQKRLAEKAAKANAKAKGKAGSSDATSSVTGTGTSTPAGSNGYSTPLTSQSGAGSQEDLMSMARLNIATDRSAAGVLVSDPKGRDIKIDSYTLSFHGRLLIEGAEVSLNYGNRYGLLGDNGSGKSTFLTSIAERDIEIPDHIDIYMVSGEADPSDINAVDFIIASAREKVAKLETYIEELSIQEDVDELALEAAYEQLEEMDPSTFEAKAMSILHGLGFSQEMMRRPTKDMSGGWRMRVALARALFVKPHLLLLDEPTNHLDLGAVVWLEAYLSTYNHILVITSHSQDFMDSVCTHIMDLTHKKKLVYYHGNYSTYVKTKAENETNQMKAYHKQQEEIAHIKKFIASAGTYANLVRQAKSKQKIIDKMEAAGLVEKVETPKPLRFNFEDVTRLPPPIIAFDGVAFSYSGKKEDYLYQGLSFGIDMDSRIAILGANGTGKSTLLHLITGALQPCEGTISKHISLKLAKYSQHSADQLPYDQSPIEYFQSLFGEKYPDKDVQFWRAQLGRFGLSGAHQTSPIRQLSDGLRNRVVFSQLSMEHPHVLLLDEPTNHLDMNSIDALARAIKEFEGGVVIVSHDFRLISQVAEELWEVKDKKIRNLTKEDITIVDYKKMLVKESNAAIEKAKLFSKTAPKGTT

SEQ ID NO: 48601 - protein, 194 aa, Vitis vinifera
MFIQTQSTPNPASLMFYPGKPVMEVGSADFPNSRSAMSSPLAKSLYGIDGITRVFFGSDFITVTKSDDASWDFIKPEIFAAIMDFYSSGKPLFLDSNTAAAMDTAIHEDDSETVAMIKELLETRIRPAVQDDGGDIEYRGFDPETGIVKLKMQGACSGCPSSSVTLKSGIENMLMHYVPEVTIISFCTYRFIVV

SEQ ID NO: 48602 - protein, 337 aa, Pseudoalteromonas tunicata D2
MKAAVTYGYKEPLVIEERPTPTLNPKDILVKIHACGVCHTDLHACHGDWPVKAKLPLVPGHEGVGEIVALGAQITHLKIGDRVGIPWLYSACGHCEYCLSGNENLCLAQQNAGYSVDGSYAQYCKAHGDYVIKIPDNLTYVEAAPLFCAGVTTYKALKVANIKPGDWVAIFGVGGLGHLAVQYAVAMGFNVVAVDTGADKLTLAKELGAEICLDFKTDDVIGQILKQTQGVHATICTAVSKAGFEQSYRAIRRGGKCVLVGLPPEDMPIPIFDTVLNGVSIIGSIVGTRQDLVECLDFAARGKVKAITIEKSLEDINDIFNDMIAGEINGRVVMKMC

SEQ ID NO: 48603 - protein, 410 aa, Oryza sativa Japonica Group
MAAPPATASAPSLRPSAASPRAAAARSVAVPSGPRTVGPRRDGGRFLGVRAAKAVSGVQSGTVVDDGVQRPWKLSDARLVLEDGSVWKAKSFGASGTQVGEVVFNTSLTGYQEILTDPSYAGQFVLMTNPHIGNTGVNPDDEESNRCFLAGLIIRNLSICTSNWRCTETLEEYLMKRNIMGIYDVDTRAITRRLREDGSLIGVLSTDQSRTDDELLEMAKNWKIVGVDLISGVTCDAPYEWSDKTDSEWEFKKGQSTESFHVVAYDFGIKHNILRRLTSYGCKITVVPANWPASEVLNLKPDGVFFSNGPGDPAAVPYAVKTVQEIIGKVPVFGICMGHQLIGQALGGKTFKMKFGHHGGNHPVCDLRSGRVDISAQAFRITGVGRGAGLLAVTLPDENLELLRVMNLNL

SEQ ID NO: 48604 - protein, 461 aa, Oryza sativa Japonica Group
MGNGGGGNKKGRRDSPSPPLETPPRGELPSTSSSSSSRATKRHRVAGMADRYFPNDLPDFVAEAPDGGRGLAVVSLLQPLRKGSSRRAPDQGQGVRLISPDRSLPPPQVMEETWTRARRQVTDYTLYTGALGTALLLFKSFQVTGNRADLALAGDIVKECDAASRGLPFLTFICGRAGVCALGAVIAKHCNDQLLLTHYLSSFDEIIVTEKVPNELLYGRAGYLWACLFLNTHLGEKTIPHEHITSVAKDIIDEGRKLAKKGNCPLMYEWHGKKYWGAAHGLAGIMHVLMHTELKLDEKDDVKNTLLYMIRNRYPTGNYPSSEGSESDRLVHWCHGAPGVALTLAKAYQVFHDEHFKQTAAEAAEVVWNRGLLKRVGICHGVSGNAYVFLSLYRLTGNVEYLYRAKAFACFLLEKADQLIADGAMHGGDHPFSLFEGRAGMAYLLLDMVSPSESKFPAYEL

SEQ ID NO: 48605 - protein, 133 aa, Zea mays
MAAAALRPAILRRIRLSPSPSLALAAAGTGASHPHALGRWLARPMSSHDAHLTRDEVIDRILDVIKSHPKIDPSKVTPEAHFEKDLGLDSLDTVEVVMAIEEEFKLEIPDMEADKIDSLPLAIEYVANHPMAG

SEQ ID NO: 48606 - protein, 492 aa, Vitis vinifera
MSRVESCSYHLFILTFALLKQSSSGAGSPSIVGDLLDYLNESWTQFHATAEAKRQLIAAGFQLLNENDEWDLRPGGRYLFTRNMSSLVAFAIGEKYSVGNGFHVIAAHTDSPCLKLKPKSAASKSGYLMVNVQTYGGGLWHTWFDRDLSVAGRVILKGSDGSFLHKLVKVKRPLLRVPTLAIHLDRTVNKDGFKPNLETHLIPLLATKLEEASSESKEKSTSLSSKTAHHPLLMQVLSDELSCGVDDIMSIELNVCDTQPSCLGGGNDEFIFSGRLDNLASSYCALRALIDSCQSTGDLSSEHAIRMVALFDNEEVGSDSVQGAGAPTMFQAMRRIISCLVHEYVGEGAFERAIRQSFLVSADMAHGVHPNFMDKHEEHHRPELQKGLVIKHNANQRYATSGITAFLFKEVGRIHNLPTQEFVVRNDMGCGSTIGPILASGVGIRTVDCGIAQLSMHSVREVCGKEDIDIAYKHFKAFYQTFSSVDRKLNVD

SEQ ID NO: 48607 - protein, 321 aa, Brassica juncea
MEKNIKFPVVDLSKLIGEERDQTMAWINDACENWGFFEIVNHGLPHDLMDNAPKKMTKEHYKKSMEQKFNDMLKSKGLEILEREVEDVDWESTFYLRYLPQSNLYDVPDMSDEYRTAMKDFGKRLENLAEDLLDLLCENLGLEKGYLKKVFHGTKGPTFGTKVSNYPACPKPEMIKGLRAHTDAGGIILLFQDDKVSGLQLLKDGDWIDVPPLNHSIVINLGDQLEVITNGRYKSVMHRVVTQKEGNRMSIASFYNPGSDAEISPASSLACKETEYPSFVFYDYMKLYAGVKFQPKEPRFEAMKNANAVTELNPTAAVETF

SEQ ID NO: 48608 - protein, 430 aa, Magnetospirillum magnetotacticum
MDLHHPELTYAAIVALAAVLCGGLMTRLKQPAIVGYILAGVVLGPSGFGLVSNRDAVATLAEFGVLMLLFVIGMKLDIIRFLEVWKTAVFTTVSQIAGSIGTALLLRHGLGWNLGLAVVLGCAVAVSSTAVVIKVLESSGELETPVGRTTLGILIAQDMAVVPMMLVLESFETKVLLPADLARVILSVLFLVLLFWWLSKRRIDLPLTSRLSRDSDLATLSSLAWCFGTAAISGVLDLSPAYGAFLGGVVLGNSAQRDMLLKRAQPIGSVLLMVFFLSIGLLLDFKFIWKNLGTVLTLLAMVTLFKTALNVAALRLARQDWPSAFLAGVALAQIGEFSFLLADTGKAVKLISAQETKLVVAVTVLSLVLSPFWLFTMRRMHRVAAVHVHPFRELVSRLYGDEARTARRARTLVRRGSWRDDHNAGPGTGI

SEQ ID NO: 48609 - protein, 462 aa, Mycobacterium tuberculosis CDC1551
MIGIGGAIGTGLFLGAGGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 48610 - protein, 337 aa, Bradyrhizobium japonicum
MTVLVTGGAGYIGSHMVHALVDAGESVVVIDNLSTGFSAFLPEGVPLFIGDAGDENLVEGVIAQHGIDSIIHFAGSVVVPDSMRDPLGYYRNNTMTTGSLLNAAVKGGVSRFIFSSTAAVYGNPDRVPVPEIAPTRPLSPYGSSKLMTEIMLHDVASAHGMSYVVLRYFNVAGADPKGRVGLATTGATHLLKIAVEAATGQRAKIDVFGTDYPTQDGSCIRDFIHVSDLVEAHRAALSYLRAGGQSVTLNCGYGRGYSVLETIEAVRRVSMRNFAVAYAARRPGDIMTMVADTTRIRSLLDWTPRFDDLETIASHALAWEEKLFRERAGSARQAESA

SEQ ID NO: 48611 - protein, 606 aa, Magnaporthe grisea 70-15
MGSKAGISSIPAFEATALDSIRPTCDKVLEMFASHKTKDLEWRKVQLRKLYWAVEDYTPMILEAMQLDFGKPAYEVLLSEISFVKNDCMFMLSNLNTFAKDEYLGSPHVPFAFRINQIRTRKEPLGSVLIISPYNYPFMLLLSPLVGAIAAGCTAVLKPSELAPHTAAVVKEMIERRLDPSAFAVVNGAVPEVNALLDWAQWDKIFYTGSTNIGKIIAKKAAETLTPVTLELGGLNPAFITRHADLYLAAKRLMWAKTFNAGQVCLSQNYVLVERPVLDSFIAELNRVHNEFFPRGARDSELARVINERHWLRMKKMLDESRGKIIMGGQMDQETLFMEPTAVLVDSADDSMVVEESFGPIFAVMAFDDLNAAIKLANSVDKTPLALYAFGKDHETNKVINEMTSGGASINDSFAHAQLNSVAFGGVKTSGQGAYRGKASFDCFSHHRTVAKTPGWMESLLRVRYMPYNMSELKKLAMLSSKSPNFDRQGREVRGLAYWSSLIFGMGAAGPKGAFARWLIVLVAAYAWMNRVAITNIYQLVKQLAAILTHTVLTRDERASAIEACISRDWYGLHSLGGSIRANAWPGDASWSRPSQPSLRRHLKGG

SEQ ID NO: 48612 - protein, 433 aa, unidentified eubacterium SCB49
MNLKLQETSPICIIHNKRPIASNKAFYVIGLNYKKADATIRGNFSINEDTQKQILSSAKDADISSVTLISTCNRTEIYGFVSHPSELVRLLCEHTRGTIAEFNKVSYIFKRQKAVAHLFKVGTGLDSQILGDFEIISQLRAGLRRSKNQGVLNAYMERLGNAVIQASKRIKNETEISTGATSVSFAAVQYIMARVPYVSEKNILLFGIGKIGRNTCENLIKHTKNEHITLINRTKIKAEEVAGKFNLVVKDYANIQSEIAASDVLIVATGAQQPTISKELLYLKKPLLILDLSIPRNVSQNVKENPNVTLIHLDELSKVTDATLEHRQSQIPLAQTIINEVAAEFNLWAKNRTFAPTIKALKEKLSDFKTGEIDNQRRKISDFNEEQAEIISNRIIQKITTQFANHLKGANGATQQSIDLINQVFKLQNTNNE

SEQ ID NO: 48613 - protein, 330 aa, Desulfitobacterium hafniense DCB-2
MKKILVSGGAGYIGSHTVQALAEAGYGPVVLDSLITGHRKAVSEDIPFYHGDIADEGLVTDIINKEEVRAVIHFAARSLVGESVQKPDLYFEENTAKTNRFVSTLLQGGVNTIVFSSTAAAYGNPEEIPIPEESHPEPINPYGASKLMIEQSFYWLEQAYGLKWMALRYFNAAGAAWDGSLGEAHTPETHLIPLVLKTALGQREAISIFGTDYKTPDGTCIRDYIHVLDLAEAHIRALEALEQGVPCGAYNVGTGTGYSVREVLAMAGKVTGLDIPVLEAPRREGDPDRLVAKVEKIQRRLGWQARYSDLETIIKTAWQWHQKHPHGYGD

SEQ ID NO: 48614 - protein, 450 aa, Ashbya gossypii ATCC 10895
MSFNEKVKWVLGTAVATLVTIKSVEAVYRLYAAKQNTSRSISGEEKDVRLAKRIRESRAYDEELYREQLARNYAFLGEDGMARLQEQYFIVVGAGGVGSWVVTMLVRSGCRKIKVIDFDQVSLSSLNRHSCATLNDVGHSKVEVLKSHLLKIAPWCEIEAVNELWHIDSAERLIFGNDGQDKPTFVIDCIDNISTKVDLLEYVYRKGIPVISSMGAATKSDPTRINVGDLSTTEEDSLSRSVRRRLKQRGITKGIPVVFSAEKPDPKKAKLLPLPEEQYLMGKVDELSALKDFRVRVLPVLGTMPGVFGLTIATWVLCSIAGYPMEPIEGENRIKLYDGIYHSLAGQMSRIGMPDQRVPVSVADVAYLVEEVYRGKSPVSGYSTRLTLSKWDPSQPVSLQNVVLLTKEEQTAHEARILNGDERLEDVYSPEVIALVHQRLQEENYYSQFR

SEQ ID NO: 48615 - protein, 305 aa, Corynebacterium efficiens YS-314
MSIVGTGNFFGSPEEERDRLVQALQGGKRQTTKPAEIPTVRLNDGNKIPQLGFGVFKVDPAETERVVSEALEAGYRHIDTAAFYNNEEGVGRAIAASGIPREELFVTTKLWPTRFDDAEAGFNESLEKLGMEYVDLFLLHWPAPRNNNFVQAWKVLEQLGERARSIGVCNFLPEHLRQLIDETTIVPAVNQFELHPALQQRDIQEASKAAGIAIESWGPLGQGKYDLSKEAPIAAAARSHGKTLAQVVIRWHLQHGFIVFPKTVNPERMRENLDVLDFELTAEEMVAIDNLERGARGGSHPNDIN

SEQ ID NO: 48616 - protein, 380 aa, Solanum lycopersicum
MSTTVGQVIRCKAAVAWEAGKPLVMEEVDVAPPQKMEVRLKILYTSLCHTDVYFWEAKGQNPVFPRILGHEAAGIVESVGEGVTDLAPGDHVLPVFTGECKDCAHCKSEESNMCSLLRINTDRGVMLNDGKSRFSINGNPIYHFVGTSTFSEYTVVHVGCVAKINPLAPLDKVCVLSCGISTGLGASLNVAKPTKGSSVAIFGLGAVGLAAAEGARIAGASRIIGVDLNASRFEQAKKFGVTEFVNPKDYSKPVQEVIAEMTDGGVDRSVECTGHIDAMISAFECVHDGWGVAVLVGVPHKEAVFKTHPLNFLNERTLKGTFFGNYKPRSDIPCVVEKYMNKELELEKFITHTLPFAEINKAFDLMLKGEGLRCIITMAD

SEQ ID NO: 48617 - protein, 169 aa, Vitis vinifera
MEEDDQKELQLLPSPHSMASSSRMSGRPSDSSLRYRGIGGDPFEGPGLDLQLSISLRPIRPPPEYVLAGQICEYGDVKQEASCVDALKWQAAEQIRLAAMEKAYAERVRELTRREMELAQSEFARARHMWERAHEEVEKAEKMKEKAMRRIDSTCMEITCQACRQRFRP

SEQ ID NO: 48618 - protein, 344 aa, Triticum aestivum
  misc_feature (86)..(86): Xaa can be any naturally occurring amino acid
  misc_feature (136)..(136): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(153): Xaa can be any naturally occurring amino acid
  misc_feature (155)..(155): Xaa can be any naturally occurring amino acid
  misc_feature (159)..(159): Xaa can be any naturally occurring amino acid
  misc_feature (161)..(163): Xaa can be any naturally occurring amino acid
  misc_feature (169)..(169): Xaa can be any naturally occurring amino acid
  misc_feature (178)..(178): Xaa can be any naturally occurring amino acid
  misc_feature (233)..(233): Xaa can be any naturally occurring amino acid
MEEDARAEELQVQRCRARLDRLAAASAGDDAEWEDIRLKRILVDYMLRMSYYDTATKLAETSGIQDLVDIDVFLDAKRVIDSLRNXKEIAPALAWCAENKSRLKKSKSKLEFLLRLQDLWKLVKAKKLPAGLSYAXEYLASLGSTHIXNXAXXRXTGFXNXXXGAQYKXLFEQNQWDXSPVDQFKQESYKLYGMTLEPLLNIYLQAGLTALKTPYPLHDRYFFLFFFTGYKLXSASWAISCLPSLTLQRFCFEGNCPKEDPLSLDGFRKLAEPLPFSKQHHSKLVCHITKELMDTENPPLVLPNGYVYSTKALDEMAKKNGGKIICPRTGEECNYTDLVKAYIS

SEQ ID NO: 48619 - protein, 547 aa, Desulfotalea psychrophila LSv54
MKNNFSPKLFSILKLGYSKEQFINDLFSGLVVAVVALPLAIAFAVASGVSPEKGLVTAVVAGLIIAILGGSRVQIGGPTGAFIVIVFGILQQYGMDGLIISTIMAGCFLVLFGVFGLGSLLSYFPYPLIVGFTSGIAIVIFTTQVKDALGLTIFAMPGDMVGKWHTYFANISSTNISAVSICIITILIATCSGRFIKKIPGSFLAIIFITVAVQVFKLPVTTIETFYGEIPSSISFCLPHVNLADLPHYLRPAITIALLGAIESLLSAVVADGMISGNHRSNTELIAQGIANIVTPFFGGIPATGAIARTATNVKNGGRTPVAGVIHAIGLFLIMIFFGQYAKLIPMSCLAGILIVVSYNMSEWRTFLSILKMGTFDRFILLTTFLLTVFVDLTVAIEVGIVLAALIFMKRMADAGNSSLETFDKDIIDDYSSLPQGVSIYEISGPFFFASAKKYASLITTTGMDSDVLIIRMRHVPFIDSTGLKNLRAALQTLNRLEIKVIISGPRDALVKVIKSNIPATPQLQYSLATNFNEAMKKATLLLNVNS

SEQ ID NO: 48620 - protein, 464 aa, Rhodobacter sphaeroides 2.4.1
MTGRVTSVRGPVLDIRVEGPLPAIGDVVEVGSLPVVAEIQAHLGAADVRAIALHSTQGIARGETVRTTGGPLRVPTGPAVLGRLLDVAGRPADLGPPIPAGAPRAPILHPAPPLAAQDARFQVFSTGIKVLDLLAPLAQGGKTAMFGGAGVGKTVLVMELIRAMVSGYDGISVFAGVGERSREGHEMLGEMKASGVLDRTVLVYGQMNEPPGARWRVPLTALTIAEGFRDGEGRNVLLLIDNVFRFVQAGAEVSGLLGRMPSRVGYQPTLETEVAALQERIASVGRASVTAIEAVYVPADDFTDPAVTAISAHVDSTVVLSRQLAAEGIYPAIDPLATTSVLLDPAVVGEEHARVAGRLKEAIEHYHELRDVIALLGIEELGREEQLMVGRARKLQRFLTQPFFVAAAYTGMEGRSVPVAETVQGCAAILGGECDDWDEGSLYMIGTLAEARAREEARRRKGAA

SEQ ID NO: 48621 - protein, 364 aa, Glycine max
MRVRVIRWEEGVKGERSSGRAQQYPLRPEAEDCAFYLKTGTCKFGFNCKFNHPLRRKNQAKKENAGEREEQAERSGQMECKYYLRSGGCKFGKACKFNHTRGKSSSASATELNFLGLPIRVGEKECLYYMRTGSCKFGANCRFNHPDPTTVGGGDSPSGYGNGSSISLQGVSQSSISSWSSTRPLNESAPFVPVILSPNPGVSPQSSEWNGYQAPVYLSERSLHPPSTYVMNNPAMESNVYMHHQKQMLVEEFPERPGEPECSYFLKTGDCKFKSNCKFHHPKNRIARLPLCNLSDKGLPLRPDQNVCTYYRRYGICKFGPACKFDHPAPSTMAGHDQQSTYINSAGVDVAENGGAEDGNQQSV

SEQ ID NO: 48622 - protein, 138 aa, Vitis vinifera
MIHPIGKIISCVEKWNRSEGTPQVAYTFDAGPNAVLIARDRKVAANLLQRLLYYFPPHSDTDLNSYVIGDKSILGDVGVEEMKDVEALPPPPETKDQIPAQKQRGAVSYFICTRPGKGPVLLSDESQALLNPESGLPK

SEQ ID NO: 48623 - protein, 767 aa, Rickettsia akari str. Hartford
MDEMNRINYAEALEYHEKDKPGKIAITATKSLVTQQDLSLAYSPGVAAPCLEIAKNLEDVYKYTARGNLVAVISNGTAVLGLGNLGAAASKPVMEGKAVLFKKFADIDAIDLEVNTEDPEEFINAVKYLSYSFGGINLEDIKAPECFIIEEKLKSLMDIPVFHDDQHGTAIITAAGLINAAYLTNRKLEDLKIVVNGAGAAAIACIDLLIALGADKSKIILCDTKGVVYKGRLEGMNKWKELYASDTKFRTLAESLNNADVFIGLSVKGVVTKEMVKRMANNPIIFAMANPDPEITPEDIKFVRDDAIIATGRSDYNNQINNVMGFPYIFRGALDVRATTINMEMKIAAAKAIADLARRPVPEEVSKAYSGRKMVFCKEYIIPVPFDPRLITVVAAAVAVAAIESGVAKVKDLSIGKYRKELGSRLNPTANYMNFLAEKIHNAPLKRIVFAEGEEEEVISAALMMRDEKYGHPIIIGRVERIEATLKKIGQYVSLDGIQIMNASLTDSLEKYIDYLYKRLQRKGYLYRDCAKLVETDKDIFAACIVACGDGDALLTGVTKSYIDSLENIMKVISPKHNRRILGYSIMIAKDNNIIISDNCITAYPNSLELAQIATQTAEIAKNMGITPRVAFLSCSSFGNASKATTARICEAVNILDNFSKDKKELSGMKVDFEYDGEMSVKVALDGDLRKLYKFCRLSGSANILIMPGLNSASISTELLQEFSSNSFIGPITNGFEKPVQILQATATANEILKIATFACVEAIKEV

SEQ ID NO: 48624 - protein, 334 aa, Rhodobacter sphaeroides 2.4.1
MRRILVTGTAGFIGFHLARLLLAEGFRVHGYDGMTDYYDVALKRRRHAMLLQDPNFSATEGMLEDQALFDRVADEFAPEVIVHLAAQAGVRYSVENPRAYLDANVIGSFTVMEAARRLKVAHLMMASTSSVYGANEEMPFRETDKADRQLTIYAATKKANESMGHAWAHVHGLPITMFRFFTVYGPWGRPDLALFRFVEAILEDRPIEIYNHGEMWRDFTYVDDLVRAIRLLIEAVPGGPETAVEEDSLSPAAPFRIVNIGNSDKVRLLDFVEAIEESLGRRAIRSYLPMQVGDVPATWADAGLLQRLTGYRPQTDIRDGIAQFVSWYRDYTGK

SEQ ID NO: 48625 - protein, 242 aa, Vitis vinifera
MAADSSQKWILMTTAQTPTNIAVIKYWGKRDEALILAVNDSISVTLDPQHLCTTTTVAVSPMFQSDRMWLNGKEISLSGGRYQNCLREIRSRASKIEDEKKGIKITKKDWEKLHVHIASYNNFPTAAGLASSAAGFACLVFSLAKLMNVQEDQGKLSAIARQGSGSACRSLYGGFVKWVMGNEENGSDSIAVQLQDEKHWDELVIIIAVVSSRQKETSSTSGMRDSVETSLLLQHRAKEVKP

SEQ ID NO: 48626 - protein, 138 aa, Lactobacillus plantarum
TNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIA

SEQ ID NO: 48627 - protein, 574 aa, Spinacia oleracea
MEELVSCHHLPLLCLQSSVPPNGCLTFFQDSACQRCSHSEFSNGHPLNDVSLQNDVAVNPIVAKSIDPSADLQLLPLLESVKEEPTLSIIVVGASGDLAKKKIFPALFALFYENCLPENFTVFGFSRTEMNDEELRTMISKTLTCRIDQRENCGEKMDHFLQRCFYHSGQYNSEDDFSGLDCKLKEKEAGRLQNRLFYLSIPPNIFVDVVRCVSHRASSASGWTRVIVEKPFGRDSDSSRELTRSFKQYLSEDQIFRIDHYLGKELVENLSVLRFSNLVFEPLWSRNYIRNVQLIFSEDFGTEGRGGYFDNYGIIRDIMQNHLLQILALFAMETPVSLDAEDIRNEKVKVLRSMKPLKLQDVVVGQYKGHSKGNKSYSGYTDDPTVPNNSVTPTFAAAALFIDNARWDGVPFLMKAGKALHTKRAEIRVQFRHVPGNLYKKTFGTDLDKATNELVLRVQPDEAIYLKINNKVPGLGMRLDRTDLNLCYSTRYRGEIPDAYERLLLDAIEGERRLFIRSDKLDAAWSLFTPLLKELEEKKVAPELYPYGSRGPVGAHYLAAKHNVRWGDLSGEDS

SEQ ID NO: 48628 - protein, 384 aa, Lupinus luteus
MGLLCSRNRRYNDADAEENAQAAEIERRIELETKAEKHIQKLLLLGAGESGKSTIFKQIKLLFQTGFDEAELKSYLPVIHANVFQTIKLLHDGSKELAQNDVDSSKYVISDENKDIGEKLSEIGSKLDYPYLTTELAKEIETLWEDAAIQETYARGNELQVPGCAHYFMENLQRLSDANYVPTKEDVLYARVRTTGVVEIQFSPVGENKRSGEVYRLFDVGGQRNERRKWIHLFEGVSAVIFCAAISEYDQTLFEDENKNRMTETKELFEWILKQPCFEKTSFMLFLNKFDIFEKKILKVPLNVCEWFKDYQPVSTGKQEIEHAYEFVKKKFEELYFQSTAPERVDRVFKVYRTTALDQKLIKKTFKLVDESLRRRNLFEAGLL

SEQ ID NO: 48629 - protein, 472 aa, Pseudomonas syringae pv. phaseolicola 1448A
MFTPVILAGGNGSRLWPLSRQSFPKQFLALDGQDQGTMFQRTLARLNGLEHTPAVVVSNENHRFIVAEQLRVAKMASRRVILEPLARNTAPAIALAALEATADGTDPILLVLASDHHIHDEEAFRQAVKIAQVHAEAGRLVTFGITPTHAETGFGYIHCGDAIAEGGFAIEAFKEKPSPEMAAEYLSSGAYLWNSGMFMFRASVFLAELRKHRSDILSACRIALENSEADSYFLHVSSEKFALCPDESVDYAVMEHTTAGLVVPLDAGWNDLGSWAAIWDVGPHDANSNRLEGDVMVIDTRNCLVQSHHRLVATVGVEDLIVIETKDAVLVANKHNSQQVKDVVKRLQAEERPEFVTHPLVNRPWGHYDTIDLGERYQVKRISVLPGECLSLQMHYHRAEHWIVVSGTAKVICDDQELILSENQSTYIPLGVKHSLANPGKVPLELIEVQSGSYLGEDDIVRFEDRYGRLKK

SEQ ID NO: 48630 - protein, 525 aa, Idiomarina baltica OS145
MSRDIHDHRILILDFGSQYTQLIARRIREIGVYCELWAWDVDEQDIKDFDPKGIILSGGPESVTEAGSPRAPDYVFKAGVPVLGVCYGMQTMAHQLGGSVQGSLEREFGYAQIELVTESPLFEAIEDAVSEDGKPLLDVWMSHGDKVEAIPEGFHTVATTSYCPYAAMADESRRFYGVQFHPEVTHTRQGMRMLEHFVSGICGCEKQWTPAQIIEDAIERIREQVGSDKVILGLSGGVDSSVTAMLLHRAIGSQLTCVFVDNGLLRLNEAEQVMEMFGDHFGLNIIPVAAEQRFLDALKGEADPEKKRKIIGNTFIEIFDEQASQLTEVDWLAQGTIYPDVIESAGSKTGKAHVIKSHHNVGGLPEDMKLGLVEPLRELFKDEVRKIGLELGLPYNMLYRHPFPGPGLGVRVLGEIKKEYCDLLRRADAIFIDELHKADWYHKVSQAFAVFLPVRSVGVMGDQRKYDWVVSLRAVETIDFMTARWAHLPYELLEKVSNRIINEVDGISRVTYDISGKPPATIEWE

SEQ ID NO: 48631 - protein, 375 aa, Corynebacterium diphtheriae NCTC 13129
MARDYYAILGVERDATDNEIKKAYRKLARKYHPDVNDTEEAAEKFSKISIAQEVLLDAEKRRIVDMGGDPMAQGGGDAGYGAGGGLGDIFEAFFGGGGGSRGPRSRVQPGSDALLRTTLTLEEAYLGTKKPITIDTAILCDRCEGTGSKSKSKPNVCSTCNGSGEIQQMQRSFLGNVMTSSPCPTCRGTGEVIPDPCDKCGGDGRVRTQRDLIVNVPAGIADGMRIRMAGQGEVGPGGGPAGDLYIEVMMQQHPVFQREGNDLHMSVHVPMVDAALGATTSVESLSGDAIDFEIPAGVQPAETIVIEGKGMPQLRGEGFGNMIAHVDVSIPTQLDEKSKELLNKLRDHRSDESSVRTADDSDDSLFGRLRNRFRR

SEQ ID NO: 48632 - protein, 263 aa, Zea mays
KKAGWVPVRNSRALLPLFSSRRRQISRGVAVSGHGGRRSEHRWGSVRRWAAVYKNQLQELAQRSCFNLPSYTCLREGPDHAPRFKAAVNFNGEQFESPGFFSTLRQAEHAAAEVALAALARRGPSYSLAARILDETGVYKNLLQEVAQRVGAPLPLYTTERSGVGHLPVFTCTVELAGITFTVVREEVNSSNETENSDEQEQIRIARALLNYRLKEKMAMANYPHVSPFPKKFPMQPERKPSFGQSSQSSYSKILPLFRPKSN

SEQ ID NO: 48633 - protein, 439 aa, Debaryomyces hansenii CBS767
MTISKVHSRYVYDSRGNPTVEVDVTTENGLFRAIVPSGASTGINEAMELRDGDKSKWQGKGVTKAVDNVNKTIAPHLIKSGLDEKNQEEIDSFLLKLDGTPNKRSLGANAILGVSLAVAKAGAAAKQVPLYRHIADISKSKQDKYVLPVPFQNVLNGGSHAGGSLAFQEFMIAPTNAPSFSEALRIGSEVYHHLKSLTKSKYGQSAGNVGDEGGVAPDIETPEEALDLIVASIEKAGYKGKVSIALDVASSEFYKDGKYDLDFKNPNSDKSKWLSGDQLADLYESLIDNYPIISIEDPFSEEDWDAWSNFYPKVASKLQIVGDDLTVTNPIFIKKAIEKKAANALLLKVNQIGTLTESIKAAQLAFSDKWGVMVSHRSGETEDHIIADIVVGLRTGQIKTGAPSRSERLAKLNQILRIEQELGDDAVYSGKGFHTAQNL

SEQ ID NO: 48634 - protein, 306 aa, Campylobacter jejuni subsp. jejuni NCTC 11168
MKHFLTLRDFSKEEILSLVNHASELKKEPKKLLQDKTLAMIFEKNSTRTRMAFELAITELGGKALFLSSNDLQLSRGEPVKDTARVIGAMVDFVMMRVNKHETLLEFARYSKAPVINALSELYHPTQVLGDLFTIKEWNKMQNGIAKVAFIGDSNNMCNSWLITAAILGFEISIAMPKNYKISPEIWEFAMKQALISGAKISLGYDKFEALKDKDVVITDTWVSMGEENEKERKIKEFEGFMIDEKAMSVANKDAILLHCLPAYRGYEVSEEIFEKHADVIFEEARNRLYVVKALLCFLDNQRGRE

SEQ ID NO: 48635 - protein, 620 aa, Arabidopsis thaliana
  misc_feature (585)..(585): Xaa can be any naturally occurring amino acid
MERSVDLPIHKHPLYHSSRFINGRCRGCKQTSPIYSGYRCNDSDCNHVWYHKECGESLPEINHPSHLEHPLCLIDYRGSGTCAFCGAFLFGPTYHCWICAFNIDIACARKQLPPLAAIENPKCHNHSLVLLEKQVKKDHCGVCKKTVFGMYPYVCLECDVYFHVECINISREVHHSSHTNHTLELFGSESLPDSAQKTCLLCDDVSDHLIYHCSVCNFSICVYCAINPPPLAIEHLKTHEHTLTLLPRQVKFICNACGMKGDGCPYFCLGCGYLIHRKCIDLPRVININRHDHRISLTHHLGLQYSECGVCRQSVNGYYGGYSCSLCPNYVVHPQCAMKDDVWDGIELEGTPEDSEQDTAPFEVVDDNTIKHFSHEKHNLMLNKNGIITQHDEITRCQACVLPLSSDPSYSCGQCDYVLHETCANLPRKKRHVFNNKPFTLHTGGKDSSRNWFECDACRTISNGFRYVSGDWILDVHCGSMSEPLLHDGHSHPLYYYRRQGKSCRSCHNKVVKPRVLCCDTCDFDLDFYCANLPKTVKHCYDEHPLSLCHGEDDVIKDNKYWCDICETETDPKKWFYTCYDCGGXNINVDGREYEVVPNSKSSRPFCDQCHSRCKDRFIL

SEQ ID NO: 48636 - protein, 396 aa, Chlamydophila caviae GPIC
MSFFNQLPTFSPDSILGLQKLFLEDEREEKVNLVIGVYEDPSKAYGGFSSVRKAQFLFLEDEMNKGYLPISGLSSFNQEMEKLVFGDVNSSFVVGAQALGGTGALHLGAKIFSMAYTSGKVYIPEQTWGNHVRIFAQQGLEVLKYPYYSSESKSLLFDEMLSVLKAAPKNSLVLLQCCCHNPTGMDLNEDMWTRLAEVMKEHQLLPFFDTAYLGFGRGIKEDRRPIEIFIEVGNPVFVAACASKNFSLYGERVGYFAVHSKITEDLDKISSCLEEKARGEYSSPPRHGAKIVSTILSDASLKKEWLSELDTIRSSLGKTRARLVQAMRNHVGHSFDFILSQKGFFGYPGFSVEQVLFLRSEKGIYTTSGARFNLNGITDKNIDHVSQSFAEAYQLS

SEQ ID NO: 48637 - protein, 443 aa, Bacillus licheniformis ATCC 14580
MNGNNIIRNLMLEIPSAPGNLGKVTTAIGLAGGDIGEIETIKVGPNYTMRNITVQVEHEEQLTEILEVIRNLKEGIHLHTVSDDVLAAHEGGKIRMKSKMPIRSLADLRRVYTPGVANVCELIKEEPQKANIYTGIGNSVAIVTDGTAILGLGDIGPVAGMPVMEGKAALFDQLADISGVPILLDTNDPDEIVRTVKNIAPGFSGILLEDIGSPHCFEIEERLKNDLNIPVMHDDQHGTAVVTLAAAISAAKSAGVDLKQAHVGQIGLGAAGVAICRMFMAYGVKRVVGTDKSLEAMARLENYGGHAAESIEELMESCDIVVATTGVPGLINKKWVREGQVILALSNPKPEIEPEDALEAGAAYAADGRSVNNVLGFPGIFRGVLNAGADSISHPMLVAAAEAIASCTRQGDLVPHPLNPEVHEIVAKAVERVALSEMGKING

SEQ ID NO: 48638 - protein, 186 aa, Campylobacter jejuni subsp. jejuni NCTC 11168
MEIKISEIANLPSKWGNFQMQSFKENDKEHLCIFKNTPKDTLNLRIHSECLTGDALGSLKCDCGEQLEFSLKYIEKNGGMVIYLRQEGRGIGLFNKVNAYALQDKGFDTIKANHQLGFKADERTYEIVEFILKHYEISKVNLLTNNPEKLDSIKEKIITRIPILIEPNRFNVEYLNIKQTQMGHLK

SEQ ID NO: 48639 - protein, 387 aa, Bradyrhizobium sp. ORS278
MISQNKVFADLPVTIFEQMSQLARDNNAINLGQGFPDDPGPEDIRRAAADAVLNGYNQYPSMMGLPELRQAIAAHYKHWHKLDLDPMSEVMVTSGGTEALTSAILSVVEPGDEVICFQPVYDSYLPIIRQAGGIPKLLRLEPPHWRLSEEMLRSAFSAKTKAVLFNNPLNPAAVVYPREDLELLARFCQDFDAVAICDEVWEHVVFDGREHIPLITIPGMRDRTIKVGSAGKIFSLTGWKIGFVCAAPQLLRVAAKVHQFLTFTTAPNLQTAVAYGLGKSDDYFINMRAELARSRDRLTAGLERLGFPVLKAQGTYFLTVDLSPLGLNETDEQFCRRIVHDYKVAAIPVSAFYEKDAVTSVVRFCFAKKDATLDTALERLSDAIHRR

SEQ ID NO: 48640 - protein, 702 aa, Rhodospirillum rubrum ATCC 11170 [sequence omitted]

SEQ ID NO: 48641 - protein, 339 aa, Parachlorella kessleri
MLSSALYQQAGLSGLLRASAMGPQTPFIASPKETQADPMAFVKDLLAGGTAGAISKTAVAPIERVKLLLQTQDSNPMIKSGQVPRYTGIVNCFVRVSSEQGVASFWRGNLANVVRYFPTQAFNFAFKDTIKGLFPKYSPKTDFWRFFVVNLASGGLAGAGSLLIVYPLDFARTRLAADVGSGKSREFTGLVDCLSKVVKRGGPMALYQGFGVSVQGIIVYRGAYFGLYDTAKGVLFKDERTANFFAKWAVAQAVTAGAGVLSYPFDTVRRRLMMQSGGERQYNGTIDCWRKVAQQEGMKAFFKGAWSNVLRGAGGAFVLVLYDEIKKFINPNAVSSASE

SEQ ID NO: 48642 - protein, 152 aa, Corynebacterium efficiens YS-314
MTSLRQDRGRSVDSASMTERTLILIKPDGVTNGHVGEIIARIERKGLKLAALDLRVADRETAEKHYEEHADKPFFGELVEFITSAPLIAGIVEGERAIDAWRQLAGGTDPVSKATPGTIRGDFALTVGENVVHGSDSPESAEREISIWFPNL

SEQ ID NO: 48643 - protein, 377 aa, Rhodospirillum rubrum ATCC 11170
MTDGTSPVPYRDYLASPEDIIEDARQGKMFILVDDENRENEGDLVIPAQMATAEVVNFMAKHGRGLICLAMTRERCEQLDLPLMAQQNSSRHSTAFTISIEAKDGVTTGISAADRALTIQVAIDPAKGRGDIATPGHVFPLVARDGGVLVRAGHTEAAVDVARMAGLVPAGVICEVMNDDGTMARMPDLVRFAQEHGLKVGTIADLIAYRRTKERLVRRELETDFRSVHGGDWRMMLYVSTVSYGEHIALVKGDPRGSDPVLVRMHALNVLDDVLGDSDGNAHGQLHRAMDVIGRAGRGVLVLIREGRPTALSERLRARIEQGPSAQRLVDYGVGAQILLDLGVTDMTLLTNTPKHIIGLEGYGLRVAGHQPLSDKE

SEQ ID NO: 48644 - protein, 316 aa, Ashbya gossypii ATCC 10895
MGQPENYIQTVYKNDGFIAFVAGGVGGAVSRTVVSPVERVKILLQVQSSTTAYNGGLVHAVKQVYKEEGVKGLFRGNGINCLRIFPYSAVQYAVYEFCKTRVFHVGQSGHEQLRSWERLVGGALGGGASVLVTYPLDLVRTRLSIQTANLAKLHRSKAHDIRRPPGIVELLRRIFREEGGLRGWYRGVYPTSLGVVPFVALNFALYERLKALIPHDYDAGSVAAAKLAIGAVSGGIAQTVVYPFDLLRRRFQVLTMGQSELGFRYASVADALWTIGRQEGLRGYYKGLTANLVKVVPAMAVQWFVYELISENMHGL

SEQ ID NO: 48645 - protein, 212 aa, Zea mays
  misc_feature (86)..(86): Xaa can be any naturally occurring amino acid
  misc_feature (180)..(180): Xaa can be any naturally occurring amino acid
MAPSIAPPSSPSCLRGKLFPRFTGTNSQPMNSVLRCDISVSPTLASNSLRRTSSVHLANNNRIKSFHVCHAGVDPSERIVVNGQVXSSKTVQADAAALGTISADMAPVVDGFSADDDELDLDLPTEGFSSIPEAIEDIRQGKYVIVVDDEDRENEGDLIMAASTVTPEAMAFIVRHGTGXIVCVSMKEDDLERLQLSLMVVGKENEEKLPTA

SEQ ID NO: 48646 - protein, 339 aa, Brassica napus
MAPVLQSTQPWVEKYRPKQVKDVAHQEEVVRVLTNTLETANCPHMLFYGPPGTGKTTTALAIAHQLFGPELYKSRVLELNASDDRGINVVRTKIKDFAAVAVGSSNRQGGYPCPSFKIIILDEADSMTEDAQNALRRTMETYSKVTRFFFICNYISRIIEPLASRCAKFRFKPLSEEVMSNRILHICNEEGLNLGGEALSTLSTISQGDLRRAITYLQSGARLFGSTITSTDLLNVSGVVPLEVVKRFFTSCKSGDFDIANKEVDNIVAEGYPASQIINQLFDIVVEAGDDITDNQKAKICKCLAETDKRLVDGADEYLQLLDVASNTITALSEMAQDY

SEQ ID NO: 48647 - protein, 138 aa, Lactobacillus plantarum
TNEMLKANQLSFPGQRVAISGAGNVAIYAIQKVEELGGKVITCSDSNGYVIDENGIDFKIVKQIKEVERSRIKDYADRVASASYYEGSVWDAQVAYDIALPCATQNEISGDQAKNLIANGAKVVAEGANMPSSPEAIA

SEQ ID NO: 48648 - protein, 406 aa, Yersinia pseudotuberculosis IP 32953
MNFPIERVRADFPLLSRQVNGQPLVYLDSAASAQKPQAVIDKELHFYRDGYAAVHRGIHSLSAEATQQMEAVRTQVADFIHAASAEEIIFVRGTTEAINLVANSYGRHFLAAGDSIIITEMEHHANIVPWQMLAQDLGVEIRVWPLTATGELKITALAALIDDTTRLLAVTQVSNVLGTVNPIKDIVAQAKAAGLVVLVDGAQAVMHQPVDVQALGCDFYVFSGHKLYGPSGIGILYGKSALLQQMPPWEGGGAMIKTVSLTQGTTFADAPWRFEAGSPNTAGIMGLGAAIDYVTELGLLPIQQYEQSLMHYALAQLSQIKSLTLYGPTERAGVIAFNLGQHHAYDVGSFLDQYGIAIRTGHHCAMPLMAFYQVPSMCRASLALYNTREDVDRLVAGLQRIEKLLG

SEQ ID NO: 48649 - protein, 507 aa, Rickettsia akari str. Hartford
MDAVDSNFTIWNKARNSKFRHVVWPIRSYELTKFIPMALLMFFILLNQNLVRSIKDSFVVTLISSEVLSFIKLWGEMPMGILFVILYSKLCNIMTTEQVFRIITGTFLFFFAIFGFILFPYKDFFHPDPELIKHYITVLPHLKWFLIIWGQWSLVLFYIMGELWPVIVFTLLYWQLANKITKVEEAPRFYSFFTLFGQTNLLISGTVIIYFAKSEHFLLPLFSYLNDTNEILLKSFITVILISGLICLALHKLIDKSVVEADKNIKFKNQRTDILKLSLIESAKVIFTSRYLGFICLLVMSYSMSISLIEGLWMSKVKQLYPATKDFISYHGEVFFWTGVLTLVSAFLGSSLIRICGWFWGAIITPIMMFGAGVMFFSFTVFENHLGNIINTLGYSSPLVVIVFIGGLWHVLSKSVKYSLFDATKEMVYIPLDSEIKTKGKAAVDVMGTKIGKSIGAIIQFISFSMFPNAVHNDIAGLLMFSFIIVCLLWLYGVKVLSAHYNKMIKR

SEQ ID NO: 48650 - protein, 496 aa, Rhodobacter sphaeroides 2.4.1
MISFATYRQQWLGHVRGDLLSGLVVALALIPEAIAFSIIAGVDPKVGLYASFSIAVVTAIAGGRPGMISAATAATAVLMVTLVRDHGLQYLLAATVLAGLIQIALGLLKLGFVMRYVSRSVMTGFVNALAILIFLAQLPELDPRAVPPLTYLLVAAGLAIIYLFPRLTRAVPSPLVTIIVLTALTLGLGLDVRTVGDMGALPDTLPVFLIPDIPLTFETLRIILPPATAVAVVGLLESLMTQTLVDELTDTRSSRNQECIGQGLANAATGFIGGMAGCAMIGQSMINVKSGGRGRLSCFVAGVFLLILVVGLGDVVSRIPMAALVAIMIMVSIGTFSWSSLKALRTHPRSSSVVMLATVATVVWTHNLALGVLVGVLLSGIFFAAKIAQLFAVSSELSACGRARTYRVEGQLFYGSVEDFMAAFDFREPLERVTIDVSRAHIWDISSVQALDMAVLKFRREGAEVRIVGMNEASETLVDRLALHDRPGALDRLTAH

SEQ ID NO: 48651 - protein, 101 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEF

SEQ ID NO: 48652 - protein, 84 aa, Triticum aestivum
  misc_feature (64)..(64): Xaa can be any naturally occurring amino acid
MVANGDAPARGSAAAAASLRRRRTTSGAAAAGGGGGASTMLQFYTDEAAGRKMSPNAVLIMSIXGFIAVVAVLHVFGKLYRTPN

SEQ ID NO: 48653 - protein, 136 aa, Oryza sativa
SLSTTDPTSRRFSPPPSYFTSELVSSQLHRSCSTMSTTVTRAHLEQRLALAKRCSREANIAGVKAAAVATIASAVPTLASVRMLPWAKANINPTGQALIICTAAGMAYFVAADKKILSLARRHSFENAPEHLKNTF

SEQ ID NO: 48654 - protein, 509 aa, Oryza sativa Japonica Group
MDELFYQSLLLSVAAVTVLQLLKLLLVRHRRPRTPPGPWRLPVIGSMHHLVNVLPHRKLRELAAVHGPLMMLQLGETPLVVATSKETARAVLKTHDTNFATRPRLLAGEIVGYEWVDILFSPSGDYWRKLRQLCAAEILSPKRVLSFRHIREDEVMMRVNEIRAAGPTTPVNLSVMFHSVTNSIVSRAAFGKKRKNAAEFLAAIKSGVGLASGFNIPDLFPTWTGILATVTGMKRSLRAIYTTVDGILEEIIAERKGIRDEKISGGAENVDENLVDVLIGLQGKGGFGFHLDNSKIKAIILDMFAGGTGTSASAMEWGMSELMRNPSVMKKLQAEIREVLRGKATVTEADMQAGNLRYLKMVIREALRLHPPAPLLVPRESIDVCELDGYTIPAKSRVIINAWAIGRDPKYWDNPEEFRPERFEDGTLDFTGSNYEFIPFGSGRRMCPGFNYGLASMELMFTGLLYHFDWSLPEGVNEVDMAEAPGLGVRRRSPLMLCATPFVPVVSAN

SEQ ID NO: 48655 - protein, 240 aa, Oryza sativa Japonica Group
METAGGDAAPPPQQQRRNKSSAANKGKKGGASGGGGGGRWPPVKPKKDLQVNRLKGTHLLTVPNFFTSAEAKAFVDIAENIGFTHQGSLGPLKGEAYRDNDRISVTDPLLAQTIWESGINKIFEDISISGKVATSLNPNIRFYRYTEGQRFGRHIDESVDLGDGSRTLYTLLIYLSGKGSAKESSGQALVGGETVFYDHRGGVVAEVAPVQGLALLHLHGAKCMLHEARVVKKNINSADV

SEQ ID NO: 48656 - protein, 413 aa, Synechococcus sp. CC9311
MAGTSTKTTDLSESPPTAVMGTYNRYPLTLVRGKGCWVRDHKGHRYLDAVAGIATCTLGHSNRAMRRALKDQLSRLQHVSNLYEIPEQEELARWLVNNSCADSVFFCNSGAEANEAAIKLARKHGHQRRGIERPVILTAAASFHGRTLAAVSATGQPRYHIGFEPMVEGFETFTYNDIHSFELLLNRLEAHGPQVCAVLIEPLQGEGGVNPGDPEVFRAMRRHCDERNILLIFDEVQVGMGRSGRLWGYEQLDVQPDVITLAKGLGGGHAIGALLTTKHADLFTPGDHASTFGGNPFACRAGLTVARELERRQLLRNVSERGAQLRAGLNQLIKRFPQQLEDARGWGLLQGLVLREDCDLNAADVVKAALAQKLLLVPAGTKVVRMVPPLVIDRREVNELLSRLERTLDLLNA

SEQ ID NO: 48657 - protein, 356 aa, Pisum sativum
GLTIRAGSYADELVKTAKTIASPGRGILAMDESNATCGKRLASIGLENTEVNRQAWRTLLVTVPTLGEYISGAILFEETLYQSTTDGRKIVDVLIEQNIIPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVQFEGILLKPSMVTPGAESKDKASPTKVAEYTLNLLHRRIPPAVPGIMFLSGGQSEVEATLNLNAMNKSPNPWHVSFSYARALQNTALKTWGGLPENVKAAQEALLFRAKSNSLAQLGKYYGDGESEEAKKELFVKGYSY

SEQ ID NO: 48658 - protein, 203 aa, Ashbya gossypii ATCC 10895
MSTTTKSKMEGPKTVVVTCGATVPFPGLVNAVLDRRVLAELAQCGFSRVMVQYGRGFAAEFERQVGAAGAVRAACDAEGLEGCDAHAWRWQGLEIIGFAFHAQMESLIGTSAALVVSHAGTGSILDALRQQKPLIVCVNEALLDNHQEQIARRFEALGHLWAIRADVDELAGALARSTRETLAPLPPAYKQGFAELLQDVAHR

SEQ ID NO: 48659 - protein, 315 aa, Brassica napus
  misc_feature (197)..(197): Xaa can be any naturally occurring amino acid
  misc_feature (211)..(211): Xaa can be any naturally occurring amino acid
MILAQLRRLRLSIFAKSHFSLASSHFNLINPNPPVKLARALFSNLATVEPIPLPVSDSSHLDAAPVEIPLDKLFIPPETDISDEEPSRLAARILKGSNIVLSKYARDAQVVQADYVKSSVRTEDCPADGLPEFALVGRSNVGKSSLLNSLVKRKRLALTSKKPGKTQCINHFRINDNWYLVDLPGYGYASAPHELKXKDWNKFTKDYFLNXRSTLVSVFLLVDASIPPKQIDLDYASWLGQNQVPMTMVFTKCDKRKKKKNGGKRPEENIKEFQDLIQGFFETTPPWIMTSSVTNQGRDEILLHMAQLRNYWLKH

SEQ ID NO: 48660 - protein, 395 aa, Erythrobacter sp. SD-21
MAGVEVIDAQQRMAPHGVAGEARIDWPELIDFKRSFTDPVPEKHEQRYKEAGIATLHGTASFSGSNRLRVGERELTASNFLIATGAKPRRLDIPGEEHLVDNEDFLSLAVLPKRIVLVGGGYIAAEFAHIAARAGAKVTVVQRGPRMLTGFEPELVDWLMEAFDRIGVCVETDLDVTAIDQRGDDYVVHAEGDGRAMQFDADLVVHAAGRVPALDQLDLKAAGIATENGRLSLNDFLQSESNTAVYAAGDAASNGPPLTPVSSHDAKVVAANLIEGNHKKPDYIGVPSVAFTLPPLARVGLSEEEAKKAGRSFEVKCGRASDWYTARRVDEPVYGYKTLVEGDSGKILGAHLVGPHAEEVINIFGLAIRHGLTVKDLKTTMFAYPTGASDIGYML

SEQ ID NO: 48661 - protein, 138 aa, Lactobacillus plantarum
TNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGNQAKNLIANGAKVVAEGANMPSSPEAIA

SEQ ID NO: 48662 - protein, 402 aa, Solanum tuberosum
MAVKKSVGSLKEADLKGKRVFVRVDLNVPLDDNFNITDDTRIRAAVPTIKYLMQNGARVILASHLGRPKGLVHPKVQLKPFVPRLSELLGIEVKMANDSIGPEVENLVAELPEGGVVLLENVRFYKEEEKNDLEFAKKLASLADLYVNDAFGTAHRAHASTEGVAKVLKPAVAGFLMQKELDYLVGAVSNPQKPFAAIVGGSKVSSKIGVIESLLEKVDVLLLGGGMIFTFYKAQGYAVGSSLVKEDKLDLATSLMEKAKTKGVSLLLPTDVVIADKFAANANSKIVPASEIPDGWMGLDFGPDAIKSFGSALDTTKTIIWNGPMGVFEFDKFAAGTEAIAKKLAELSGKGVTTIIGGGDSVAAVEKVGLAEKMSHISTGGGASLELLEGKPLPGVLALDDA

SEQ ID NO: 48663 - protein, 224 aa, Mycobacterium leprae TN
MGPLIAPSILAADFARLTDEAAVVASADWLHVDVMDGHFVPNLTIGLPVVQSLLAASDIPMDCHLMIDNPDRWAPPYAEAGAYNVTFHAEATDNPVGVAHDIRTAGAKAGIGVKPGTPLNPYLDILPHFDTLLIMSVEPGFGGQAFIPEVLSKVRTVRKMVDAGELTILVEIDGGINADTIEQAAEAGVDCFVAGSAVYGAADPSAAVAALRRRAGAVSPHLRR

SEQ ID NO: 48664 - protein, 484 aa, Acinetobacter calcoaceticus
MSIFTKELWDKKLFNGSWQSAQDTYSVIEVATGQVLGEIGYATAADVVSAAQQAKAAQQQWWALNYQERQAVFERAAALLTENQAEVIEWLVKESGSLQLKAGFEVSIAIQVLKHCIASPTNEQGTLLPTQNGKLSIAKRLPLGVVGVISPFNFPLYLALRAVAPALAFGNAVVLKPDERTAVCSGYVIARIFELAGLPKGLLHVLPGGVEVGEALTLDQNIASIQFTGSTQVGRIVGANAAKTLKKVSLELGGKNSLIILDDADIELAAENIAWGAFLHSGQICMTSGKILIHQKIYQQVKQRVIEKVQNFVVGNPCDKNVTIGPLINAKQAQRVEQLVSAAVNEGATLEIGGHADGVFFQPTVLTDVTANNSIFSEEIFGPVAVLIPFSSDEQAIELANDGDYGLSAGIITSNVGRGMQLGAQLKVGLLHINDQTVNDETVNPFGGFGSSGNGTRIGGPANADEFTQWQWITVQAQAPHYPF

SEQ ID NO: 48665 - protein, 264 aa, Mycobacterium tuberculosis CDC1551
MDGMTAMAADLSAYPDRESELTHALAAMRSRLAAAAEAAGRNVGEIELLPITKFFPATDVAILFRLGCRSVGESREQEASAKMAELNRLLAAAELGHSGGVHWHMVGRIQRNKAGSLARWAHTAHSVDSSRLVTALDRAVVAALAEHRRGERLRVYVQVSLDGDGSRGGVDSTTPGAVDRICAQVQESEGLELVGLMGIPPLDWDPDEAFDRLQSEHNRVRAMFPHAIGLSAGMSNDLEVAVKHGSTCVRVGTALLGPRRLRSP

SEQ ID NO: 48666 - protein, 371 aa, Acinetobacter calcoaceticus
MSELKDIIAAVTPCKGADFELQALKIRQPQGDEVLVKVVATGMCHTDLIVRDQYYPVPLPAVLGHEGSGIIEAIGPNVTELQVGDHVVLSYGYCGKCTQCNTGNPAYCSEFFGRNFSGADSEGNHALCTHDQGVVNDHFFAQSSFATYALSRENNTVKVTKDVPIELLGPLGCGIQTGAGACINALKVTPASSLVTWGAGAVGLSALLAAKVCGASIIIAVDIVESRLELAKQLGATHVINSKTQDPVAAIKEITDGGVNFALESTGRPEILKQGVDALGILGKIAVVGAPQLGTTAQFDVNDLLLGGKTILGVVEGSGSPKKFIPELVRLYQQGKFPFDQLVKFYAFDEINQAAIDSHKGITLKPIIKIA

SEQ ID NO: 48667 - protein, 591 aa, Pseudomonas fluorescens Pf-5
MDVSRPRLRDSGTKPDPGQGPTLPGRGYDEPDRLQDRAMIAIREAWKAGLLGRAHWGRNLVSGVIVAVVALPLAMAFAIASGVKPEQGIYTAIVGGLLVSLFGGSRVQIAGPTGAFIVILAGVTAQYGVDGLQLATLMAGLILFLLGISRLGALIKFIPDPVILGFTAGIGVIIWVSQWKDFFGLPAVSGEHFHQKLWHLLQALPQLHLTTTLLAMLSLALLLWVPRIPQLKRLPAPLLAMTLATALQSLFQFQGVATIGSAFGGIPQGLPALQFPEVSLPQVLDLIGPAFAIAMLGAIESLLSAVVADGMAGTRHDSNQELMGQGIANLVTPLFGGFAATGAIARTATNIRNGGSSPLAGIVHALVLLLIILFLAPLAANIPLCALAAILFVVAYNMSELHHFKRMLQRAPRADVAILLCTFVLTVFSDLVIAVNIGVVLAMLHFLRRMASSVEVQQVVEQDLQQELHHSGQQHLPPGVLIYTIEGPLFFGAAETFERALAQTHSDPQVLIIRLKHVPFMDITGLQTLEEVIGQLHKRAIVVKLCEANLKVHGKLERVGILHAIGAQNYHRDLSEALQSQIPPASPPPLS

SEQ ID NO: 48668 - protein, 859 aa, Candida albicans SC5314
MMPPGGRKSKIRPPRKSLISSSSSSENSTTDPVIDFDKNWSVLSSAISQIQNKNVSNLSYEQLYRKAYVLVLRKFGGKLYDNVANVIKTHLLTRREKLLSVSANHDLFMQSILQEWSEHLQAMKFISDVLMYLNKVYVAEHKKLLIYDLGIQLFKDYVIKYNNDEVGSKIVNMVIDEIAKSRTGVVITSSMYITKIINMMELLVEPSGSSDILFGDSYYQIKFEPKFLKSSEESLYNLSQEFVSHNLGTKYLQLTTQFIKDEDNRVRFYLPPSTYPKLVELMNNIMIKDKIDKMILSSNQGLEYWLKPVVSNIFEDTNIETYHYADLKMLYNLIGRFDDEYQLLRLRLKEAIVAQGNSLPDYVRSSIENSGKKQSNNSPAFATKWIETILKYRDQLMQVWKNSFDENLMIEQTFTFAMRDFINGSNKRGPASVNAPELLSVYMDYFIKQLTKGSSSNKDISLKSGDQTEDLISNSIQFLRFIKDKDAFEANYANHFAKRFLNSKTGNSPSSNKDIEEIILAKLSEEMGTSSLDKVIKMNRDVRSSKDTTNDWKRYLNKQSKSTDLVEMELKICNVTDWPKSMTKDYKWFSRTENEETPFKWPRQLRNTIKQFDEFWSNGKKNDNKSLYWSPKFGSMDLRITYPSRTYEINLSTFAAIIMLLFAPQSTNADGSTVSAFDEMKELTYEEILELTGIPEPELKRHLQSIAVAPKSRLLVKVPMSKDVNKNDVFKLNAKFKSPSVKVKVLTVSASSSSSASSSSSSSKNTNKSVAKTEQEEELEEVNANIMEGRKIEVNAAIVRILKSRQSIKHNDLIEELLKQLSNRFQPSIILIKQRIEDLIDKEYLKRDTDDRNLYHYIA

SEQ ID NO: 48669 - protein, 138 aa, Lactobacillus plantarum
TNEMLKANQLSFPDQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIA

SEQ ID NO: 48670 - protein, 487 aa, Yersinia pseudotuberculosis IP 32953
MKPRMEYAPEFDNSYARQLSGFYTRLQPTPLKGARLLYHSKPLAQELGLDAHWFTEPKTAVWAGEALLPGMEPLAQVYSGHQFGMWAGQLGDGRGILLGEQRLNDGRYMDWHLKGAGLTPYSRMGDGRAVLRSVIREFLASEALHHLGIPTSRALTIVTSDHPIYREQTERGAMLLRVAESHIRFGHFEHFYYRQQPKQVQQLADYVIARHWPQWVGHQECYRLWFTDVVERTARLMAHWQTVGFAHGVMNTDNMSILGITMDYGPFGFLDDYVPGYICNHSDHQGRYAYDNQPAVALWNLHRLGHALSGLMSADQLQLALEAYEPALMVAYGEQMRAKLGFLERDSQDNDLLTGLLSLMIKEGRDYTRTFRLLSEVEVHSAQSPLRDDFIDRAAFDDWYRRYRSRLQQESIDDDQRQQSMKAANPKYILRNYLAQQAITQAEKDDIQPLQRLHQALQQPFTDQPEFDDLAALPPDWGKHLEISCSS

SEQ ID NO: 48671 - protein, 351 aa, Pseudomonas syringae pv. phaseolicola 1448A
MNSYNIAAVPGDGIGVEVIAAGVEVLQALSKKSGFDLTFKHFDWNSDNYLKNGHYIPEGGLAELKTFDAIFFGAVGALNVPDHISLWGLRLPICQGFDQYANVRPARVLPGVKSPLHNGHEIDWVVVRENSEGEYSGNGGRVHRGLPEEVATEVSVFTRAGVERIHRFAFELARTRPRKHLTMVTKSNAQRHGMVLWDEIFYEVAKDFPDVRIDKELVDAVTTRMVLKPSSLDVIVATNLHADILSDLAAALSGSLGIAPTANLNPGRNFPSMFEPIHGSAFDITGKGVANPIATFWTAAMMLEHLGESAAAKTLMSAIEAVTESGLHTPDLGGTATTRQVTDAVLQLINR

SEQ ID NO: 48672 - protein, 333 aa, Glycine max
  misc_feature (16)..(16): Xaa can be any naturally occurring amino acid
  misc_feature (321)..(321): Xaa can be any naturally occurring amino acid
PPPPEKVLSKIEKDVXCKIKMDEKFIIVSGKDRLILAKGVDSVHKIREEGDQRGTSSSQMTRSRSPERSPVSARFQRSEPQRSHSGPRNTSQFQQRLGRQERAVEDRIRDDVQKFSRGSPQAYGNSGARGRSSQSRSPRHAPYTGNSYNSFEGRNQNMGAYRNDGWDSHRRESGIRPGHQFDYSASPQTLEELELEYKNEAAELMKIRDREEDEENFKHREAIRDLREKYMSKVSLVRDTHAKQWEGFLQLDAQRRQQQAVQQMPSGYRGFKQQSFPEYDGSTANPPPYAGSNLPLESRNRFSDNMETYPNRPHDNFGEFXRRGDFAKAYNRY

SEQ ID NO: 48673 - protein, 105 aa, Brassica napus
MGMSLDFDVDLEKGIVVCDNVYAKSPEKPLLPMSPDNKPVETGEETVGSLGNDASPVQCAISKPGWGKEKRKKSASKPPRPPRGPSLDAADMKLIREIAELAMLK

SEQ ID NO: 48674 - protein, 176 aa, Desulfitobacterium hafniense DCB-2
MLYSYLDKRPTLGKDVFIADGAKIIGDVHIDEGASIWYNSVIRGDIASIYIGKGTNIQDLSVIHVNTNVPVIIEDDVSIGHSVTLHGCTIKKGTMVGMGSTILNGAIIEEGSMVAAGSLITENKQFPPHVLIMGSPAKVVRALTSDEVNALKETAERYSQKAREHRENSPLPIAKC

SEQ ID NO: 48675 - protein, 335 aa, Bacillus licheniformis ATCC 14580
MNQTINLKGRSYLAEKDFSEEEILYLLDLAQKLKEKKAQGIRHRYLEGKNIALLFEKPSTRTRCAFTTACIDLGAHPEYLGKDDIQLGKKESIEDTAKVLGRMFDGIEFRGFEHEKVISLAEHSGVPVWNGLTDLWHPTQMLADFMTVKEHTGRVKGVKLTYIGDGRNNVANSLLIGGAKVGMDVRICSPQELFPDQDIVKMAEAFAEESGGKITVTSDTDKAVSGADVLYTDVWVSMGEEDKFAERIKLLKPYQVNMDLVKKTGNDNVIFLHCLPAFHDLHTTYGQNVYEQHGLKEMEVTDEVFRSKHSKVFDEAENRMHTIKAVMAATLGDLD

SEQ ID NO: 48676 - protein, 468 aa, Bacillus licheniformis ATCC 14580
MAEEKKLGLFALIALVIGSMIGGGAFNLASDMASGAGAGAILIGWIITGVGMIALAFSFQNLTTKRPDLDGGIFTYAREGFGHFMGFNSGWGYWFAALLGNVAYGTLLFSAIGYFIPAFGDGQNIASIIGASVILWCVHFLILRGVQSAAMINLITTISKLVPIFAFIIAIIFVFHLDLFTNDFWGKGLSLGSIGTQVKSTMLVTVWVFTGIEGAVLFSSRAKKSSDVGKATVIGLISVLVIYVMITMLSLGVMNQQNLAELPNPSMAAIMEHIVGKWGAVLINLGLIISVLGAWLAWTLFAGELPLIAAREGVFPKWFGKENKNGAPTNALTLTNAIIQLFLLTFLISDAAYQFAFSLASSAILIPYLFSGLYQLKYSWLHKEPNRGKNLIIGIIASIYGVWLVYAAGLDYLLLTMILYAPGILVFRAVRKGKEGPVFNKAELLIAALILVLAVIAVIRLASGSISI

SEQ ID NO: 48677 - protein, 159 aa, Triticum aestivum
  misc_feature (44)..(44): Xaa can be any naturally occurring amino acid
  misc_feature (100)..(100): Xaa can be any naturally occurring amino acid
  misc_feature (102)..(102): Xaa can be any naturally occurring amino acid
  misc_feature (114)..(114): Xaa can be any naturally occurring amino acid
  misc_feature (118)..(118): Xaa can be any naturally occurring amino acid
  misc_feature (120)..(120): Xaa can be any naturally occurring amino acid
  misc_feature (124)..(124): Xaa can be any naturally occurring amino acid
  misc_feature (126)..(126): Xaa can be any naturally occurring amino acid
  misc_feature (131)..(131): Xaa can be any naturally occurring amino acid
  misc_feature (133)..(133): Xaa can be any naturally occurring amino acid
  misc_feature (135)..(135): Xaa can be any naturally occurring amino acid
  misc_feature (143)..(143): Xaa can be any naturally occurring amino acid
  misc_feature (146)..(146): Xaa can be any naturally occurring amino acid
  misc_feature (149)..(149): Xaa can be any naturally occurring amino acid
  misc_feature (152)..(152): Xaa can be any naturally occurring amino acid
  misc_feature (155)..(155): Xaa can be any naturally occurring amino acid
MAEQTFIMIKPDGVQRGLIGEVISRFEKKGFYLKGLKLQNVEKXSFAEQHYAHLSSKPSSAWLVEYIVSRPVRRYVWEGQERPLQLDAKIIGATQPPGPXPXTSVGDFAFNFGXKSSXGXTNLXCXKELPXGXLXISNGGEPXNWXTSXKFXWLXSSKT

SEQ ID NO: 48678 - protein, 199 aa, Vibrio fischeri ES114
MANVRARIELMVGQKSNIPAEMLSFEGLETDKEHVAVVFNQADKHQSTPLVRMHSECLTGDVFHSSRCDCGEQLEETINRMSESGGIILYLRQEGRGIGLYNKLDAYELQSQGMNTYEANNHLGFGDDLRDFKEAAQMLEALNISKIKLVTNNPKKIKDIQNYGIEIDEVVNTHAHVKQGNEHYLHSKAAHGHKLNFDK

SEQ ID NO: 48679 - protein, 435 aa, Mycobacterium leprae TN
MGPFDSKVAKMTRLDSVERAVADIAAGKAVVVIDDEDRENEGDLIFAAEKATLEMVAFMVRYTSGYLCAPLDGAICDRLGLLPMFAVNQDKHGTAYTVTVDARNGVGTGISASDRATTMRLLADPASVADDFTRPGHVVPLRAKDGGVLRRPGHTEAAVDLARLAGLQPAGAICEIVSQKDEGSMAQTDELRVFADEHDLALITIADLIAWRRKHEKHIERVAEARIPTRHGEFRAIGYTSIYDDVKHVALVRGEIAGSSGDGDDILVRVHSECLTGDVFGSRRCDCGTQLDAAMAMVAREGRGVVLYMRGHEGRGIGLMHKLQAYQLQDAGADTVDANIKLGFPSDARDYGIGAQILVDLGVRSMRLLTNNPAKRVGLDGYGLQIIERVPLPVRANADNIRYLMTKRDKMGHDLGGLDDFHESNYFPGEFGGAL

SEQ ID NO: 48680 - protein, 289 aa, Zea mays
  misc_feature (81)..(81): Xaa can be any naturally occurring amino acid
  misc_feature (96)..(96): Xaa can be any naturally occurring amino acid
  misc_feature (125)..(125): Xaa can be any naturally occurring amino acid
MGGKEEDVRLGANKFYERQPISTGVQGTDDKDYKEPPPAPLFEPGELKSCSFYRARITKFVATFLFLYISILTAMGVSKSXSKSATVGIQGITWSXFGGMILALRYCTGGMYGGHINPAVTFGLXLARKLSLTRAVFYIIMQCLGAICGAGVVKGFQQGLYMGNGGGANVVAPGYTKGDGLGAEIVGTFILVYTVFSAADAKRNARDSHVPILAPLPIGFAVFLVHLATIPITGTGINPARSLGAAIIYNGDHAWNDHWIFWVGPFIGAALAAIYHQVIIRAIPFKSRS

SEQ ID NO: 48681 - protein, 160 aa, Mycobacterium leprae TN
MSGGAGIPEVPGIDASGLRLGIVASTWHSRICDALLAGARKVAADSGIDGPTVVRVLGAIEIPVVVQELARHHDAVVALGVVIRGDTPHFDYVCNSVTQGLTRIALDTSTPVGNGVLTTNTEKQALDRAGLPTSAEDKGAQAAAAALTTALTLLNLRSRI

SEQ ID NO: 48682 - protein, 461 aa, Shigella flexneri 2a str. 2457T
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 48683 - protein, 329 aa, Edwardsiella tarda
MHITYDLPVSIDDIQAAKKRLSGKIYKTGMPRSNYLSERCKGEIFLKFENMQRTGSFKIRGAFNKLSSLTESERRKGVVACSAGNHAQGVSLSCAMLGIDGKVVMPTCAPKSKVAATCDYSAEVVLYGNNFNDTISKVSEIVEMEGRIFIPPYDDPMVIAGQGTIGLEILEDLYDVDNVIVPVGGGGLIAGIAIAIKSINPTIRIIGVQSENVHGMAASYYAGEIATHRTSGTLADGCDVSRPGNLTFEIARELVDDMVLVSEEEIRASMVALIQRNKVITEGAGALASAALLSGKLDQYIKGRKSVSIISGGNIDLSRVSQITGLVDA

SEQ ID NO: 48684 - protein, 435 aa, Candida albicans SC5314
MTEQPINTKKKNGDISKAPTPQNTPASVTNSYMRSKPPTVSTIQESNNEDGTGAAAAAGGLANNPVLLSMIQGKLGDLVGKQSGYIDNLSKPVKNRVYGLKSLQLNQMKLEAQFQKELLELEKKFFAKYQPLYVKRKQIINGELEPTVEEIEEGQQLEEEEKGIDKEDGEEEEEEEEDDEEEDEQGIPGFWLTALENLSTVSETITDRDSEVLSNLIDIRMEYLSTPGFQLIFEFKPNDFFENQTLTKTYHYQAELGYSGDFVYDHADGCEIRWKSKENNVTITIERRKQRNKTTKQTRTIEKLTPTESFFNFFDPPKPPKIKSEDDDNDDKLQDKEEANDDDEGEEGDEEDEELEARLELDYQLGEEIKDRLIPRAIDWFTGDAVDFDYPELEGEGDEDEYSDEDGEGDSDDDDDDDDEAAGSQKQPPPECKQQ

SEQ ID NO: 48685 - protein, 106 aa, Triticum aestivum
AYLGDTLEQVCTKKQAGTGPEFPGYRRPTRPNLNKKMRRSIEELSTGIVNKLLHGPLQHLRCDGSDSRTLEETLENMHALNRMFNLDTEKAVLEQKIKAKVEKTQS

SEQ ID NO: 48686 - protein, 608 aa, Debaryomyces hansenii CBS767
MECPEPSESVIPNDQSTKSCSIKLQPMNRFRDMSKLRNYEIIQKLGQGTFGVVQKARNIKTKELVALKQLINHSAKEGFPITAMREITILKKLNHKNILKIIDMIYEEPKISNPQDILHQRGCFYTVSPYMCSDLVGLLENPNINLEVSHIKCFMEQLLHGIQYIHEQMFLHRDIKAANILIDRNGTLKIADFGLARVYHGSPPKFMSGPGGGERAYTGLVVTRWYRPPELLLGERRYTTAVDMWGIGCVFGELFTRKPILVGKTDSHQAQLIFDLVGPPNSISWSEATSLPNKHDLNIGLTCQRSLESKFAPLMNPDGINLLSGLLTLDPYKRFNALDALNHNYFKNEPLPMKPQELPKFEECHEIDKERFKLLREKKNNIHEANKIPKAHFPKGPGEYNNSNNYPRNRNGSFPLALPKQPKFYNQHQQEAHVPQQMHTDTYIPKKRDDKPGANAPQKESSEPITSYQSLRDRSPRREGHISRKPSTTNSNNISSNSSASNVGGTLSNPTHQKNRPNAKASAGIFMTNSRKQRPKPNPQSSSRNVSDQFKKRKLLPDEQNESDLTDFDEDVKDSKQLDSFLDWDTFTRSPENRKLQHEKKQFETKYS

SEQ ID NO: 48687 - protein, 339 aa, Mycobacterium leprae TN
MTVRVGINGFGRIGRNFYRALLAQQEHGIADVQVVAINDITDNSTLAYLLKFDSILGRLPHDVSLEEEDTIVVGSEKIKALAVREGPAALPWHAFGVDVVVESTGLFTNAAKAKGHLEAGAKKVIVSAPATDPDITIVFGVNDDKYDGSQNIISNASCTTNCLAPLAKVLHDQFGIVKGLMTTVHAYTQDQNLQDGPHSDLRRARAAALNVVPTSTGAAKAIGLVMPELKGKLDGYALRVPIPTGSVTDLTADLSKCVSVNEINAVFQDAAEGRLKGILKYVDAPIVSSDIVTDPHSSIFDSGLTKVIASQAKVVSWYDNEWGYSNRLVDLVGLVGKSL

SEQ ID NO: 48688 - protein, 398 aa, Mycobacterium avium subsp. paratuberculosis K-10
MSTPLPPLVAPADQLTADEMARYSRQLIIPGLGVDGQKRLKNARVLVIGAGGLGAPTLLYLAAAGVGTIGIVEFDAVEESNLQRQIIHGVADVGRSKAASARDSIAAINPLVDVRLHEFRLDASNAVELFGHYDLIVDGTDNFATRYLINDAAVLAGKPYVWGSIYRFEGQVSVCWEDAPDGRGLNYRDLYPEPPPPGAVPSCAEGGVLGVVCASIASVMSTEAIKLITGIGESLLGRLMIYDALEMSYRTIAIRRDPCDASRPAITTLVDYEQLCGAAPAASTDAATGGAEAAITPRQLRELLDSGAKLALIDVREPVEFDIVHLDGAQLIPQSSINSGEGLAKLPADRMPVLYCKTGVRSAQALAVVRQAGFSDAVHLQGGIVAWAQQMQPDMILY

SEQ ID NO: 48689 - protein, 135 aa, Oryza sativa
INLVIVKKGDNDLPGLTDTEKPRMRGPKRASKIRKLFNLAKDDDVRKYVNTYRRTFTTKNGKKVSKAPKIQRLVTPLTLQRKRARIAQKKQRIAKKKSEAAEYQKLLAQRLKEQRERRSESLAKRRSKLSAATTA

SEQ ID NO: 48690 - protein, 64 aa, Oryza sativa
MGDRERRTVFVTVGTTCFDALVKAVDSPQVKEALLEKGYTDLIIQMGRGSYVPSKVNEFLFHSF

SEQ ID NO: 48691 - protein, 556 aa, Debaryomyces hansenii CBS767
MSNSTKKDDCHDVTIDSTISDIEIERSGSTNNVMIEPSPKSSSELLSSESVISDSDARPSKLIILITLTSSISGFMFGYDTGYISSALVNIGTDLSNKLLSNGEKEFITSATSLGALIGAIIGGILANLIGRKMVLLGSNVIFVIGTIIQLAAHTVWTMIVGRFVLGLGVGIASLISPLMLSELAPSKYRGRLIVTNCMFITGGQLVAYFINWGLTGVNNGWRVSVGLCMVPPIIQFVLFCFLPDTPRFYIMVGRVEEARKVLSKTHHNPSNAFVNATIQDMIASNSTVPGNNPLVQAWNSIKIIHTNPANFRALILACGLQGIQQFTGFNSLMYFSATIFETIGFDNATAVSIIIAATNFVFTGIALCIIDKIGRRRILLGAIPCMCISLVLCAIAFHFLGVKFTSDSDVIVEARGITGWGIVIILGMVWFVASYAIGIGNSAWTGVELFSDVNVRAVGCMYAAATNWAGSLVIASTFLTMLENITPPGTFAFFAGLCFVAFFFVFFLLPEVSGLELEETTEFLANGFNVKASRQISKDRKKVSKFVTQNDDHSA

SEQ ID NO: 48692 - protein, 143 aa, Idiomarina baltica OS145
MALERTLSIIKPDAVAKNLIGAIYNRFESAGLRIVASKMMHLSKEQAEGFYAEHSERPFFGALVEFMTSGPIVVQVLEGEEAILKNREIMGATNPADALAGTLRADYAETIDENAVHGSDAAETAAREIAYFFSDEEICPRTR

SEQ ID NO: 48693 - protein, 933 aa, Treponema denticola ATCC 35405
MAKSKYVYFFGGGSAEGNGTMREVLGGKGAGLAEMTAIGLPVPAGFTITTEVCEEYYKNNRKYPVELKTQVESYLSKLEKITGKKLGDKKDPLLVSVRSGAPVSMPGMMETILNLGLNDQSVQGLAEKTGNLRFALDAYRRFILMYGSTAMNIEREKFDKIFDDVKEKRTKKRLNLAQTAKVSDTDVNEPELQDVIDRSKKLYEKEIKSPFPQDPIKQLWGAIGAVFGSWMSDKAVTYRRVENIVGIRGTAVNVMQMVFGNKGDNSGTGVCFTRDPNSGKNDFYGEYLFNAQGEDVVAGIRTPIKLDVFAKKDPDAYKKLCDARKILEKHYKDMQDMEFTVEEGELYMLQCRTGKRLPAAAFQMAVDMVEEKLITKEEAVSRIKASDIEGVFYKALDYSKASEIKSAHLVDGIPAVPGAACGIICLSAEAAEAAAKDGKRAVLVRHETSPEDVGGMHAAEGILTATGGKTSHAAVVARGWGKCCIVGCENLRIDYEKKAISAKGIVLKEGDYITLDGSKGAVYKGELPLITPKPPAAYKKIMEWVDQIRKIKVRTNADTPEDAKIAVGHGAQGIGLCRTEHMFFSDESRIQAIREMIIAENKEAREKALKKLLPYQTKDFEGIFKAMNGYPVTIRLIDPPLHEFVPHDKEGQQKLAEKLNISFASVKNRVDQLTEANPMLGHRGCRLSITYPEILEMQVTAIINAACTVQKKGIAVLPEIMIPLTIDAKEFRILEKRVRAVADDIIEKKAKDKKLKYMVGTMIETPRAALLADKIAEYAEFFSFGTNDLTQMTIGISRDDAGKFLPEYVDENKAGVFKADPFQSLDQEGVGILVSTAIQKGREVKKNLEIGVCGEHGGDLNSVKFFCRAGMDYVSASPLRVPIARLAAAQAEVEALKSKSAAKKPAKPAAKTSKPSEKAKAKTGKKPANKPAK

SEQ ID NO: 48694 - protein, 774 aa, Vitis vinifera
  misc_feature (145)..(145): Xaa can be any naturally occurring amino acid
MAEKSCSVSSLPWLWVMETLASFERVDISLLKDLMIKAPEVSDNLGRNVKEMIALRCLEALFSGITNDVHPVVHSKMGFDPSESCEDVLQCILRKVSASKLRMGEPELLKWNVNPFIAHKRACLPKCALQELKDTILEGSHPSAXSLKERSGLRFESQCETRTPNGDGDSGAVAPRVDEGTACGQVEAAKGDLIPLTAENENNLLPEDTTERILLPYKRGLDDLPAKNLMGQFNPNVDSVNYGGDSHSNAKRRKHDAFCSITSIEPNPVSLHGKKLLEDSSRPSINECDLAKESQLGDLEGSTMVSEDDHDKYVVSKRVEQITDVEHGEFEHNQTQIPFHSNKMPQNMPRDESHHDISVDEAKDDDVEHWVEPNKSIGAASDGSQQKTAVDEAKDDGDCRVEPNKSSGSSDESQKKNSVDEAKDDGDHSSQPKASNDKLPNEAHHKVFVDEAKDDTEHCCEEEMLSDSTEYHDEEDGIAMERQNFLSSKCTFNHDSLSIAGWTEQNLCMKCTKDGQLLVCSSSGCPLVVHENCLGCPPSFDNMGNFYCPFCAYSRAVSEYLESKKKVSLAKKELASFINAGMKHEPVKPKKKHRKKNEKLNESANLVKVCENGHVKEKRQTRANHGDAQVTDQLIRRNVEKHDGVEEQGVANLGVQQEALQQQISDPLEDPASGTSGDENDKPSSSTYYIRFRRQQQQYTFPPIHQLRRKKLAWTAKEEEILKVGVQKFSNDHDKSIPWKKIMEFGGTVFQRGRTTIDLKDKWRNICKGSPKSK

SEQ ID NO: 48695 - protein, 496 aa, Thermus thermophilus HB8
MPLITTETGKKMHVLEDGRKLITVIPGDGIGPECVEATLKVLEAAKAPLAYEVREAGASVFRRGIASGVPQETIESIRKTRVVLKGPLETPVGYGEKSANVTLRKLFETYANVRPVREFPNVPTPYAGRGIDLVVVRENVEDLYAGIEHMQTPSVAQTLKLISWKGSEKIVRFAFELARAEGRKKVHCATKSNIMKLAEGTLKRAFEQVAQEYPDIEAVHIIVDNAAHQLVKRPEQFEVIVTTNMNGDILSDLTSGLIGGLGFAPSANIGNEVAIFEAVHGSAPKYAGKNVINPTAVLLSAVMMLRYLEEFATADLIENALLYTLEEGRVLTGDVVGYDRGAKTTEYTEAIIQNLGKTPRKTQVRGYKPFRLPQVDGAIAPIVPRSRRVVGVDVFVETNLLPEALGKALEDLAAGTPFRLKMISNRGTQVYPPTGGLTDLVDHYRCRFLYTGEGEAKDPEILDLVSRVASRFRWMHLEKLQEFDGEPGFTKAQGED

SEQ ID NO: 48696 - protein, 467 aa, Erythrobacter sp. SD-21
MTAMNHGADNTMDHELETAGRGTISLAGGVAMGTGVMIGAGIFALTGQIAELAGPLFPLSFIVGALVTSLAAYSYIKMSNAWPSSGGIAMILQKAYGPGVVAASASLLMALSMVINESLVARTFATYALRPFGLEENAFLLSALALALIVFAYIVNKAGNRSVSGFSLIMSAIKIGGIALFAVAAIAASGFFSGAFAEPANITSGGAFLASVAFSILAFKGFTTITNSGGEIVDPHRNVGRTIMISIAICVVTYLLVAFAVGSSLTIGQIVEARDYSLAAAARPALGQLGFWFTIVIAIAATTSGVIASVFAVSRMLTMLTEMKMIPHRHFGMKGPIRGHLLVYTVVIAGTLAVLFDLSRIASLGAFFYLVMDILVHWGVYRHLRNEIGAKGSVLLAAIAADGVILAAFAGVKLDSDPAIVVIAAVLIAAVFALEALFLRRKRVADGNDHRDANGDESQPPSNGAEN

SEQ ID NO: 48697 - protein, 544 aa, Bradyrhizobium sp. BTAi1
MNIHVHTPDETETAVLDEAHIGHIHGALGTILHGDVGPRTTWRHRLQTLLAILGPGLIVMVGDNDAGAFGTYTQAGQNYGTALLWTLVLLIPVLYVNQEMVLRLGAVTGVGHARLILERFGRFWGAFSVIDLFLLNALTIVTEFIGISLGLSYLGLPKELGVALSAVVIMGAASTGNFRQFERFALVLVAGSLVLVPIVIMVHPPMTEIVHNLIVPQFPQGAKLSEVMLLIIAIVGTTIAPWQLFFQQSYVIDKRITPRFIRYQRADLWIGIVLVIVGAVAMMAFTAQAFTGTAEFGQFKDAAAVSAGLEKYAGRLPGVLFAIALIDASIIGAAAVSLSTAYAIGDVLSLRHSLHRKPKDAKGFYAVYCGLIVVAAGLVLSPGAPLGLLTNAVQTLAGVLLPSATVFLLLLCNDKAVLGPWCNGRGMNLFTGAVIAVLVMLSVVLTSSVLFPEATDETVILSLLGGGTVLALVAAVMSGALGRKPADSANLAEREHWRMPPLHRLPPARLAAGSKLWMLVLRGYLIVAAGLVLVRIAQLAVSAG

SEQ ID NO: 48698 - protein, 756 aa, Ashbya gossypii ATCC 10895
MRKVTEREESHSRYSVSTPEYPLATVPVPYQYKIEKTISRDEASTFLLGSLGHEPPSLKRRQDSEEPDLCEASSHKRSKTDADELTPNSGFEQLGYLKGGDAGGSGGAADVQRADADAERAASDADRADAACAEGAQRDGEAELHDTTLSADEGAATGLGALVGAVVEEALPISPLASPGYTPPFSGLQGGVEAGNSLVAHRSSLTLQDTMQNIATNAFLQLPHSAFKNLVFQLLSKLNRSELSDLSTYLKDHLKRDFLQYLPMEVSMNILNNLDFEDICSCLLVNRTWNNLIRNSPYLWKHMMLSEGFVTEDCFSSYCDSIPEKHRHLPNPSDRFRLDFLENRWLLENWCNPCYRPGRTCLDGHRTKVVTCFQFEGNYIITGADDKRINVYDADREQFKLELVGHEGGVWALKYAGDEILVSGSTDRTVRIWNVKAGKCTHVFRGHTSTVRCLDVVEHGGIKYVVTGSRDNTLHVWKLPDPNSPDYNPNAMRQFNSIEDNPFFVGVLRGHMASVRTVSGHGNIVVSGSYDHNLMVWDIAKMKLLYVLTGHTDRIYSTLYDHKRKRCISASMDTTVKVWDLSDINNNGPVSQINSTSALKVSGSVRTLCGHTALVGLLGLSDKYLVSAAADGSLRGWDASDYSKRFSFHHTNQSAITTFFVSDNILVSGSEHQFNIYDLRTGRLVHRHLLNDAAQIWGVKFNNRKLVVAVESEDHSYVEILDFGSRNRPVTYMSMRSPPSTSNSYWNQRGDPTASS

SEQ ID NO: 48699 - protein, 293 aa, Triticum aestivum
  misc_feature (74)..(74): Xaa can be any naturally occurring amino acid
  misc_feature (135)..(135): Xaa can be any naturally occurring amino acid
KLGVTRARLAAFVRAYPACLHASVAVDLAPIVKALRGLDVDRQDIPRVLERYPDVLGLKPDGTISTCVAYLVGXLRTPRDIVPMATHYPFFLSMRVGTTIKPFCDYITSLGLPMRILARIIEKRPYILGYDLEEXTVKPNVEALLSFRIRKEVLPLMIAQYPSILGLPLKVKLAAQQYFFNLKLKIDPDGFARAVEKLPQLVSLHQNVILKPVEFLRGRGITDDDIGRMLIRCPQILLLRNELMKNSFYFFKSELKRPISELLEYPEYFTYSLESRIKPRYMRVASKGIRCSL

SEQ ID NO: 48700 - protein, 439 aa, Bradyrhizobium sp. BTAi1
MSRVTETVVPRGSLSERTVSAARQVLEGRHSGLRAYLAFAGPAVIASIAYMDPGNFATNIQAGAKYGYALLWVVLAANLIAMLFQALSAKLGIVTGRNLAEMCRDHFPQPVVWAMWAASEIAAMATDLAEFLGGAIGLSLLFHVPLLAGMAVTAVVTYGVLMFERSGFRPIELIIGGMVSVIALCYVVELFIAPVDWAAAAVHLVLPQIPDGGALLLSVGIIGATVMPHAVYLHSGLTQARTPVHNDAERRKLLRFSNQEVIIALAVAGLVNIAMVMMASGAFHAGYTDVEEIETAYHTLTPLLGIGAAAVFLLSLIASGISSSTVGTMAGQMIMQGFLRFRVPIVVRRLVTMLPAFIVVAVGANATSSLVISQVVLSIALPLPMISLLIFTSRRDIMGQFANSRLTFLAALLGTALVLLLNIFFILQIFGLPMPGFAA

SEQ ID NO: 48701 - protein, 470 aa, Corynebacterium efficiens YS-314
MATSSPDVWQSPRHRRTVYSVLAIVGISILFDGYDLVIYGAVLSTLLNDPSHIGALSPAVAGTLGSYALIGVMIGALTAGAICDWVGRRKVMLTAIIWFSVGMALTAMATSITMFGFLRFLTGLGVGMIVATGGAIIAEFAPRNRRNLFNAIVYSGVPAGGVMASVFALLFEDYLGWRGLFFIGATPLLFLFPLALFALPESPRWLASRGRRAEAIALCERKGLPIADFVPSTPAPVASESVAVTAPAATERTGFAGIFSRAYLPGTLLIGAMSFIGLLSTYGLNTWLPKIMESNGASAHDSLYSLLFLNGGAVIGGLIASWFADRIGAKTIITSTFFLAALCLGALPFISAWPLMYTAIALAGIGVLGTQVLTYGLTSNYFGTACRAAGVAWCAGFGRLGGIVGPAVGGLIIGMGLGPTVAFFIFAGAAILGAICTALIPRSPAEVTISTLPSASREPVAPRRTPQPQS

SEQ ID NO: 48702 - protein, 208 aa, Corynebacterium efficiens YS-314
MSNGFQMPSSRYVLPSFIEQSAYGTKETNPYAKLFEERIIFLGTQVDDTSANDIMAQLLVLEGMDPDRDITMYINSPGGSFTALMAIYDTMQYVRPDVQTVCLGQAASAAAVLLAAGAPGKRAALPNARVLIHQPATQGTQGQVSDLEIQAAEIERMRKLMETTLSQHTGKTPEQIRIDTDRDKILTAEGALEYGIIDQVFDYRKLNT

SEQ ID NO: 48703 - protein, 199 aa, Corynebacterium efficiens YS-314
MSDNLNMTAPGAGTGYSGDIFDRLLRERIIFLGSQVDDEIANKLCAQILLLSAEDPTRDISLYINSPGGSVTAGMAIYDTMKYSPCDIATYGMGLAASMGQFLLSGGTPGKRYALPHARIMMHQPSAGVGGTAADIAIQAEQFAQTKREMAKLIAEHTGQTFEQVTKDSDRDRWFTAEQAKEYGLVDHVITLAEGPISN

SEQ ID NO: 48704 - protein, 556 aa, Legionella pneumophila subsp. pneumophila str. Philadelphia 1
MSYLALARKWRPRTFSQLVGQEHINKALINALNQQRLHHAYLFTGTRGVGKTSVARILAKALNCEKGITSEPCLHCDTCIAIEQGRYIDLIEIDGASKTRVEDTRDLLDNIQYAPTNGRFKVYLIDEVHMLSQHSFNALLKTLEEPPSHVKFILATTDPQKLPVTVLSRCLQFNLKHLPAELINQQLQLILQEERLDFEIQALDILAQAARGSMRDALSLLDQAITSCETKLLASDVKMLLGHTQQDYALLLLQALAKQEAPIMLVLSQQIIAEGGNFQYVLDEILSYLHQITVYQCLGDNNPLISPKAEIKELAKQFSAADTQLFYQIGIKGREEMHLAPTLAIGFNMTMLRMYTFKPASHVTTPPLAFEQNNKTCSLIVDDNTPAQNPIGIEPIPVIKATDNTVAYQQTQSLSTDDKKSANSGESMSCDWNEIIPQLKLSGLALNAIENAEFLGKKEREITFGVHKGHQSLFTPTTINRIETALAGYYKSPVKIILNTQDAVHASPAQQKEKASQEKLEQAEAALHADPVFQQLQQEFSAELVKNSIVLLKDDL

SEQ ID NO: 48705 - protein, 731 aa, Oryza sativa
MNSQKKRSPKIEPFRHRVDADPKSFDKSWKKLEDAIREIYNHNASGLSFEELYRTAYNLVLHKHGLKLYDKLTENLKGHLKEMCRSIEDAQGSLFLEELQRRWADHNKALQMIRDILMYMDRTFITTNKKTPVFDLGLELWRDIVVRAPKIHGRLLDTLLELIHRERMGEMINRGLMRSTTKMLMDLGSSVYHDDFEKPFLEVSASFYSGESQQFIECCDCGEYLKKAERRLAEELERVSQYMDAKTADKITSVVDTEMLANHMQRLILMENSGLVNMLVDDKHEDLSRMYNLFKRVPDGHSTIRSVMASHVKESGKALVSDPEKIKDPVEFVQRLLNEKDKYDEIISISFSNDKAFQNALNSSFENFINLNNRSPEFISLFVDDKLRKGVKGANEEDVETVLDKVMMLFRYLQEKDVFEKYYKQHLAKRLLSGKTTSDEAERSMLVKLKTECGYQFTSKLEGMFNDLKTSHDTMQSFYANLSGDTDSPTISVQILTTGSWPTQPCTPCKLPPEIVDISEKFRAFYLGTHNGRRLTWQTNMGNADIKATFGGRRHELNVSTYQMCVLMLFNSADGLTYGDIEQATGIPHADLKRCLQSLACVKGKNVLRKEPMSKDISEDDTFYYNDKFTSKLVKVKIGTVVAQKETEPEKLETRQRVEEDRKPQIEAAIVRIMKSRRVLDHNSIITEVTKQLQSRFLPNPVVIKKRIESLIEREFLERDKVDRKMYRYLA

SEQ ID NO: 48706 - protein, 416 aa, Mycobacterium leprae TN
MRIPNLKDLLEEGVSGRCVLVRCDLNVPLGDDGAITDLGRVTASVPTLKALLEAGAKIVVAAHLGRPKNGPDPKLSLEPVAAALGEQLGQNVQLVCSTDRSPVGGDALACVERLTDGDLLLLQNIRFDPRETSKVDDERLALAKQLVELVGSAGAFVSDGFGVVHRRQASVYDVATLLPHYAGILVADEIRILEQLTSSAKRPYAVVLGGSKVSDKLGVIESLATKADSIVLGGGMCFTFLAAQGFSVGKSLLETEMIETCRSLLDTYADVLRLPMDIVVTEKFVADSPPQTVAADAIPDGLMGLDIGPESVKRFATLLSNASTIFWNGPMGVFEFPAYAAGTRGVAEAIVAVTGKGAFSVVGGGDSAAAMRALSLPEGSVSHLSTGGGASLEYLEGKTLPGIEVLGREQPRGGDS

SEQ ID NO: 48707 - protein, 53 aa, Triticum aestivum
MTTSRRLADRKSAKFQKNVTKRGSVPETTVKKGNDYPVGPIVLGFFIFVVIGS

SEQ ID NO: 48708 - protein, 756 aa, Burkholderia sp. 383
MDEQLKQAALAYHLNPKPGKISVTPTKPLSNQLDLSLAYSPGVAAACEAIHADPLDAQKYTSRGNLVGVITNGTAVLGLGNIGPLAAKPVMEGKGCLFKKFAGIDVFDIELSESDPDKLVEAIAMLEPTLGGINLEDIKAPECFYIEQKLRERMKIPVFHDDQHGTAIIASAAILNGLKVVDKKLSEVKLVCSGAGAAAIACLDLLVNLGLTKSNILVADSKGVIYEGRGNLDPSKQRYAATTDARTLADAIVGADVFLGCSSAGVLKQDMVKTMGDRPLILALANPEPEIRPEDAKAVRPDAIVATGRSDYPNQVNNVLCFPFIFRGALDVGATTITEEMKLACVRAIAELAQETDQSEEVAKAYEGHSLEFGPDYLIPKPFDPRLIIKIAPAVAQAAMDSGVATRPIQDMDAYREQLGATVYRTGMVMRPVFATAKQKQARIVFAEGEDERVLRAAQFVLQEKIAKPILVGRPSVIDMRLAKIGSKLKAGTDFEIVDPEDDARYHRYWQAYQEIGARDGVTPEVAKAAMRKFNTLIGAMLVHLGDADGMICGMIDTFHSHLKFIEQVLGRAKGAEHFAAMNLLMLPGRNLFVCDTYVNELPSAEQLADMTIQAAAEIERFGIAPKAALLSNSNFGSAPSASSRRMGEARKLIVERAPNLEVDGEMHGDAALSEMIRKQAFPGTTLSGEANLLIMPNVEAANIAYNLLKMVGGEGVTVGPFLLGAAKPAHILTPAATVRRIINMTAVAAANVNTK

SEQ ID NO: 48709 - protein, 261 aa, Mycobacterium leprae TN
MSRKSLIAGNWKMNLNHFEAIALVQKIAFSLPDKYYDKVDVTVLPPFTDLRSVQTLVDGDKLRLTYGAQDLSQHDLGAYTGDISGAFLAKLGCSFVLVGHSERRTYHDEGDALVAAKTAAALKNSLTPIVCIGEYLEIREVGEHVSHCQNQLRGSLAGLSPEQIGNVVIVYEPVWAIGTGRVASAADAQEVCEAIRKELGALASPQVAETVRVLYGGSLNAKNIGDIVAQQDVDGGLVGGASLDGAQFATLAVIAAGGPLP

SEQ ID NO: 48710 - protein, 342 aa, Solanum tuberosum
MARCRLLLFLAALFSIFGLLHASAGDADPIYSACVDQCEKTGCVGDECSQHCNFTSGGIPVDGPWYLQEPLYLRWKQWDCLSDCRYHCMLAREKERKKVGLKPVKYHGKWPFQRVNGIQEPVSVALSALNLAMQFHGWVSFFIFVNYKLPFRPNRKPFYEYTGLWHIYAIFAMNSWFWSVVFHSRDVYLTEKLDYSSAVALLGFPLILAVLRVFNVTDEAARVMVSAPLVAFVTTHILYLNCYQLDYGLNMKVCLGMGILQLILWAVWAGVTRHPSRWKLWVVVIGGALAALLEIYDFPPYRGFVDAHALWHATTIPLTYLWWSFVRDDSEFRTTTLIKKAK

SEQ ID NO: 48711 - protein, 811 aa, Cryptococcus neoformans var. neoformans B-3501A
MTGGAFFAPAADNDEEYDMGPVGEAHAVQWIGTAGVKGPKWARLPLLTVGMLGIQCVWSIEMGYASPYLLELGLSKSFMSLVFMAGPLSGLIVQPLVGIFADRSRSPLGRRRPFMLAGCLICVSAMMLLGWSREVAAIFGGGQWLAITLAVWAIYCIDFSINAVMSTDRALVVDTLPPREQEEGSAWAGRMFGFGSVAGFFVGNLDLAPVLPFLGKTQLQILSFLTSAVLMVTHSFTSWAVSERVLLRDDRPQSKSSLKSNLKSIWENMFSLPPGIRTVCIVQFFASLGWFPILFFTTVWVSEIYKSSVPSDGIDPATFDSRAVRSGARALLLQALVNIITSIGMPFLVAESGVQPSESVDGYEAIEGSSSRRVGLETANGDGRSPQASVATPPNSALWKRAREDLENGTVFRRFLHSVQSMVNNVKKGELGIPIKGLTLVKVWWISQFVFAAAMAGSWFVKSVGGAYVIIATTGFCWALSQWAPYSLLGELILIDGSIQRNQSINLSRMRARRNSSDAQSRPSSALFDAEETSHPIIPPSNTNFSRVSTPLHSRHASRTSLVLDRSNRHSRDRTRPSSPSSNLDRPANFDREKFMSHKSNLSLEGEGLSPLVIQGDTPVEPAFGSTVVLRHSDEMSRSEGEDDEYEMGQVRGNSSSTHHSPRASGDYDMNGTKGTADKAGVILGIHNVFLVLPQFIVTVLSSVIFWLMEPSKSLPTHHPGSVPVTDTNTTAAIAAIANSSVLEDAVSATMEVAEQVAKRTVELVSREGVDVDVSSPDAVGLIFRIGGVSAAVGGWICWRLARDWARGQGV

SEQ ID NO: 48712 - protein, 169 aa, Picea sitchensis
MGWGNFLKAVLSNIDIFAGPVVTLLYPLYSSIRAIESPSRLDDQQWLTYWVLYSFITLFELTFSRMLQWLPFWPYVKLIATCWLVLPVFNGAAYVYENFVRTYLLNSSVLNSRARSSPGQRILNAISPSTKNSVERFVNQYGPDALDRAIKRAEKEAKVNRNTGYDDEY

SEQ ID NO: 48713 - protein, 627 aa, Zea mays
MNGQTPMGLAAVAVRPCCSRLISSASAAAASKTAAGTATSLFPRLPHPHHPPYGRRLPFLVSAASQSQAGPGTPPTPVPAPVPSDPRAAVSGNLPFFDRVLFPDSFPLETPPSKEEEDAAALQTDEAVAPAVPLREETETEREAWRLLRRAVVSYCGEPVGTVAAEDPECTEMLNYDQVFIRDFVPSALAFLMRGETEIVRNFLLHTLQLQSWEKTVDCYSPGQGLMPASFKIRTVPLDENNEGFEEVLDPDFGEAAIGRVAPVDSGLWWIILLRAYCKITGDNALLERVDVQTGIQLILSLCLADGFDMFPTLLVTDGSCMIDRRMGIHGHPLEIQALFYSALRCSREMLVVNNGSKNLIRAINNRLSALSFHIREYYWVDMKKINEIYRYKTEEYSHDATNKFNIYPEQIPSWLVDWIPEKGGYLIGNLQPAHMDFRFFSLGNLWAIASSLTTPKQAEGILSLIEEKWDDLVANMPLKICFPAMEDDEWRIITGSDPKNTPWSYHNGGSWPTLLWQFTLACIKMGRPELARRAIAVAEERLSDDKWPEYYDTRSGRFVGKQSRSYQTWTIAGFLTSKMLLENPELASILTCDEDLELLQGCACCLSKKRTRCSRRVAKPHAGVKL

SEQ ID NO: 48714 - protein, 281 aa, Oryza sativa
  misc_feature (243)..(243): Xaa can be any naturally occurring amino acid
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALXAAGKEISALEGVVEHGLFLDMATSVIIAGTDGVSVKTK

SEQ ID NO: 48715 - protein, 262 aa, Zea mays
MLRPTSDQASAPDTHHLPPRSTTPAMATAFDSPTSSPAAAPFHDDPFLHFDGSAPAAADGFPASPDAYAPSPFGMPHSNGDLHDDPFAAPADSNGGPILPPPTEMGREEGFLLREWCRQNAIHLEEKEKKEKELRSQIIVDAEEFKKAFVEKRKLNAETSKGQNRDREKLFLANQEKFHAGADKQYWKAISELIPHEIANIEKRGARKDKEKKPGIVVIQGPKPGKPTDMARMRQILLKLKHTPPPHMKPPPPPAAATGKDV

SEQ ID NO: 48716 - protein, 1212 aa, Candida albicans SC5314
MNNQDPDSQYHNKKVYPPNLPSIPPPPQQPLSGRPATPRMLRSISGTLKSKTELAHSDKGQESNNETKNSNSPHYVPDTHTRQPPPESLKSNIQAPTAVHGNQQKGSLLPPPSIPNPNTMKPAPTPTGVDQPPAKQKPSPAPKQPQPQQQQQQQQQQQFHRKSIGDWNFVKTIGAGSMGKVKLAQHNATHEICAVKIIPRAAKLYQRAHANDPPPQTTQEAAQRHKEFEKEVARDRRTIREGALGRLLYHPFICRLYEMVPMTNHYYMLFEYIEGGQMLDYIVAHGSLKERHARKFARGIASALDYCHRNNVVHRDLKIENIMINEKGDIKIIDFGLSNLYAPKNLLKTYCGSLYFAAPELLSAKPYIGPEVDVWSFGVVLYVLVCGKVPFDDQSVSVLHEKIKKGNVEYPAFLSRECVSLLSRMLVVDPTKRASLYEVCSHPWMNKGYDYKVNNYLPRREPLRLPLDPEIIKTIANFELGTVQGVADELTSILTSVEYQMSCENWYKITETGREYASSQNAQILPDPTGGFHPLVSIYYLVDEMRKRKKAKEEALKAQRRAQVPTIAVPTPKQQQQQQPQPAQPQPQPQPEVSQPLPEPKPVPPEEIINPAVATQAQANMTAPKIVETFSETPQRTLDPSKQSVDEKPSAPGPSIAVPEQAHTTSVPSSFVKTQTSIDEDQLSIPEQQSPRTSTPQTLDPAKVVGGSSGSAISAPNAGSGAGFNSLLRRLSSKKYKGASSPKRSTSPSPNVEGLSPQPTKADPMVRRGVSMKVTAKEKQTNTRPPKSELIKKKPQHGRSSSTSNKMQGFIPVEYLPPLPTIDTNTNTIVSDGAKQQNLTVPSTARHMHPTARAKSVGGGHMRKDSYGRVSHGSQNPLPPLPTSMASQNSQEVVGKDTSEGFFDDVQLDDVGYQEVPQLTESEIIEQYNISKPNSMPSIEHCKTLFLKGFFSVQTTSAKPLPVIRYNIINVLSKLGVKFQEVKGGFVCMHTPSVQPSHSNELDEENKLYGDAFKSKSSDSFEAAEPEGSKTPSRQPSLQLPSHTPTTPSGPKSHKSSNSIGSIGGNVPRRKFSIGNAFNTYRKKNGSQVMMPPNTPATAKVIHGLYDDDDKERNGEDDDDEDDYGYDDSADSLNGYGGGSDMLISSRIEQRAKHQRTVSSSSQKASKSPLKFEIHIVKVPLVGLYGVQFKKILGNTWNYKTLASQILNEMNL

SEQ ID NO: 48717 - protein, 262 aa, Synechococcus sp. CC9311
MEGDSYHRFERMAMKTAMSESLAKGENFSHFGPEANLFDKLEELFRVYGETGGGQKRYYLHSPEEAAEHNARLGVSLDPGQFTPWEDIPGGTDVLFYEGLHGGVVGDGYDVASHADLLVGVVPITNLEWIQKIQRDNAERGYSAEAIVDTILRRMPDYINHICPQFSLTDINFQRVPTVDTSNPFICRNIPTPDESFVIIHFRKGAREKWGIDFSYLLSMIHDSFMSSPTSIVVNGGKMGFAMELILTPIIHRMIEEQSKLS

SEQ ID NO: 48718 - protein, 447 aa, Debaryomyces hansenii CBS767
MGKFVQLLSHPTELKAVIQLMYFRQPLHPQGASSQSQASKRCYELLNITSRSFAAVIQELHPELRDAVMLFYLILRALDTVEDDMTIEPEIKVPLLRTFHDKLNLKEWSFDGNSKTEKDRCVLVEFPCILTEYHKLKEDYQDIIKHITKEMGNGMADYILDDNFNVNGVATVREYDLYCHYVAGLVGEGLTKLMVLAGFSDNSLSQDNFAKSESMGLFLQKTNIIRDYHEDLEDGRSFWPKEIWEKHTSSLPSFHKDTSLESQGHGLACINELVLNALCHVKDVLTYLSLVRDPSCFNFCAIPQVMAISTLALVYNNPNVLHGNVKIRKGTTCGLILNSRTLPGVVKIFKHYVQVINHKSSVQDPNYLKIGIKCGEIEQFCELMYPSEYAIPKGVVKQKQEINHNILERASVDDQVAETVNLEETKCNLAVGISLLVVVVVVAYFIH

SEQ ID NO: 48719 - protein, 292 aa, Shewanella sp. ANA-3
MSDFPTIEACIGQTPLVRLQRLDCGSSTVLLKLEGNNPAGSVKDRAALNMIIQAELRQEIAPGDTLIEATSGNTGIALAMAAAIKGYKMILIMPSNSTQERKDAMQAYGAELLLVDNMEAARDLALDLQAQGKGKVLDQFNNQDNANAHFQTTGPEIWQQSQGKITHFVSSMGTTGTIMGVSKYLKSRNPDITIVGLQPADGSSIPGIRRWPQEYLPGIFDAARVDAVMDIEEQDAKAMARTLAREEGICAGVSSGGAVFAALEIARQNPGSVVVAIVCDRGDRYLSSGLFS

SEQ ID NO: 48720 - protein, 413 aa, Zea mays
MAAAATTSSSSHLLLLSRQQAASLRCRLSFLGQPRRPGRVTAQAPAAKDVRCMAAVDTTAASTAAAETSPKSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 48721 - protein, 415 aa, uncultured archaeon GZfos9D8
MITIAIAGKPNSGKSTFFKAATLADVEIASYPFTTISPNVGVAYVRVKCPCKDKTIQQEIGRECGNCVDGFRFVPVELMDVAGLVRGAHEGRGLGNEFLDELRQAEAIIHVVDASGGTDADGNVAEIGSHDPLEDVLFFQHELNEWVKGILSRNRRKIERKAKLEGMKIPRLVSEQLAGVGVTEEQVKAAILGSRVRDKPDMNSWDEDDMKDLASQLIKKSKKMIIAANKADIAPEANVRKLKELELERESKEEEAAVVIPSSAEAELALRTAAKHEFIKYLPGDTDFEIAHSAEAEVTEKQREGLERLRKQIHAYSGTGTGVQAIINRVVFDLLDYVVAYPVEDEHKYSDASGRILPDAFLLKNGSTARDLAFAVHSDIGESFLYAIDARTKRRLGEKYALRNNDIIKVVYSSR

SEQ ID NO: 48722 - protein, 430 aa, Magnaporthe grisea 70-15
MDVDEMDVEEDFDQEQRIINEEYKTWKKNSPFLYDMILSTALAWPTLTVQWLPDVKEPEGKNYRIHRVLLGTHTSGATDEYLQIAEVEIPKAVQPNPADYDEDRGEIGGYGGSKGSEAAAIKWNITQKIDHPGEVNKARYQPQNPDIIATACVDGKILIFDRTKHSLQPSGTPNPQYELVGHKAEGYGLNWSPHDEGCLVTGSSDQTVLLWDLKDVQPNNRILKPKRKYTHHSQVVNDVQYHPLVKHFIGTVSDDLTLQILDTRQESNDKAALVAKNGHSDAINALDFCPASEFLVATASADKTIGLWDLRNVKDKIHTLEGHRDAVTSVFWHPHEAGILASGSYDRRILFWDLSRVGEEQQPDDAEDGPPELLFMHGGHTNHLADFSWNPNEPWMVCSAAEDNLLQVWKVAESIVKRDDADLPVDELGP

SEQ ID NO: 48723 - protein, 392 aa, uncultured archaeon GZfos9D8
MFSERIRSLPPYLFAEIDKRKREAEKKGADIIDLGIGDPDLPTPPHIVEAVCRAAKDPANHCYPTYEGMLSFREAVAAWYNREKHVRLDAEDEVLTLIGSKEGIAHSAFAFLDHGDVALVPDPAYPVYNNATVLADGIPHLMPLRQENGFKPVLNDIDRETASKAKVMFLNYPNNPTAATVDRTFFKEVVDFAREHDIVILHDNPYSELTFDGYEAPSFLAVAGADEVGIEFNSLSKTYNMTGWRIGYAVGNSELLKSLGLVKTNIDSGAFQAVQIAGTTALTGPQDCITANVAVYRQRRDILFDALSSAGMEVKKPKATFYLWAKVPPGFSSIQFSMFLLEREGLVVTPGVGFGENGEGFVRFSLCVSVERLKEACERIKGLDRYSHSENY

SEQ ID NO: 48724 - protein, 347 aa, uncultured archaeon GZfos9D8
MKRRKEGYFDFEHHPNAYLERKRNVEQGLHARTKILEALAMSTPTAAATAAVSNSEEMREDGTELTIKAISKSAAMSYSSSFHHLRLLEEEKIVKREGPRPYKWVVTGKGQRSLDELDLELGVTKMREELLMIPGPVPVLPRIREAMTKPMIFHRGDEFGAMYEEIVETLKDIYQTKNDLFVLSGSGTCAMEAAIGNLVGNETKMVCITIANGKFGERFGEIAVRYKADAVTPVNVNVNFEWGHSIELEAVKVALENSSSSDPKSKIVTMVHNETSTGILNPAKEVGKLAKKHDAVFVLDCITSIGGDKVPVDELGADIAIVGSQKCLGAPPGLSALSVSEHAWEMS

SEQ ID NO: 48725 - protein, 487 aa, Arabidopsis thaliana
MESVALSRIGLAGLAVMGQNLALNIADKGFPISVYNRTTPKVDETLDRASNEGKLPVAGQYSPRDFVLSIQRPRSVIILVKAGAPVDQTITALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 48726 - protein, 178 aa, Legionella pneumophila subsp. pneumophila str. Philadelphia 1
MSLMEIQSGRDVPNEVNVIIEIPMHGEPVKYEVDKKTGALFVDRFMTTAMFYPTNYGYIPNTLSEDGDPVDVLVITPVPLISGAVISCRAVGMLKMTDESGVDAKILAVPTTKLSKMYQSMQTYQDIPQHLLLSIEHFFKHYKDLEEGKWVKVEGWVGPDAAREEITSSINRYNHTKK

SEQ ID NO: 48727 - protein, 482 aa, Solanum tuberosum
MASATASHTFCGIPTKSSSSTTNRSTTPSSARFLLKTPLRRLGFAGAVADPLFTSHVATKLRSLKASSNPVRAVVSMAKKSVGDLSSADLKGKKVFVRADLNVPLDDAQNITDDTRIRAAIPTIKHLIANGAKVILSTHLGRPKGVTPKYSLAPLVPRLSELLGIQGVKADDCIGPEVEKLVDSLPEGGVLLLENVRFYKEEEKNEPEFAKKLASLADLYVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSIKTFNDALDTTKTVIWNGPMGVFEFDKFATGTEAIAKKLADLSGKGVTTIIGGGDSVAAVEKVGVASVMSHISTGGGASLELLEGKVLPGVIALDEADAPVAV

SEQ ID NO: 48728 - protein, 134 aa, Zea mays
GAFTGEVSAEMLVNLGVPWVILGHSERRALLGESNEFVGDKVAYALSQGLKVIACVGETLEQREAGSTMDVVAAQTKAIAEVAESTRIIYGGSVTAANCKELAAQPDVDGFLVGGASLKPEFIDIINAATVKSA

SEQ ID NO: 48729 - protein, 160 aa, Triticum aestivum
MLRAGGSRLVAPGLRRLLGPDAGERAAPGLAAAGARAYHERVVDHYNNPRNVGSFDKDDPNVGTGLVGCGSAIASSSVATEWVKGKQMEEVVSIKNTEIAKHLSLPPVKLHCSMLAEDAITAAVSDYANLCRRQLGDSPAELCIQRVGSSPIWSTCRRPH

SEQ ID NO: 48730 - protein, 99 aa, Triticum aestivum
  misc_feature (46)..(46): Xaa can be any naturally occurring amino acid
  misc_feature (79)..(79): Xaa can be any naturally occurring amino acid
MRKRKRENPCGIWGHYQKYEEAEPRVWCGHRPTALEPTGAESDPRXETTVPSEILKDCLLLGGCDNADRCELIMTVGIXHVHDCADVCVNLYRGSLTEL

SEQ ID NO: 48731 - protein, 538 aa, Candida albicans SC5314
MSPSLVHQILAITHPYVEYLEENITKWYILVPGILIVLNVLTTLHTKYLEYKFNAKPVTNFIQDYTFGVITPLILIYYKSQGTVMEFANNFWNFKFLIKNPDVGTGELRIFGMHLIETKDPENIKAVLATQFNDFSLGTRHGFLYSLLGDGIFTLDGAGWKHSRSMLRPQFAREQIAHVKILEPHMQVFFKHIRKNKGKTFDIQELFFRLTVDSSTEFLFGSSVESLRDETIGMSPSVKNLAGRDEFADAFNYSQTINAYRFLLQQFYWLCNGTKFRKSIAAVHKFSDFYVQKALSLSQDELDEQKGYVFLYELAKQTRDPKVLRDQLLNILVAGRDTTAGLLSFVFFELARNPEVYAKLKEEIYNKFGSGEDARIDEITFESLKQCEYLKAVINESLRLYPSVPHNFRTATRNTTLPRGGGPDGMSPIVVKKGQSVMYTVLVTHRDTKTYGADANEFRPERWFEPETRKLGWAYVPFNGGPRICLGQQFALTEASYVTVRLLQEFEHLTMDAETRYPPKLMNSLTLSLLDGANVEMY

SEQ ID NO: 48732 - protein, 485 aa, Solanum lycopersicum
MGFEIAKTNSILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMPSDEKFVDNFLRESAMRLGKRHKHFTNGLEVVGIKCLKNNAGLFCWMDLRPLLRESTFDSEMSLWRVIINDVKLNVSLGSSFECQEPGWFRVCFANMDDGTVDIALARIRRFVGVEKSGDKSSSMEKKQQWKKNNLRLSFSKRMYDESVLSPLSSPIPPSPLVR

SEQ ID NO: 48733 - protein, 286 aa, Francisella tularensis subsp. holarctica
MIRIENVVKRKVQQGQKLLPNIKNIILIASGKGGVGKSTVTANLAVCFAKMGAKVGILDADIYGPSQPTLFDLKQNPNTTDKKKIIPLEKYAVKMISIGNLIDPETAVIWRGPIVSRALMQLLNDTDWGDIDYLFLDLPPGTGDIQLTISKNMPVTGAVIVTTPQDLSLIDARRALAMFQKVDIKTLGVVENMSYYICPKCGNSEHIFGEDGAHLLCGKNNIEFLGSLPLHKDIRENADNGKPYVSLDKDDSINTSYMTVAENILNQIEKLPKASSLDSIGVKLEN

SEQ ID NO: 48734 - protein, 522 aa, Candida albicans SC5314
MSVSDIVQEYITKWYVVIPTLFVVYQVVDFFYVRSLRSRLGAKAPTNNESDGYWGFHLPFLLVSKKAEGTIIDFAGERFKSIAHPEVPTFQFPIFTVKVISTVDPENIKAVLATQFNDFSLGTRHNQFAPLLGDGIFTLDGAGWKHSRSMLRPQFAREQVAHVKALEPHMQVLFKHIRKSGGRTFDLQELFFRFTVDSATEFLFGESVESLRDESIGMALEAVDFDGKKEFAEAFNFSQNYLASRAVMQQMYWLLNSSEFKSCNSKVHKFAEYYVNKALELSHEELEKQQGYVFLYELAKQTRDTKVLRDQLLNILVAGRDTTAGLLSFVFFELARNPRVFAKLREEVEEKFGVGEDARVEEISFESLKSCEYLKAVLNECLRLYPSVPQNFRVATKNTTLPRGGGSDGMSPILVRKGQTVMYSVYVTHRDTKVYGKDADEFRPERWFEPETRKLGWSFVPFNGGPRICLGQQFALTEASYVTVRLLQEFGHLTMDPNTDYPPKKMSHLTMSLYDGTNVEMY

SEQ ID NO: 48735 - protein, 331 aa, Cryptococcus neoformans var. neoformans JEC21
MAAVNYTIEDPNTVPWIKTPLVRSAALSKLAGCEILLKLENIQPSGSFKSRGIGNLVLQSVNSAPPDTPLHFYSSSGGNAGLACVNAASTLGYPSSVIVPLSTKPFMIDKLRTAGATEVIQTGQTWFEADKHLQEEILARDPNGIYLPPFDHSDIWQGAATMVDEIVQELTHVPDAIVCSVGGGGLMIGVCKGLERLDKEKKAKVVAVETLGAESLHKSVKAGQLITLPGIASLATSLGATTVAAKALEYALQPQVRSTVVSDKEALEACIRFLDDERILVEPACGATLAMVYSGKLKDVLKLDAKSKVVLVVCGGSNISLELIEGYKKMF

SEQ ID NO: 48736 - protein, 502 aa, Solanum tuberosum
MQFLSLASIFLFLSFLFLLRKWKNSNSQSKKLPPGPWKLPLLGSMLHMAGGLPHHVLRDLAKKYGPLMHLQLGEVSAVVVTSPDMAKEVLKTHDIAFASRPKLLAPEIVCYNRSDIAFCPYGDYWRQMRKICVLELLSAKNVRSYGSIRRDEVDRLVNFIRSSSGEPVNFTERLFLFTSSMTCRSAFGKVFKEQDKFIQLIKEVIGLAGGFDVADIFPSLKFLHVLSGMKGKIMNAHHKVDAIVEDVINEHKKKFAIGKTNGALGGEDLIDVLIRLMNDGGLQFPITNDNIKAIIFDMFAAGTETSSSTLVWAMVQMMKNPSVIAKAQAEVREAFKDKETFDENDVEELKYLKLVIKETLRLHPPVPLLVPRECREETDINGYTIPVKTKVMVNVWALGRDPKYWDDAESFKPERFEQRSVDFVGNNFEYLPFGGGRRICPGISFGLANVYLPLAHLLYHFDWKLPIGMEPKDLNLTELVGVTAARKDDLILVATPYEPPRQ

SEQ ID NO: 48737 - protein, 662 aa, Yarrowia lipolytica CLIB122
MPTTTMNIEELKHKNKDTLDKLDKHAKYVFDFKDRQAEKFFGAMSPKTRSIMTFFFSPEYDYNSATETFDPNDEVEDLQLTHSEIVRKVWSRNQLIMAWCFLIFMSLASTIMSSSFSSYIVYASSEFSQMGALASVQIVQSCIFLIARALCGKLADNFGRFEAMTISVVCLAVGSGLYMGIHNIVTYFAALAFYSVGDIGIQMMYEIFAADTVTLRDRTFFQTITLIANLFTPWVSGPMVAAVLKNSTWQWGMGMWCIIVPGCSLPFLFTLLYFRIKAYRMGLRIRRGDPNRTWFKNTVTGIIRMDLPGLVFLCAGLILFFVPISFCTGTDNWKLGENIAMLTVGTFLLYVVFPLWEFFFTKHPFLKYKLMYNRFVTVPGCIIGLYNMAFAIYHPYFQTWLLLAKGLPQARATNIHMAMFVALTGTTLVFSPLMRWRAKLKSVLTWGTILYFIGMGLTYEFRRPEKPLSTMILAQVFEGVGAGLLVIPVMVYIQVVCKQSDSAAAITIYYFFTSSGTILGNVISAAVYRNHFPKILRETGLFSEKEIQTIFSSIYAGLGYKIGTPQRAAIGASLNTVMRSLLVGPFVLCAIMFCLALTNADINLNVAQRIKRASEQRKMDENEGSTEENGDAGLVVTNSFEEKSAGSSDDKKQVNEKVVQAV

SEQ ID NO: 48738 - protein, 331 aa, Bacillus licheniformis ATCC 14580
MSVLVVGGAGYIGSHAVYTLIEKKERVVVVDSLATGHAEAVHSEAAFYKGDIRDRHFLKQVFENEDIEAVMHFAASPISSKSKNVFTSFNENITGMETLLDVMKEYDVGRIVFASSAAVYGSPEDLPVTEETEPEPVHAHGKVKWMMEKMLMEAEKAYGLKYVILRSFNACGAHPSAIIGEDRGSETHLISNVLRTALGHLPFVHIDQSEDGTGVRDYVHVQDLAEAHVLAINHLRKGKDSRIYNLSYGESYSAEQIILAAQYVTGIPLIAAKLTETDIDSQATFAASSSRARKELGWTPQHNSLIAIIRDAWNWHSANPNGYASEKVKQG

SEQ ID NO: 48739 - protein, 503 aa, Thermus thermophilus HB8
MVLVLDFGSQYTRLIARRLRELRAFSLILPGDAPLEEVLKHRPQALILSGGPRSVFDPDAPRPDPRLFSSGLPLLGICYGMQLLAQELGGRVERAGRAEYGKALLTRHEGPLFRGLEGEVQVWMSHQDAVTAPPPGWRVVAETEENPVAAIASPDGRAYGVQFHPEVAHTPKGMQILENFLELAGVKRDWTPEHVLEELLREVRERAGKDRVLLAVSGGVDSSTLALLLAKAGVDHLAVFVDHGLLRLGEREEVEGALRALGVNLLVVDAKERFLKALKGVEDPEEKRKIIGREFVAAFSQVARERGPFRFLAQGTLYPDVIESAGGHGAAKIKSHHNVGGLPEDLEFELLEPFRLLFKDEVRELALLLGLPDTLRLRHPFPGPGLAVRVLGEVTEERLEILRRADDIFTSLLREWGLYEKVAQALAVLTPVRSVGVAGDERKYGYVLALRAVTTEDFMTADWARLPLEFLDEAARRITRRVPEIGRVVYDLTSKPPATIEWE

SEQ ID NO: 48740 - protein, 170 aa, Fusarium oxysporum f. sp. lycopersici
MSESTSTQKVWLASNDSATIEVDRVVAERSMLIKNMLEDIGDEGINAENPIPIPNVNEAVLRKVIEWCDHHRNDPLQAQDDDSDARKKTTDIEEWDQKFMQVDQEMLFEIILASNYLDIKPLLDVGCKTVANMIKGKSPEEIRKTFNITNDFTPEEEEQIRRENEWAEDR

SEQ ID NO: 48741 - protein, 170 aa, Synechococcus sp. CC9311
MDLRSLPPSPSPGLLNLIVEIPAGSCNKYEFSEDVGVMALDRVLHPSIRYPFDYGFVPNTLAEDGSPLDAMVIMAEPTFAGCLIKARPIGVLDMNDTGHYDGKILCVPVADPRQAGIQSIQQIAPSQLEDVAEFFRTYKNMDGRVISIGGWRDSDAVAPLLEACIRAAGG

SEQ ID NO: 48742 - protein, 267 aa, Campylobacter jejuni subsp. jejuni NCTC 11168
MMRVKFNGKELDTDFKTSLEFFENISKNENDVWIINGFATKENIALNENDELFCIEKNTLPPKDALDAMMRARHTPKLHDKLKNGRVAVCGLGGLGSHIAINLARSGVGYLKLIDFDVIEPSNLNRQAYRVSDLGKFKTEALKEQISEINPYISVEICTLKIDEDNLESLFKDIDIVCEAFDSAIAKAMIAQNFHRFYKDGILICASGLAGYGDSNSIQTRKIAKNFYVCGDLVNGAKLGNGLMAPRVNICAGHQSNLVLELLANKE

SEQ ID NO: 48743 - protein, 553 aa, Thermus thermophilus HB8
MLETALRPEDRESPTFKANKDAWVALVRDFRESLERVRQGGGPKAVERQHKKGRLTARERIQKLIDPGTEFYELMAFAGWGMYEEWGGAPAGGVITGIGRIAGRDWMIVANDATVKAGAFFPITAKKVIRAQTIALENRIPTVYLVDSAGVFLPLQDEVFPDQDDFGRIFYLNARMSALGIPQISAIMGNCVAGGAYLPVMTDVLIMTEGSGLYLAGPALVKAAIGQEVTSEELGGARMHYEVSGTVDFYEPTDEAALARIRELAALYPPPRLAPWAEGRKAPKEPLYPIEDLYGLVSPDGSRPYDLREVIARIVDGSEFLEYKGGYGETLVTGFARIGGYPVGIVGNQRLVLKKRGRIEVGGVIYAEAADKAARFILEVNQMGIPLLFLQDVTGFMVGKESEQAGIIRRGAKLVNAVSNSVVPKITLILGGSFGAGNYALAGKAYAPRFLFAWPSAKYAVMGGAQAAKTLLELEVEKLKREGKEPSDEELKELYERIKGRYEETLDPRYAAARLWVDGVIFPHETRKWLIKALEACALNPEREPFRIGVFQV

SEQ ID NO: 48744 - protein, 451 aa, Alnus glutinosa
MTSLQYFSLNRPVFPATHLHRPGIRHLQVSACANVEVQAPSSVKKQGVSKEVMEAAGRVLVGTYARVPVVLSRGKGCKLYDPEGREYLDLSAGIAVNVLGHADSDWLRAVTEQAATLTHVSNVFYSIPQVELAKRLVASSFADRVFFSNSGTEANEAAIKFARKFQRFTRPDEKQPATEFVSFSNSFHGRTMGSLALTSKENYRSPFEPVMPGVTFLEYGNIEAATQLIQRRKIAAVFVEPIQGEGGVYSATKEFLYALRKACDDSGTLLVFDEVQCGLGRTGYLWAHEIYDVFPDIMTLAKPLAGGLPIGAVLVTERVASAITYGDHGTTFAGGPLVCKAALTVLDKILRPGFLASVSKKGHYFKEMLINKLGGNSHVREVRGVGLIVGIELDVSASPLVNACLNSGLLVLTAGKGNVVRIVPPLIITEQELEKAAEILLQCLPALDRHG

SEQ ID NO: 48745 - protein, 289 aa, Allium cepa
MPCSTLPIPTFPPPESESDESWVWNQIKAEAHRDAESEPALASYLYSTIISHPSLARSLSFHLANKLCSSTLLSTSLYDLFLNTLSTFPTVLSASVADLIAARHRDPACVGFSHCLLNFKGFLAVQTQRIAHVLWSQSRRPLALALHSRVADVLSVDIHPAARIGKGILLDHATGVVIGETAVIGNNVSILHHVTLGGTGKAGGDRHPKIGDGVLIGAGATILGNIRIGAGAKVGAGSVVLIDVPPRTTAVGNPARLIGGKEKPSVHEDVPGESMDHTSFISEWSDYII

SEQ ID NO: 48746 - protein, 387 aa, Solanum tuberosum
MTAAPAVIRAETRHVPTRAKAEIRDPLSSTNYHSDDENGSSASSTTTSASAAAAISSAEDISRQAQLCQELSRKIINMGEVRRLASQGIPDGAGIRATVWKLLLGYLPTEKALWPTELVKKRSQYKHFKEELLVNPSEITRKLEKSVILDDEGTVIEDKGALPRSEIPQGEHPLSLGKNSIWNQFFQDTEIIEQIDRDVKRTHPDLHFFSGDTPFAKSNQDSLRNILIIFAKLNPGIRYVQGMNEVLAPLFYVFRNDPNEENAASAEADTFFCFVELLSGFRDHFCQQLDNSVVGIRSTITKLSQFLKEHDEELWRHLEMTTKVNPQFYAFRWITLLLTQEFNFPDSLLIWDTLLSDPEGALEKAVSSLLCYVNYCAEASTCWGFHF

SEQ ID NO: 48747 - protein, 454 aa, Triticum aestivum
DYSTAFLAAAGSSFVFRGPAMHFFITCDPANVRHIFVSNFTNYPKGEEFGAIFDAMGNSFFNADDESWRRQRGRVQHLMSSPQLLAYMARCCRDKLEKGLLPFLARMDSLTPFDMQDLFTRFTFDMTAMSVFGVDPGLLTADMPPVIVPDAMEAVMDVGFFRNMVPVSCWKSMKRLKIGPERKLAAAQLELCRFVTEMMEKRRDGSVHMDEEQENRNVEIVSSYIHDPEYIDDHGKPNGFMYATLINYMFAGRDTVGTTLTWLFYNLIKHPHIVSSIRRELAPIAMHKANNSTTMVTFEPEETEPLIYLHAALFESMRLYPPGPIERKTVMTNDVLPSGHKVQRGETILISLYSMGRMEGVWGKDCREYRPERWVKEDGKLLYVPSYKFLAFNAGPRSCLGKHISVLQMKSVVAAMVWNFDFEMVGGYVVEPKPSVVLKMKNGLWAKILKRQIE

SEQ ID NO: 48748 - protein, 118 aa, Solanum tuberosum
MSWHATIMGPTDSPYAGGVFLVSIHFPPDYPFKPPKVAFRTKVFHPNINSNGSICLDILKEQWSPALTISKVLLSICSLLTDPNPDDPLVPEIAHMYKTDRAKYETTARSWTQKYAMG

SEQ ID NO: 48749 - protein, 468 aa, Sinorhizobium meliloti 1021
MAYDLIVIGSGPGGYVCAIKAAQLGMKVAVVEKRSTYGGTCLNVGCIPSKALLHASEMFHQAQHGLEALGVEVANPKLNLQKMMAHKDATVKSNVDGVSFLFKKNKIDGFQGTGKVLGQGKVSVTNEKGEEQVLEAKNVVIATGSDVAGIPGVEVAFDEKTIVSSTGALALEKVPASMIVVGGGVIGLELGSVWARLGAKVTVVEFLDTILGGMDGEVAKQLQRMLTKQGIDFKLGAKVTGAVKSGDGAKVTFEPVKGGEATTLDAEVVLIATGRKPSTDGLGLAKAGVVLDSRGRVEIDRHFQTSIAGVYAIGDVVRGPMLAHKAEDEGVAVAEIIAGQAGHVNYDVIPGVVYTQPEVASVGKTEEELKAAGVAYKIGKFPFTANGRARAMLQTDGFVKILADKETDRVLGGHIIGFGAGEMIHEIAVLMEFGGSSEDLGRTCHAHPTMSEAVKEAALSTFFKPIHM

SEQ ID NO: 48750 - protein, 418 aa, Mycobacterium leprae TN
MTISLTPLDLSAIRADFPILKRVMRGGNQLAYLDSGATSQRPVQVLDAEREFLVTSNGAVHRGAHQLMEEATDAYERGRVDIAAFIGAAADELVFTKNATESLNLVSYVFGDNRFEGTSGDGGDVIVTTELEHHANLIPWQELARRIGATLRWYGVTDDGQIDLDSLQLDERVKVVAFSHHSNVTGAVAPVRELVARAKEVGALTVLDACQSVPHQPVDLHGLGVDFAAFSGHKMLGPNGIGVLYARRELLSVMPPFLTGGSMIETVTMESTTYAPAPQRFEAGTPMTSQVVGLAAAARYLDAIGMKAVEAHERELVAAAVEGLSRIDGVRIIGPKSMENRGSPVSFVVDGVHAHDIGQVLDDDGVAVRVGHHCALPLHRRFALAATARASFAVYNTVDEVDRLVAGVLRALDFFGRE

SEQ ID NO: 48751 - protein, 417 aa, Sinorhizobium meliloti 1021
MATEIRVPTLGESVSEATVGTWFKKVGDAIKADEPILELETDKVTIEVPAPAAGTLSEIVAQAGETVGLGALLGQIAEGAGAAAAAPAAAEKKPEPAAATAAPAAAAQPAAAAATQTSTSMPPAPAAAKLIAENNLSADQIDGSGKRGQVLKGDVLAAVAKGISAPAAAEPAKVQARAPAPAEDAAREERVKMTRLRQTIARRLKDAQNTAAMLTTYNEVDMSAVMSLRSKYKDIFEKKHGVKLGFMGFFTKAVTHALKELPAVNAEVDGTEIIYKNFCHVGVAVGTDKGLVVPVVRDADQMSIAEIEKEIGRLGKAARDGTLSMADMQGGTFTISNGGVYGSLMSSPILNAPQSGILGMHKIQDRPVAIGGQVVIRPMMYLALSYDHRIVDGKEAVTFLVRVKESLEDPERLVLDL

SEQ ID NO: 48752 - protein, 84 aa, Nostoc sp. PCC 7120
MSQSETFEKVKKIVIEQLSVENPDTVTPEASFANDLQADSLDTVELVMALEEEFDIEIPDEAAEKITTVQEAVDYINNQVAASA

SEQ ID NO: 48753 - protein, 398 aa, Sinorhizobium meliloti 1021
MNIHEYQAKALLKSYGAPVAEGVAIFSADEAEAAAKKLPGPLYVVKSQIHAGGRGKGKFKELGPDAKGGVRLAKSVDEVVANAKDMLGNTLVTKQTGPAGKQVNRLYIEDGADIDRELYLSILVDRSVGQVAFVVSTEGGMDIEAVAEHTPEKIVTVAIDPEKGVTAENLKTLADALKLEGEARADAEKLFPILYKAFVEKDMSLLEVNPLIVMTNGRMRVLDAKVSFDGNALFRHEDVVALRDTTEEDDKEIEASKYDLAYVALDGNIGCMVNGAGLAMATMDIIKLYGAEPANFLDVGGGASKEKVTQAFKIITADPAVKGILVNIFGGIMKCDVIAEGVLAAVKEVGLKVPLVVRLEGTNVELGKKIINESGLNVISADDLDDAAQKIVAAVKGA

SEQ ID NO: 48754 - protein, 532 aa, Streptomyces coelicolor A3(2)
MTVLASALDPADPDHRAHRAAMLAKLADLDAEHAKALAGGGEKYVARHRKRGKLLARERIELLLDPDTPFLELSPLAAWGSEYTVGASLVTGIGVVEGVECLITANDPTVRGGASNPWSLKKALRANDIALANRLPCISLVESGGADLPSQKEIFIPGGAIFRDLTRLSAAGIPTIAVVFGNSTAGGAYIPGMSDHTIMVKERAKVFLGGPPLVKMATGEESDDESLGGAEMHARTSGLADHFAVDEPDALRQARRVVARLNHRKAYADPPPAEPPMYDPEELLGIVPGDLRTPFDPREVIARIVDASDFDEFKPLYGTSLTTGWAALHGYPVGILANARGVLFSEESQKAAQFIQLANQRDIPLLFLHNTTGYMVGREYEQGGIIKHGAMMINAVSNSRVPHLSVLLGASYGAGHYGMCGRAYDPRFLFAWPSAKSAVMGPQQLAGVLSIVARQSAAAKGQPYDDEGDAALRAMVEQQIESESLPMFLSGRLYDDGVIDPRDTRTVLGLCLSAVHTAPYEGARGGFGVFRM

SEQ ID NO: 48755 - protein, 353 aa, Staphylococcus aureus subsp. aureus MW2
MRRWQGLVEEFKAHLPVNENTPKLTLNEGNTPLIHCENMSKILGIDLYVKYEGANPTGSFKDRGMVMAVTKAKEQGKKIVICASTGNTSASAAAYAARAGLKAIVVIPEGKIALGKLSQAVMYGAEIVSIEGNFDEALEIVKEIAKSGEIELVNSVNPFRIEGQKTGSFEIVQQLDGEAPDILAIPVGNAGNITAYWKGFKEYHEAKGSQLPKMFGFQAEGASPIVQNKVIKNPETIATAIRIGNPASWDKATNALKESNGLIDSVTDDEILEAYQLMTTKEGVFSEPASNASIAGLIKLHRQGKLPQGKKVVAILTGNGLKDPDTAISLLDNPIKPLPNDKDSIIDYIKGAL

SEQ ID NO: 48756 - protein, 409 aa, Oryza sativa Indica Group
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAKKVPKLPPPAVAGTSFVIDSKSSEETQKVELLAKAEEPTNLFENEGLLSLQNIERNRDSNCHEAFFEARNVMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRAEEFCFITDNTYTKAEVLKMEGLVLNDLGFHLSVPTTKTFLRRFLRAAQASRNNHTLEHYTSYKSSDIQICVCALRELQHNTSNCPLNAIREKYRQQKFECVANLTSPELGQSLFS

SEQ ID NO: 48757 - protein, 561 aa, Oryza sativa Indica Group
MASAAAPKRCYYEVLGVPRDCSPADIKLAFRRLALSLHPDKQPPGSDVAAATAAFQELQHAHSVLSDPHERSYYDSHRSQILFSDHHPSSGPGRGGGVASASASPVPDLFAFFSSSAFSGFSDSGRGFYKVYGDVFDRVFAQELAYARRMGMPADAVPTPPWDAERGASRRVKRLHGGGQQEGDAQGAAGVQRRRERLAAFCKKRDKRVVDMALKKKAEEEKRKAEEAARKKEEERRRKERAMAYQEPEWARVDEDEAAVFEDEEEEETRAKRKEELYCVACNKKFKSDKQWKNHEQSKKHRDKVSELRMVFEEEEEALKDAEEEEPEEVDVGFDFQPAQESEESEFSDAAEELADELSEGLEVRDEEEKGDKHLGNGEQKVGSYDETSVLEEMLSRSRRKNRKSGFVAPQEEASPAGAMDDDDDEDTSYEINNVKKKGRRRRAAKKGGTYADNGQGRKSENQPEESRHNNDENGADDKMEGPSSNEDSAAASKEDQQKGKTGNTKKNKKGTEKNTTTISSEQKGTSKGKKQKEQVVFSLGRNRSCNAEDTTEKSLKRTRK

SEQ ID NO: 48758 - protein, 501 aa, Amaranthus hypochondriacus
MAIRVPSRQLFIDGEWREPIKKNRIPIINPSTEEIIGDIPAATAEDVELAVAAARRALKRNKGEDWASASGAHRAKYLRAIAAKITEKKDYFAKLEAMDCGKPLDEAARDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCQKTFGSEDEAIELANDTQYGLGAAVLSKDLDRCERITKALEVGAVWVNCSQPCFTQAPWGGTKRSGFGRELGEWGIENYLNIKQVTRDTSTDEPWGWYKSP

SEQ ID NO: 48759 - protein, 334 aa, Synechococcus sp. CC9311
MDSPLNPDREPAWRFSVAPMLDCTDRHFRMLMRQISKQSLLYSEMVVAQALHHSKRRERLLDFDAEEHPIALQVGGDDPALLADATRMAADWGYDEINLNVGCPSPRVQAGNFGACLMAEPQTVARCVEAMVAASSLPVTVKHRVGIDDLDSDDLLRQFVDQVAEAGALRFSVHARKAWLEGLDPKQNRTIPALQHDRVIALKESRPALTIELNGGLDTPEDCLNALKHCDGAMVGRAAYAHPLRWREIDSLIYGAAPRQVLASDVVLGLIPHAERHLQRGGRLWDLCRHLVQVVEAVPGARYWRNNLSTKAQRAGAGIEIIEEAAQQLLDAGL

SEQ ID NO: 48760 - protein, 318 aa, Idiomarina baltica OS145
MTRDLVSGGQQIKAPDDLNRLLKEIHQQAMQIQSGNVADYIPALAAVEPEQCALTLTTLDGEVFNVGDTDTLFSIQSISKIFGLMMAMDRLGDDLWQRVKMEPSGQAFNSIVQLEWEKGIPRNPMINAGAILISDVLVSHYSTSKNAVMSLVRSLCGNDRIYADESVHASEKEHGHRNAASAHLMKSFDNIESDVDEVLDHYFWQCAISMSCENLARSFTFLANAGVCPFSQREIITKRDAQRINALLSTSGMYDQSGEFAFTVGVPAKSGVGGGIVAIVPDFGVISAWSPKLNEFGNSARGMFMVRELANRLGLSVY

SEQ ID NO: 48761 - protein, 460 aa, Glycine max
MATQSLDEETTKKVIRQVEFYFGDSNLLTDGFMRKSITESEDGMISLALICSFNRMRKHLNLGDVKPDEVAQETVNTVAQTLRNSATLKVSEDGKKVGRKTELPKLEEVEQVEIRTLAVSPFEHDLKLEDVEKLFGQYAKVNSVRLPHHVGDKKFFCGTALVEFSSEEDVEKVMKEKLVYAGAELELKPKKDFDAEREKELEDYKKSRPPVGSNQQNNTNVEEDYPKGLIIAFKLKSISDEIPSEQNGVDQQAKDNSVVSKTDENPHSEITSGENDQMVTENVGDDEENSETKEAKETESEENNGMKEGKVTEGEDKKRQAGGKFSAAAYKDNMDVVSREDLKSVFEKFGTVKYIDFKIGAESGYIRFEETEAAQKARAAAVISEKDGLVVKNYIAILDPVTGEAEKEYWNLLRGNQGKHREFKNKQGRGGWHGRGGKHARSRDNGSRDRRNKAQKVDAA

SEQ ID NO: 48762 - protein, 551 aa, Arabidopsis thaliana
MEGVGLRAVGSHCSLSEMDDLDLTRALDKPRLKIERKRSFDERSMSELSTGYSRHDGIHDSPRGRSVLDTPLSSARNSFEPHPMMAEAWEALRRSMVFFRGQPVGTLAAVDNTTDEVLNYDQVFVRDFVPSALAFLMNGEPDIVKHFLLKTLQLQGWEKRVDRFKLGEGVMPASFKVLHDPIRETDNIVADFGESAIGRVAPVDSGFWWIILLRAYTKSTGDLTLSETPECQKGMKLILSLCLAEGFDTFPTLLCADGCSMIDRRMGVYGYPIEIQALFFMALRSALSMLKPDGDGREVIERIVKRLHALSFHMRNYFWLDHQNLNDIYRFKTEEYSHTAVNKFNVMPDSIPEWVFDFMPLRGGYFVGNVGPAHMDFRWFALGNCVSILSSLATPDQSMAIMDLLEHRWAELVGEMPLKICYPCLEGHEWRIVTGCDPKNTRWSYHNGGSWPVLLWQLTAACIKTGRPQIARRAVDLIESRLHRDCWPEYYDGKLGRYVGKQARKYQTWSIAGYLVAKMLLEDPSHIGMISLEEDKLMKPVIKRSASWPQL

SEQ ID NO: 48763 - protein, 403 aa, Synechococcus sp. CC9311
MCLFSEVCSELLFLCCHAEPQSDDADGFDFPSLMIRSRAAVAWAPGEPLDVTEIDVAPPRSGEVLLRVVATGVCHTDAYTLSGSDPEGLFPVVLGHEGGAVVEEIGEGVTSVSVGDHVIPLYTPECGRCRFCLSGKTNLCQAIRSTQGRGLMPDGSSRFSRDLTMIHHYMGTSTFSEYTVLPEIAVAKINADAPLEKVCLLGCGVTTGIGAVHNTAKVEPGSSVAVFGLGGIGLAVIIGAVQARAERIIGIDLNPAKFAIAQQLGATECINPRDHATPIQEVLIELTDGGVDYSFECIGNVDVMRAALESCHKGWGESTIIGVAGAGQEISTRPFQLVTGRVWRGSAFGGVRGRSQLPGYVERYQAGEIPLDSFITHTMELNDINRAFELMHAGESIRTVVHF

SEQ ID NO: 48764 - protein, 272 aa, Erythrobacter sp. SD-21
MTDYPTLNLNDGRQIPQLGFGTWQMEEEDAPQAVSTAIDVGYWLIDTAAIYGNEKGVGKGVGEWSDIFLQTKIWNDSQGYDRTLRAAEKCLERLGREHVDMLLIHWPCPEKDQFVDTWKALIELRDAGKAKSIGVSNFREEDLKRIIDETGVTPALNQIELHPSFQQRDMRKVHEDLGIVTQSWSPLGQGKGMSNEVIEAIAEETGQPETAVILRWHIQHGLCPIPKASSRDHIEANFKALSFELSDEQMGRIDALDDPKGRMGPDPADFNG

SEQ ID NO: 48765 - protein, 469 aa, Corynebacterium efficiens YS-314
MIAMSAAPTGYTNFNGDFIEFGSPEALAEEARTTALDRDHVFHSWSAQDKITPKAWATADGAILYDYEGRAFIDMGSQLVSANLGHNHPALVEAIRTQAGRITNLNPAFANDIRSELAGQIIACAQGEFSHVFFTNGGADAIEHAIRMARLHTGRNKILSAYRSYHGATGSAMMLTGEHRRLGNPTTDGDIYHFWAPFLYRSSFFAENEEQECERALTHLAETIAFEGPGMIAAIVIEPVVGSSGIIVPPAGYLAGVRELCDQHGILLIADEVMVGLGRTGKFFAYEHAGADVEPDMITFAKGINAGYAPLGGVVMTRAIRDTFDAQAYSGGLTYSGHPLAVAPALAALKVYEDEKIFERVASLGENLIGPRLAEIGQKYAAVGDVRGIGFFWALEFVSDAQAKTPAGADAMAAGAAALKEHGVWPMVSGHRFHIAPPLITTETQLEQLLEAIDVAAAAVDAEIFALAR

SEQ ID NO: 48766 - protein, 149 aa, Glycine max
MECYTRPNRSDIHLSAEEEATIEAKTREYFDGVAPQRHTKPQRSDYSAQYVDAFSNAHHSSLTIPELTQFQLLQNDPQEKKLVYNGSQVPEEFVETEYYQDLNSVDKHHHTVFSSILLACILLKIFDVSRKYISALIYILVSLNLIAKY

SEQ ID NO: 48767 - protein, 314 aa, Shigella flexneri 2a str. 2457T
MDIPNMQNAGSLVVLGSINADHILNLQSFPTPGETVTGNHYQVAFGGKGANQAVAAGRSGANIAFIACTGDDSIGESVRQQLATDNIDITPVSVIKGESTGVALIFVNGEGENVIGIHAGANAALSPSLVEAQRERIANASALLMQLESPLESVMAAAKIAHQNKTIVALNPAPARELPDELLALVDIITPNETEAEKLTGIRVENDEDAAKAAQVLHEKGIRTVLITLGSRGVWASVNGEGQRVPGFRVQAVDTIAAGDTFNGALITALLEEKPLPEAIRFAHAAAAIAVTRKGAQPSVPWREEIDAFLDRQR

SEQ ID NO: 48768 - protein, 345 aa, Bacillus halodurans C-125
MKNVAVIGAGSWGTALSLVLADNGHHVTLVARREEIAREINERHTNETYLPSIEIPSSIVATCSMEEIIDVEIIVLVVPTKAIRQAVRSLNDVLKWPVTIVHASKGIEPGSHLRISEMIEEELEPTLLKEVVVLSGPSHAEEVSLRQPTTVTVSSKSLSTTKQIQDLFMNQQFRVYTNEDLIGVEIGGALKNIIALACGLTNGLGYGDNTKAAIMTRGLAEIGRLGVKLGASPLTFAGLSGLGDLIVTCTSIHSRNWRAGQMLGKGKSPAEVEESMGMVVEGIRTTQAAHELAQKLQIEMPITSALYSVLFEGKKPEHAADELMGRVKKHEMENLHDVVSDQKND

SEQ ID NO: 48769 - protein, 481 aa, Rhodobacter sphaeroides 2.4.1
MRRLRNVKIVATLGPASNDYATIRALFEAGADVFRLNMSHGSHDDIRARHQMLRQIEADTGTPVCILADLQGPKLRVGTFANGSEELVERGRFRLDLDPAPGTAERVNLPHPEIFAALEPGSSLLVNDGKIRLEVADCGPDFADCIVTVGGTISNRKGVNVPDVVLPLAALSEKDRRDLEFVCELGVDWLALSFVQRPEDVEEARSLARGRAAILSKIEKPAAVKAYDAILAVSDGIMVARGDLGVELPVQAVPPIQKRLVRGARAAAKPVIVATQMLESMIDSPMPTRAEVSDVATAIYEGADAVMLSAESAAGSYPIEAVMTMNNTAISVESDPVYRDIIEASRAAKRASVADAIVAAAREIAETTPIKAICCFTQTGKTVSLVARERPRVPILALTPLVETARRLSLTWGTHCVVTAPQERFKGAVICAARAALSDGFAQEHEQIAVVAGVPFNVRGTTNILRVAPCDERLIYSGDPE

SEQ ID NO: 48770 - protein, 455 aa, Francisella tularensis subsp. holarctica
MDNNQDKLKRDILSRHIVMISLGGTISASFFLGIGSILNTVGAFGTVIGFFIGGIIMMLVMISLAEMAIEMPISGSFQSYATKFISPYSGFLTGWLYLLNWLTAAAGGLVAAGIICNNFYPAISVWQFCLAIILIVSLLNLCAVRVFAEIEFWLSAIKIITIIIFIIIGIGIIGGFLHSNKPIAGLVNFYVDGLFPNGFKAFLFGLVIIVCTFQGAEVVGIAAGETKEPEKNIRKAIRSVAVRILLFFVFSSFIIAYVIPYKDSGITNTPFVTVLQLVNIKYVDTIMQLVILSASLSAVNSCFYTCARLMWSMAEANQAPKIFAKISKKQIPIYGVVFVALLSCICLITKFIGAEKIFILVISSSGMVGCMIWIIISMCHIYFRKSLTASQIESLRFKAWGFPLIPYTSILFNSCVILAMFWDPEQRMVVYSGVILILLFSFLYKFYYKKIIVKT

SEQ ID NO: 48771 - protein, 353 aa, Oryza sativa
MAAPEIPSQQWAQIFEKTAGPIEYKQIPVQKPGPDEVLVNVKFSGVCHTDLHAWQGDWPLDTKLPLVGGHEGAGVVVARGELVKDVKIGEKVGIKWLNGSCLSCSYCQNADESLCAEALLSGYTVDGSFQQYAIAKAIHVARIPEECDLESISPILCAGITVYKGLKESGVKAGQSIAIVGAGGGLGSIAVQYCKAMGIHAIAIDGGEEKGKLTKELGATAYVDFTTTKNLVADVKATTSDGLGPHAALLVATNEKPFQQATQYIRSRGTVVCIGLPANAQFSAPVFDTVVRMISIKGSYVGNRADTAEAIDFFRRGLIKVPFKTVGLSELNEVYKLMKAGQIVGRYVVDTSR

SEQ ID NO: 48772 - protein, 211 aa, Listeria monocytogenes
RSREPITAKLVANLIETAGATRMITLDMHAPQIQGFFDIPIDHLNAVRLLSDYFSERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEESPIEKLVVTNSIALPEEKWIDKMEQLSVAALLGEAIVRVHENASVSSLFE

SEQ ID NO: 48773 - protein, 378 aa, Mycobacterium leprae TN
MARDYYGLLGVSRNASDADIKRAYRKLARELHPDINPDEAAQAKFKEISMAYEVLSDPEKRRIVDLGGDPMENAAASPSGFGGFGGLGDVFEAFFGGSSASRGPIGRVRPGSDSLLPMWLDLEECATGVTKQVTVDTAVLCDRCQGKGTNGDSAPIPCDTCGGRGEVQTVQRSLLGQMVTARPCPTCRGVGVVIPDPCCQCVGDGRVRARREITVKIPSGVGDGMRVRLAAQGEVGPGGGPAGDLYVEVHEQAHDIFVRDGDDLHCTVSVPMVDAALGTTITVDAILDGMSEIDISPGTQPGSVIELRGQGMPHLRSNTRGNLHVHVEVMVPTRLDQHDTELLRELKRRRSRDVAEVRSTHAAGGGLFSRLRETFTNR

SEQ ID NO: 48774 - protein, 249 aa, Legionella pneumophila subsp. pneumophila str. Philadelphia 1
MRQKIVAGNWKMNGQIQQVTELVSQIEELIGFDCAAQVAVMPPSIYIPKVRDCLRTGKIVVGAQNVYPKDYGAYTGELSAPMLKDFDCRYVLVGHSERRQFFHEDENFVAQKFHHVKDHGMIPVLCVGETLSERENGKTEQVIAQQVLAVSAKGKDCFRDCVVAYEPVWAIGTGKTATPEQAQKIHQFIRDLVGEINDSDAKHLTLIYGGSVNENNAKALFSMPDIDGGLVGGASLNAKQFVEIVKCIN

SEQ ID NO: 48775 - protein, 241 aa, Zea mays
MGRKRAVLVGINYAGTKAELKGCHNDVARMRRCLVDRFGFDDDGAAIRVLSDADRAAPQQQPTGANIRRELARLVADARPGDSLFFHYSGHGTRLPAETGQDDDTGYDECIDPSDMNLITDQDFTELVQKVPDGCLFTIVSDSCHSGGLLDKAKEQIGHSTKQNKAQQGKREERSESGSGGFRSFLKQTVRDAFESQGVHLPRRGGQQGSYDDAESEEPSLDFGTDGHVKNRSLPLSTFIE

SEQ ID NO: 48776 - protein, 529 aa, Cryptococcus neoformans var. neoformans JEC21
MGRPLSGSSSAASGDKKGLELWSSLPKASQETTVAIASAFEDDDAPNKINICTPGYRDETGKLFVPPTVRYAEKQLNSESMVSREALPIEGHAPFLDAGVKFAYGGDSHPYRHKRVAAVQAVSLTGALRLAGTFLSRFPTLPPTKTVFIPSPTTDEDVTALQDAGLEIRSFRFLDLKTGGVDWESLREDLQDAPMKSIVLLHVSGSVPSGAELTTNQWRLLASLLQEREMIPLVIMAFQGLSSGDTNRDAQALRFMVHEGLPVVLVQNFDATMGLYADSPSIVSIVTRNSEDKDRVESQLRAIGRGMWIHPSPWGAHIAHQILTDAKLHPSWLKEMRLMSDRLRSARSKLYMQLVDKLKTPGDWAHIKKANGMYCTALLPSAQTEALTAKHHIHLLPDGCFNLGSLNSSKIDALSRAIDSVVREGIREAEEAQAHRLAMELALAAAKEQAAREETQREEEREAAEMRAAREEDTLLMERSIANAIERQKREEEEERKREEQRKREDEQQRKQREREEIARQAEAILATI

SEQ ID NO: 48777 - protein, 445 aa, Vitis vinifera
MAVKITVDPKTVASIILGGGAGTRLFPLTKSRAKPAVPIGGCYRLIDVPMSNCINSGINKIYILTQFNSQSLNRHIARTYNLGSGVNFGDGFVEVLAATQTSGESGKKWFQGTADAVRQFIWLFEDARHRHIENILILSGDHLYRMDYMEFVQKHIDSDADISVSCLPMDESRASDFGLIKIDEMGQIRQFLEKPKGETLKSMRVDTTALGLSPVEAKKFPYIASMGIYLFKTDVLLKLLRWSYPTANDFGSEVIPMAAEECNVQAYLFNGYWEDIGTIKSFFDANLALTDQPPKFHFYDPLKPIFTSPRFLPPTKIEKCRVMDSIISHGCFLRECSVEHSIVGIRSRLDYGVEMKDTMMMGADYYQTEEEIAAFLAEGKVPIGVGKGTKIMNCIIDKNARIGKNVVITNKDKVEEADRPSEGFYIRSGITVVLKNSVIMDETII

SEQ ID NO: 48778 - protein, 288 aa, Cryptococcus neoformans var. neoformans JEC21
MLRRQTRERREYIFKKSQESQERAIYERKQKIKDLLAQGKPLPTELRNEVRELGGKDLVLDEAQQDPRSHIDDEYAKVGTYDPKIVITTSRSPSSRLLQFSKELRLVFPNSYRLNRGNTVVKDLVSACNAQGVTDLVVVHEHRGVPDALIVSHLPHGPTLSMTLHNVTLRHDVSSNSSTVSEQYPHLIFDGFSTKLGERVTGILKALFPVPKDDAKRVMTFKNENDFISFRHHVFANTGHKDVQLAEVGPRFEAKPFEIRQGTVDQTEADVEWLLRPYLRTAKKRNQF

SEQ ID NO: 48779 - protein, 382 aa, Mycobacterium avium subsp. paratuberculosis K-10
MQISGTLLLQLGALLATLAVLGAAARRFALSPIPVYLLAGLALGKGGLLPLATGGQFITTSAPIGVVLLLLTLGCEFSLAEFSSSMRHHLPSAAVDVVLNAAPGAIAGWLLGLDGVAILCLAGVTYISSSGVVARLLEDLHRLGNRETPAVLSVLVLEDFAMAAYLPLFAVLASGGGWLHAVVGMVVAVSALVAAFAASYRWGHHVQRLVEHPDSEQLMLRVLGITLIVAAMAESLHASAAVGAFLVGLTLTGETATRTRQVLAPLRDLFAAIFFLAIGYSVDPHELIPMLPAALILAAATAATKVATGIFAARHDGVARRGQLRAGTALIARGEFSLIIIGLAGSSLPAVAALATSYVFIMAIAGPVLARYTGPRPAAPAT

SEQ ID NO: 48780 - protein, 350 aa, Treponema denticola ATCC 35405
MIYCEKMMELKNRLEHIEKTLDCFLPEKINSSWISQSFGELAYSLPDSFFLNIINPVRDLVKRGGKRWRPLLCVLSCELAEGDPEKAYPLTPLIEFCHTASLVHDDIEDKSDTRRGAPAAHIKYGLDTALNSASWLYFEALNPLINYEVSESVRAVIYSLYSQNLRRLHLGQSMDIGWHSNSDIIPSVDEYITMISLKTGSLAKLAGELGFIAAGKPINEVLEYGKLMTDMGIGFQILDDVKNITEGNAGKRRGDDIVEGKKSLPLIFYTEENPEGVEKIKLLFKQAAKEGIESPAVEASISAICSSKAVKRAEDYGKKIVEASLIKLQNNYKQNEAKELIFDLFNTILR

SEQ ID NO: 48781 - protein, 479 aa, Synechococcus sp. CC9311
MITPLIPVILCGGTGTRLWPLSRASYPKQYWPLGGSGDETLLQQTQKRLTGIKALGNPLLICNEDHRFIVAEQMRQIDVEPGAILLEPMGRNTAPAVAVAALQATAKGDDPLLLVLAADHVIRDRSHFQAAIAAGRKEAEVGRLVAFGIVPTAPETGYGYIEAAEPLVPGALTPVPIARFVEKPDQATAEQFLASGRFTWNSGMFLFKASAMLAELERLTPEVVSCCRSALEQDTADLDFLRLDRDAFAKCPNVAIDVAVMEQTELGTVLPLDAGWSDVGSWSALWDTADRDENGNVLRGRVISEGSKNCYLRSEHRLVVGLGVENLVVVETDDAVLIADRSQAQNVKTVVKQLEAEGSPEGKAHRKIYRPWGAYTGVVEGTRWQVKRISVKPGASLSLQMHHHRAEHWVVVHGTALVERNGETELIGENQSTYIPIGCKHRLSNPGRIPVEMIEVQSGEYLGEDDIVRFEDRYGRSDL

SEQ ID NO: 48782 - protein, 535 aa, Oryza sativa Japonica Group
MALELSLVSASPPGGLAASPPPPAAIPGKEQQVAGVGILLQISMLVLSFVLGHVLRRHRFYYLPEASASLLIGLVVGGLANISNTETNTRMWFNFHDEFFFLFLLPPIIFQSGFSLSPKPFFANFGAIVTFAILGTFIASVVTGVLVYLGGLTFLMYKLPFVECLMFGALISATDPVTVLSIFQELGTDVNLYALVFGESVLNDAMAISLYRTMSLVRSQAAAGENFFMMVFQFLETFVGSLSSGVGVGFISALLFKYAGLDIDNLQNLECCLFVLFPYFSYMLAEGLGLSGIVSILFTGMVMKHYTFSNLSNNSQRFVSAFFHLLSSLAETFVFIYMGFDIAMEEHSWSHVGFIFFSIIFIIIARAVNVFSCAYLVNMSRPEHRRIPLKHQKALWFSGLRGAMAFALALQSANELPGGHGKTIFTTTTAIVVLTVLLIGGSTGTMLEALDVIGDENRSIENYDDNNGYIPPTYEEGSSSGGGLRMKLKEFHKSTTSFTALDRNYLTPFFTSQTDEDDDVFGEQPQNQRRGFYDQ

SEQ ID NO: 48783 - protein, 457 aa, Silicibacter pomeroyi DSS-3
MLKNDQLDQWDRENFFHPSTHLAQHARGDSANRVIKTASGVFIEDRDGNKLLDAFAGLYCVNVGYGRQEIADAIADQARELAYYHSYVGHGTEASITLAKMILDRAPANMSKVYFGLGGSDANETNVKLIWYYNNILGRPEKKKIISRWRGYHGSGLVTGSLTGLELFHKKFDLPVNQVIHTEAPYYFRRADPDQSEAQFVAHCAAELEALIEREGADTIAAFIGEPVLGTGGIVPPPAGYWEAIQAVLRKHDILLIADEVVTGFGRLGTMFGSDHYGIEADIITIAKGLTSAYAPLSGSIISDKVWKVLEQGTDENGPIGHGWTYSAHPIGAAAGVANLKLIDRLNLVQNAGETGAYLNATMTEALAGHPNVGEVRGAGMLCAVEFVKDKDSRLFFDAADKIGPQISAKLLEQDKVIARAMPQGDILGFAPPFCLSRAEADQVVDATLRAVRTVLG

SEQ ID NO: 48784 - protein, 125 aa, Idiomarina baltica OS145
MALTKEDILNAIAEMPVMELVELIEAAEEKFGVDASAAVAVAAGPAAGGEAAAEEQTEFDVILKGAGSNKVAAIKAVRGATGLGLKEAKAMVESAPVAVKEGISKDDAEELKKQLEEAGAEVEVK

SEQ ID NO: 48785 - protein, 491 aa, Silicibacter pomeroyi DSS-3
MTETALSARADIADKALVRSFSYINGKWCAAANGETFAVTDPADGTELGHAASLSAEESSAAVDAAQAAFPAWAGRLPQERAALLRRWYELLLEHKEDLARIMVLEQGKPLSEARGEIDYGAAFVEFYAEEAKRPNIEGVTSHLPDAEVELWREPVGVAALITPWNFPSAMLTRKAAAALAAGCTVVAHPSRETPFSALALAELAERAGVPPGVFNVVTGTAATVVEPWTRDTRVRALSFTGSTEIGKLLYRQSADTVKRLVMELGGHAPVIVFKDCDLDKAVSETIKAKFATSGQDCLGANRILVERPVYADFCARFTLAAQALTLGPGMADCDLGPLMNEQAVQKQEDHVADALARGARLACGGRRHPRGPLFYEPTVLVDVPPDALIMSQETFGPVAAIAPFDTEEEAVARANDSEYGLVAYVHSNDPRRIYRLSRALQYGMVAVNRTKVTGAPIPFGGTKQSGLGREGARLGMEAFTEVKYICRDWA

SEQ ID NO: 48786 - protein, 393 aa, Magnaporthe grisea 70-15
MLWRRAGGLCLLLCWAWATPAQAAAFSHDITQLSYTDVDSPLQKHLQSQQQQKQEHKQKPITTTTISSILFTSLERLARLVDIAYCVGSLPGISRPFTCASRCADFPHVSLVNTWDTGPLLTDSCGYVAIDHADEAIVVAFRGTYSIANTVIDLSTVPQEYVPYPEPDDDGDRERCDNCTVHLGFLASWKVARNLVLPAIEEARQKHPGFSINLVGHSLGGAVAALAALELKLISGYDVVVTTFGEPRVGNSGLAKFIDRVFGLDQEAKEDMAYRRVTHAEDPVPLLPLEEWGYRSHAGEIHIEKPALPPAPTDIKLCKGERDPDCSNGNSDAALTTLLLGEEHYLKKQHLKLWQLFFAHRDYFWRLGLCVPGGDPADWGRDKYDVAPGQDEL

SEQ ID NO: 48787 - protein, 149 aa, Arabidopsis thaliana
MTKTMMIFAAAMTVMALLLVPTIEAQTECVSKLVPCFNDLNTTTTPVKECCDSIKEAVEKELTCLCTIYTSPGLLAQFNVTTEKALGLSRRCNVTTDLSACTAKGAPSPKASLPPPAPGNTKKDAGAGNKLAGYGVTTVILSLISSIFF

SEQ ID NO: 48788 - protein, 506 aa, Petunia axillaris subsp. axillaris
MMLLTELAAATLITLIAHIIISTLISKTTSRRLPPGPRGWPVIGALPLLGAMPHVSLAKMAKKYGAIMYLKVGTCGMAVASTPDAAKAFLKTLDINFSNRPPNAGATHLAYNAQDMVFAHYGPRWKLLRKLSNLHMLGGKALENWANVRANELGHMLKSMSDMSREGQRVVVAEMLTFAMANMIGQVMLSKRVFVDKGVEVNEFKDMVVELMTIAGYFNIGDFIPCLAWMDLQGIEKRMKRLHKKFDALLTKMFDEHKATTFERKGKQDFLDVVMENGDNSEGERLSTTNIKALLLNLFTAGTDTSSSAIEWALAEMMKKPTILKKAQAEMDQVIGRNRRLLESDIPNLPYLRAICKETFRKHPSTPLNLPRISNEPCIVDGYYIPKNTRLSVNIWAIGRDPQVWENPLEFNPERFLSGRNSKIDPRGNDFELIPFGAGRRICAGTRMGIVMVEYILGTLIHSFDWKLPSEVIELNMEEAFGLALQKAVPLEAMVTPRLQMDVYVP

SEQ ID NO: 48789 - protein, 413 aa, Glycine max
MGSLGAILKNPDDFYPLLKLKMAARNAEKQIPPEPHWAFCYTMLHKVSRSFALVIQQLGTELRNAVCIFYLVLRALDTVEDDTSIETDVKVPILIAFHRHIYDRDWHFSCGTKEYKVLMDQFHHVSTAFLELGKNYQEAIEDITKRMGAGMAKFICKEVETIDDYDEYCHYVAGLVGLGLSKLFHASGSEDLAPDDLSNSMGLFLQKTNIIRDYLEDINEIPKSRMFWPRQIWSKYVNKLEDLKYEENSVKAVQCLNDMVTNALMHAEDCLTYMAALRDPPIFRFCAIPQIMAIGTLALCYNNIEVFRGVVKMRRGLTAKVIDRTTTMADVYGAFFDFASMLESKVDKNDPNATKALSRLEAIQKTCRESGLLSKRKSYIVKDESGYGSTMIIVLVIMVSIIFSYLSASHQNN

SEQ ID NO: 48790 - protein, 178 aa, Campylobacter jejuni subsp. jejuni NCTC 11168
MNLPNILAIFRMVLAPLLFFLLIHKFENIHQSWINYFAALTFSLAALSDFFDGYIARTWKQTTKLGGILDPLADKMLVLAAFLGLLLTGKANEWVIYIILVREFFITGFRVVMISENLNVNASFAGKLKTAFQMTAIGFLIMEWIGGEILLYIALILTLYSGFEYIYTYIKAQKKGEK

SEQ ID NO: 48791 - protein, 412 aa, Brassica napus
MSNPAESSDSKSKKDFSTAILERKKSPNRLVVDEAINDDNSVVSLHPDTMEKLQLFRGDTILIKGKKRKDTICIALADESCEEPKIRMNKVVRSNLRVRLGDVISVHQCPDVKYGQRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGA

SEQ ID NO: 48792 - protein, 424 aa, Thermus thermophilus HB8
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRYVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVLRNAFGAVWQVAQEKKIPLRTAAYVVAATRVLEAQALRGLYP

SEQ ID NO: 48793 - protein, 419 aa, Thermus thermophilus HB8
MPLKAYRPPEDPGLWDTYLEWLERALKVAEAHPTTLEYLAHPKRLVTLSLPVVMDDGKVRIFQGYRVVHDIARGPAKGGVRLDPGVTLGQTAGLAAWMTLKAAVYDLPFGGAAGGIAVDPKGLSPQELERLVRRYTAELVGLIGPDSDILGPDLGADQQVMAWIMDTYSMTVGSTVPGVVTGKPHALGGSEGRDDAAGLGALLVLEALAKRRGLDLRGARVVVQGLGQVGAAVALHAERLGMRVVAVATSMGGMYAPEGLDVAEVLSTYEATGFLPRLDLAPEEVFGLEAEVLVLAAREGALDGDRARQVQAQAVVEVANFGLTPEAEAYLLGKGALVVPDLLSGGGGLLASYLEWVQDLNMFFWSPEEVRERFETRVARVVDAVCRRAERGGLDLRMGALALALERLDEATRLRGVYP

SEQ ID NO: 48794 - protein, 313 aa, Erythrobacter sp. SD-21
MDLGAIVSETWAELADERGSGNPARYIPALALVDPNKFGIALATSDGEVFCAGDTDEAFSIQSISKVFALALALEREGPALWDAVGREPSGNAFNSIVQLEREKGIPRNPFINSGAIVTTDRFIGDRSPDEAVGDLLVRLQRMGRDEAIRFDPEVARSESETGSRNRSLAWFLADFGRLLNPVEDVLSVYFRQCALAMSCRQLAESALFLAFDGTDPVTGQQMCSASRARRINALMLLCGHYDNSGQFAFEVGFPGKSGVGGGILASVPGRAAIAVWSPGLNRAGTSLLGAKALAQIARRTSWSVFSGKLPEI

SEQ ID NO: 48795 - protein, 245 aa, Bacillus halodurans C-125
MTETKEERVHQVFEKIYKRYDVMNSVISFQRHKAWRKDTMKRMNVQEGQSALDVCCGTADWAIALGKAVGPTGHVEGLDFSENMLSIGKKKIADERLDHVFLRHGNAMELPYADDTFDFVTIGFGLRNVPDYMQVLREMARVTKPGGKVVCLETSQPTIPVFKQLYFFYFRHVMPLFGKMFAKSYDEYSWLQESTLSFPGRDRLAQMFKEVGLTDVQVKPYSGGAAAMHLGVKESYDEESRNVTC

SEQ ID NO: 48796 - protein, 161 aa, Schizosaccharomyces pombe 972h-
MSKIKLISSDNEEFVVDQLIAERSMLIKNMLEDVGEINVPIPLPNVSSNVLRKVLEWCEHHKNDLYSGTEEESDIRLKKSTDIDEWDRKFMAVDQEMLFEIVLASNYLDIKPLLDTGCKTVANMIRGKSPEDIRKTFNIPNDFTPEEEEQIRKENEWAEDR

SEQ ID NO: 48797 - protein, 269 aa, Brassica napus
  misc_feature (247)..(247): Xaa can be any naturally occurring amino acid
  misc_feature (268)..(268): Xaa can be any naturally occurring amino acid
MGGGSSETKILQELILYAASAAFSCLVLFAGLRHLDPNREASKKALEHKKEISKRLGRPLIHTTPYEDVIACDVINPDHIDVEFGSIGGLETIKEALYELVILPLKRPELFAYGKLLGPQKGVLLYGPPGTGKTMLAKAIAKESGAVFINVRVSNLMSKWFGDAQKLVSAVFSLAYKLQPAIIFIDEVDSFLGQRRSTDHEAMANMKTEFMALWDGFSTDPNARVMVLAATNRPSELDEAILRRLPXAFEIGMPDRKERAEILKVTLXG

SEQ ID NO: 48798 - protein, 300 aa, Schizosaccharomyces pombe 972h-
MSWTTIESDAGVFTDLIENLGVKDVEVDELYSLDVDSLRQFPDIYGIIFLFKWNSKVDKPDGTMDYDSMDNIFFAKQVINNACATQALLSVLLNHSDEIDLGTTLSEFKDFSKTLPPELKGEALGNSEHIRCCHNSFARSDPFISEEVRAATDEDEVYHFIAYTNINNVFYELDGLQAAPINHGSCTKEEFAEKAVSVIQARIANYDPAEIRFNLMVICKDKKASLLTREDLTDEEKAASIAVEDEKRLRWKRENQLRRHNFVGLFVELSKLLVKDRIDKNTWNSTLETAKAKYASQKRP

SEQ ID NO: 48799 - protein, 177 aa, Glycine max
  misc_feature (114)..(114): Xaa can be any naturally occurring amino acid
  misc_feature (142)..(142): Xaa can be any naturally occurring amino acid
ASSMISSPAVTTVNRAGAGMVAPFTGLKSMAGFPTRKTNNDITFIASNGGRVQCMHVWPPVGKKKFETLSYLPDLDDAQSAKEVEYLLRKGWIPCLEFELEHGFVYREHNRSPXYYDGRYWTMWKLSMYGCTDALHVLKELXDAKTAYPNGFMRMIGFNNVRQMLCIRFIAYYRPVF

SEQ ID NO: 48800 - protein, 605 aa, Schizosaccharomyces pombe 972h-
MSSPNNQPLSCSLRQLSISPTAPPGDVGTPGSLLSLSSSSSSNTDSSGSSLGSLSLNSNSSGSDNDSKVSSPSREIPSDPPLPRAVPTVRLGRSTSSRSRNSLNLDMKDPSEKPRRSLPTAAGQNNIGSPPTPPGPFPGGLSTDIQEKLKAFHASRSKSMPEVVNKISSPTTPIVGMGQRGSYPLPNSQLAGRLSNSPVKSPNMPESGLAKSLAAARNPLLNRPTSFNRQTRIRRAPPGKLDLSNSNPTSPVSPSSMASRRGLNIPPTLKQAVSETPFSTFSDILDAKSGTLNFKNKAVLNSEGVNFSSGSSFRINMSEIIKLEELGKGNYGVVYKALHQPTGVTMALKEIRLSLEEATFNQIIMELDILHKAVSPYIVDFYGAFFVEGSVFICMEYMDAGSMDKLYAGGIKDEGVLARTAYAVVQGLKTLKEEHNIIHRDVKPTNVLVNSNGQVKLCDFGVSGNLVASISKTNIGCQSYMAPERIRVGGPTNGVLTYTVQADVWSLGLTILEMALGAYPYPPESYTSIFAQLSAICDGDPPSLPDSFSPEARDFVNKCLNKNPSLRPDYHELANHPWLLKYQNADVDMASWAKGALKEKGEKRS

SEQ ID NO: 48801 - protein, 470 aa, Staphylococcus epidermidis ATCC 12228
MGIGRVTQVMGPVIDVRFEHNEVPEINNALHIEVPKEDGALQLTLEVALQLGDDVVRTIAMDSTDGVQRGMEVKDTGRDISVPVGDVTLGRVFNVLGETIDLDEKIDDSVRRDPIHRQAPGFDELSTKVEILETGIKVVDLLAPYIKGGKIGLFGGAGVGKTVLIQELINNIAQEHGGISVFAGVGERTREGNDLYYEMSDSGVIKKTAMVFGQMNEPPGARMRVALSGLTMAEYFRDEEGQDVLLFIDNIFRFTQAGSEVSALLGRMPSAVGYQPTLATEMGQLQERISSTNKGSVTSIQAVFVPADDYTDPAPATTFAHLDSTTNLERKLTEMGIYPAVDPLASTSRALEPSVVGQEHYDVAREVQSTLQKYRELQDIIAILGMDELSDEDKQTVERARRIQFFLSQNFHVAEQFTGQKGSYVPVKTTVADFRDILDGKYDHIPEDAFRLVGSMEDVIEKAKDMGVEV

SEQ ID NO: 48802 - protein, 147 aa, Bacillus halodurans C-125
MERTYLMIKPDGVQRNLIGEIVSRFEKKGFTLIGAKLMTVTKEQAETHYAEHKERPFFGELVDFITSGPVFAMVWEGENVIATARKMMGATNPADAEPGTIRGDFGVQVAMNVIHGSDSPESAKREIDIFFDSSELNEYDKVVNRWV

SEQ ID NO: 48803 - protein, 330 aa, Agrobacterium tumefaciens str. C58
MTKFDVLTVGNAIVDIISRCDDRFLNDNAITKGAMNLIDAERAELLYSLMGPALEASGGSAGNTAAGVANFGGKAAYFGKVAEDQLGEIFQHDIRAQGVYFETKPEGTFPPTARSMIFVTEDGERSMNTYLGACVDLGPEDVEDDVVAKTKVTYFEGYLWDPPRAKDAIRECARIAHENGREVSMTLSDSFCVGRYRDEFLDLMRSGTVDIVFANKQEALSLYETEDFELALTKIAADCKIAAVTMSEEGAVILRGTERVKVEAYPVHDVVDTTGAGDLFAAGFLFGYTQDRSLEDCGKLGCLAAAAVIQQVGPRPMSSLKALGEKHGLI

SEQ ID NO: 48804 - protein, 574 aa, Pediococcus pentosaceus ATCC 25745
MAGTLKGIAASDGIAIAKAYLMVDPDLSFEKKNITDVDAEIKRLHDALEKSKEELSLIKAKAAENLGAEEAEVFEAHLTILSDPELIGNIEDKIKNDTINAEEATKEVTDNFISMFEAMTDNAYMQERAADIRDVTKRLMSHLLGVELPNPALIDSEVVIVAHDLTPSDTAQLDRRYVKGFITDIGGRTSHSAIMSRTLEIPAVVGSEKATTSIKQGEMMIVDGLTGDAIIAPTDDEIKAYQQKGEEFKAQKAEWEKLKNEKTVSKDGVHFDLAANIGTPDDLQGVLDNGGEAVGLFRSEFLYMNASELPSEDEQFEAYKKVVEGMNGKQVVVRTMDIGGDKELPYLPLPEEMNPFLGYRAIRISLDRTDLFRTQLRALLRASAFGKLAIMFPMIATVAEFKKARAIYDDERQKMVDAGQEVGEIQVGMMMEIPAAAMIADKLARYVDFFSIGTNDLIQYSFAADRGNEKVSYLYQPYNPSLLRLIKQTIDASHAEGKWTGMCGEMAGDQIAVPILMGLGLDEFSMSATSILKTRSLMKKLTTDDMKKLAEKAVTEAETNEDVIKLVQETVDNI

SEQ ID NO: 48805 - protein, 182 aa, Solanum tuberosum
MAPHDPILKDERIAGIASAIRVIPDFPKPGIMFQDITTLLLDPKAFKDTIDLFVERYKDKNISVVAGIEARGFIFGPPIALAIGAKFVPMRKPKKLPGEVISEEYSLEYGTDKMEMHVGAVQAGECALVVDDLIATGGTLSAAIRLLERVGVEVFECACVIELPELKGRERLGDKPLFVLVS

SEQ ID NO: 48806 - protein, 278 aa, Brassica napus
  misc_feature (257)..(257): Xaa can be any naturally occurring amino acid
MGFEMKPEKDVLSKDQCKVKSPNPNSVNSPHIKKKKKKKKRGMRRKRSDSPAYEITPVRRLFDTCKEVFSNGGPGVIPSEDKIQQLRDILDNMKPEDVGLAPTMPYFRPDYGPEDGSSPPITYLHLHQCEQFSIGIFCLPPSGVIPLHNHPGMTVFSKLLFGTMHIKSYDWVADAPMRDPKTRLAKLKMDSALTAPCNASILYPEDGGNMHRFTAITACAVLDVLGPPYCNPEGRHCTYFLEFPLDNFSSEGGDVLXGELRKEGHAWLQERGDNPGST

SEQ ID NO: 48807 - protein, 175 aa, Solanum tuberosum
MNRCGYQQKAIMGCVGVGEIRRADISVSDGLVCPKPRRNGLFNEPIRPSRFLQINNQQMNDYDLKAGTELLDIILTKGSYDVEMTNFEMDSSPPFFFGSPPSRVSNPLIQDAQFGNDNFVPILAIPEGAPSPPPSFTPTCGRNNGGGCVPVKFGIKPAAVRIEGFNCCSSISAVA

SEQ ID NO: 48808 - protein, 336 aa, Solanum lycopersicum
MSHHYQEQEQLEAQKIPFLLDSLYCEENNILTEVSIETESFSSHDLLWEEEELTSLFSKETEYEISYNVLEKNQSFISSRRESVEWILKTTAYYSFSAQTGFLAVNYFDRFLLFSFNQSLNHKPWMNQLVAVTCLSLAAKVEETDVPLLLDLQVEESGFLFESKTIQRMEMLILSTLKWKMNPVTPFSFLDFITRRLGLKHCLSLEFLRRCEKVLLYTITDDRFIGYLPSAMASATMLHVLDRLKPCIGEKYQDQLLGILGIVKEKVEGCYRLIQEVACNIDFGSNKRKFGTLPGSPTGVMDMSFSSDYSNDSWSVATSVTSSPEPLSKKIRESNE

SEQ ID NO: 48809 - protein, 138 aa, Zea mays
MAEKEGAKVGAEEMEEREQEGEAEEVEVKFRLFDGSDIGPVRCNAATTTVAALKDRVVADWPKDKQIIPKTASDVKLISGGKILENDKNVAQCRAPFGDLPSSAITMHVVVQPSSAKSKPDKKANKLPKTTRCSCTIL

SEQ ID NO: 48810 - protein, 153 aa, Solanum lycopersicum
GLSKKPKEHIVDIDAADVNNELAVLEYVEDIYNFYKLAETETRVHDYIDSQPEINEKMRAILIDWLIEVHHKFELNPETLYLTINIVDRYLTVETSSRRELQLLGISAMLIASKYEEIWAPEVNDFVCIADKTYSHDQVLAMEKQILGKLEWY

SEQ ID NO: 48811 - protein, 482 aa, Xanthomonas oryzae pv. oryzae KACC10331
MGIGKSTGCCSDESRIPNPGLKCAMNEFSALPLSPALAPGIDALGYTVLTPVQAQSLPPILRGLDVIAQAPTGSGKTAAFGLGLLQKLDPALTRAQALVLCPTRELADQVGKQLRKLATGIPNMKLVVLTGGMPLGPQLASLEAHDPHVVVGTPGRIQELARKRALHLGGVRTLVLDEADRMLDMGFEEPIREIASRCDKHRQSLLFSATFPDIIRTLAREILKDPIEITVEGADNAPEIDQQFFEVDPTYRQKAVAGLLLRFTPESSVVFCNTRKEVDEVAGSLQEFGFSALALHGDMEQRDRDEVLVRFVNRSCNVLVASDVAARGLDVEDLSAVVNYELPTDTETYRHRIGRTARAGKHGLALSLVAPRETARAQALEAEQGQPLKWSRAPLATARPAQLPQAAMTTLRIDGGKTDKLRAGDILGALTGEAGLSGAAIGKIAIYPTRSYVAIARAQVAKALAHLHAGKIKGRRFRVSKL

SEQ ID NO: 48812 - protein, 650 aa, Glycine max
MAWSHKGKFFIFSLLFFFSSLHISSSPLDPESCSIQSKLDHDSCQEHDSGKPQIANHLNQQVLLDRLEELVRNLSDLVTRLESKLPDPPKEKGRFTQKKIGDDDEDARSSSKGVEDGEFEGKIRDGERARGTSVTKYTPFWSERFQFASALKLDSEATCINVLPFRDHEGLSKYVAVSDERGRVYVFTRNGDVLVEFDTSLESPITAMVSYTSVYKNESFVVTGHQNGEILMHRIWEGGSSGEDYSSVFMENVGKFLSPENWEDGLPVTLLEVHYVGRMKYILSADTSGKIRVFKENGSLHGSATPSSRPLVFLKQRLMFLTETGAGSLDLRGMKIRESECEGLNHSVARTYVFDATERSKAYGFTSDGDLIYVLLLGDVMNFKCRVRYKKKFDVDEPLALQAIKGYLLIVNPEKVFVYNVSSPHYVRVGVPRPVFSSGLDELRSSFLNNPTPSLDAETRVTPLIASDREKLVIVGLGGGYVGMYHSNLPIFKGEFNTMLWTSPVLFFILFLFGAWHFFAKKKEALTSWGPDDPFSSTSATTSAPLASGSGDRSFADSSSRSSEVMDLRGGNLRAPPRRYGSPSRYPGGAATSYRLGGASADHNARPASVDPDFRAASELKFRASTMDPPGFPKRRDGMFVGNQVVNDHS

SEQ ID NO: 48813 - protein, 416 aa, Ralstonia metallidurans CH34
MYQHIKVPAGEKIKVNADLSLNVPDNPIIPYIEGDGTGVDITPVMLKVVDAAVAKAYGGKRKISWMEIYAGEKSTKVYGPDVWLPEETMEVVKEYVVSIKGPLTTPVGGGIRSLNVALRQQLDLYVCLRPVRYFKGVPSPVREPEKTDMVIFRENSEDIYAGIEWEAESEGAKKLIAFLQNEMGVKKIRFPETSGIGIKPVSKEGTQRLVRKALQYAIDNDKPSVTLVHKGNIMKFTEGGFRDWGYELAQQEFGAELVDGGPWCKFKNPKTGRDIVVKDAIADAFLQQILLRPAEYSVIATLNLNGDYISDALAAQVGGIGIAPGANMSDSVAMFEATHGTAPKYAGKDYVNPGSEILSAEMMLRHMGWTEAADLIIRSMEKSIQSKKVTYDFARLLEGATQVSCSGFGQVMIDNM

SEQ ID NO: 48814 - protein, 316 aa, Tulipa gesneriana
MASFPVINLEQLEGGERSTVMEALHDACANWGFFELLNHGISHELLDKVERLTKDHYKKCMEERFREFASKTLRDGSMVDVDNLDWESTFYLRHLPTSNMSEIPDLSDEYRETMKEFALRLEELAEQLLDLLCENLGLEKGYLKKAFSGSKGPTFGTKVSNYPPCPKPKLIKGLRAHTDAGGLILLFQDDKVSGLQLLKDGEWVDVPPMHHSIVINLGDQIEVITNGKYKSVMHRVLAQPDGTRMSIASFYNPGSDAVIYPAATLLEEAEKQSEVYPKFVFEDYMKLYAVQKFQAKEPRFETMKTMKIADAQSIAT

SEQ ID NO: 48815 - protein, 5435 aa, Streptomyces noursei ATCC 11455
MNAPENPETPENNVVAALRAAVKETDRLRRQNRMLVAAAKEPIAVVGMACRFPGAVDSPEALWEMVATGTDVISGFPDDRGWDLEALRNSGTDARDTDVSQRGGFLDCIADFDPGFFGISPREAVTMDPQQRLLLTTAWEAVERAGIDATTLRATRTGAFIGTNGQDYAYLLVRSLDDATGDVGTGIAASAASGRLSYTLGLEGPALTVDTACSSSLVALHLAVQALRNGECGMALAGGVNVMATPGSLVEFSRQGGLARDGRCKAFADAADGTGWSEGAGVLLLERLSDAQRNGHPVLAVVRGSAVNQDGASNGFTAPNGPSQQRVIRQALANAGLATGDIDAVEAHGTGTPLGDPIEAQSILATYGQDRAHPVLLGSIKSNMGHTQAASGVAGVIKMIMAMRHGVLPRTLHVDRPSTHVDWTTGSVELLTDAHPWPETGRPRRTGISSFGVSGTNAHVIVEQAPDTPAEAADDTPPRTPRTLPWLLSARTGAALRDQATALLDHLDRPDGDRGPTALDTAFSLATTRAALEHRLAVVTGTDGTAGRDALTAWLAHGTAPDAHEGHAAGRTRCAALFSGQGAQRLGMGRELHARFPVFARALDTAVDLLDAELGGTLREVIWGTDDAPLNETGFTQPALFAVEVALYRLIESWGVAPDFVAGHSIGEIAAAHVAGVFSLEDACTLVAARAGLMQALPRGGAMVAVEATEDEVSPLLTDGVAIAAINGPTSLVVSGDETATLAVAARLAEQGRRTTRLRVSHAFHSPLMDPMLAEFRAVAEGLSYGEPQIPVVSNLTGAVADGTLLGTADYWVRHVREAVRFADGIRALTDAGVGAFLELGPDGTLAALAQQSAPDAVSVPVLRKDRDEEPAAVAALARLHTAGVPVDWTAFYAGTGAHRTDLPTYAFQYERYWPKATYRPADATGLGLTAADHPLLGAAMSVAGSDELLLTGTLSLATHPWLADHVVGGMVFFPGTGFLELAVRAADQVGCDRVEELMLAAPLILPATGTVQMQIAVGAADDDGGRDLRFFTRPGDDPDAAWAQHATGRITEGERVLALDTTTWPPRDAEPVDIDGLYDRYRANGLDYGPVFRGLRAVWRRDTEIYAEVALPEGTADADAFGLHPALFDAVLHSTLFASADGDDRSLLPFAWNGVSLHAAGADALRVRITSCGPDAVEITAVDPQGRPVVSVESLTLRAAGPDAGTADHRADAGSLFRMDWTPRTVHAPATPATWAVLGTDPIGLTEALTAAGPDTVTGLRDGVDALGELTAGDDRPVPDVVAVPLRGATDHGPAGAHDLTRTVLALLQEWLAEERFARSRLLLVTRGAVADGERGPLDLAAAPVWGLVRSAQSENPGRLLLVDLDDTAESAAQLPLLPALLDADEPQAVVREGTVRVGRLARLDSGRGLVPPPGTPWRLGSRAKGSLDGLALLPHPEARRPLTGHEVRVGIRAAGLNFRDVLNALGMYPGDAGLFGSEAAGVVVEVGPEVTGLAPGDRVMGMLFGGFGPLGIADARLLTPVPADWSWETGASVPLVFLTAYYALKELGGLRAGEKVLVHAGAGGVGMAAIQIARHVGAEVFATASEGKWDVLRSLGVADDHIASSRTLDFEAAFAEVAGDRGLDVVLNALSGEFVDASMRLLGDGGRFLEMGKTDIRAADSVPDGLSYHSFDLGMVDPEHIQRMLLDLVELFDRGALAALPVRSWDVRRAGEAFRFMSLAQHIGKIVLTVPQPLDPDGTVLLTGGTGGLAGLLARHLVTEHGARHLLLAGRRGPDAPGAAALHAELTALGAEVTVAACDVADRTALAALLATVPAEHPLTAVVHTAGVLDDGTLTALNPDRLATVLRPKVDAAWHLHDLTRHLDLAAFVLYSSTAGVMGGPGQANYAAGNTFLDALAAHRHALGLPATSLAWGAWEQGAGMTGALTDHDLRRVSDAGGQPLLTAERGLALYDAATAADEPLIVPLGLTGGALPAGVGVPAVLRGLVRTAGRRARAGTAGVSRAGLAERLAALPEEERTPFLVELVRTEAATVLGHGSTDPVDARREFRQLGFDSLTAIELRNRLGKATGLTLPATLIFDYPTPDRLAVHLHDELLGADAPVTVTAAAQAADPEHDPVVIVGMSCRFPGGVSSPEELWDLVASGTDAITGFPADRAWDRHPQLAGAPGARTGQGGFLRDIADFDAAFFGISPREALAMDPQQRILLEVAWEAAERAGIDPQTLRGSDTGVFMGVSGQDYAGLVMRSRDDIAGHATTGLAVSVVSGRLAYALGLEGPALSVDTACSSSLVSLHLAAQALRAGECTMALAGGVTVMTTAANFTGFSRMGGLAQDGRCKAFSDSADGTGWSEGAAVLVLERLSDARRAGHRVLAVVRGSAVNQDGASNGLTAPNGPAQQRVIRQALANAGLTPVDVDAVEAHGTGTPLGDPIEAQALIAAYGTDRDPEHPLLLGSVKSNIGHTQSAAGAAGLVKMVMAMRHGILPQTLHLTEPSSHVDWSAGTVRLLTERTAWPRTDRPRRAGVSSFGISGTNAHVILEQPPAEPTPAADPGRPAPTVVAWPVSAQTPAALDAQLDRLRTAAALAPLDTAHTLATGRSLFEHRAVLLATVGDPATGAPDLPEVARGAATPHRTAFLFSGQGAQRSGMGRELHAAFPVFAAAFDEVVAVLDAELGSDADGGVSLREVMWGGGSELLDRTRFTQPALFAVEVALFRLVASWGVGPEFVAGHSVGEIAAAHVAGVFSLVDACRLVVARASLMDALPVGGVMVAVEAAEAEVVPLLVDGVAIAAVNGPVSVVVSGVEAAVGQVVDQLVERGRRVRRLAVSHAFHSPLMDPMLDAFRAVAEGLEYHQPRIPVVSNVTGEVAAAEELCAADYWVRHVRATVRFADGVRTLAERGATAFLEIGPDGVLSALARGVLPAEALVTPTLRKDRDEESALLAGLARLHVAGVTVDWSAALTGTGARGTDLPTYAFQRERYWPELAAEPAGGGADAADAEFWAAVERADATALAAHLDIDGDQLGAVLPALSAWRTRRRTTSATNALRHRESWEPLSLAGTPHTGGVLVLVPAAATTDPWVADVVAALGPDARRVDVPADGTDRAALAALLTEAADDTAPTAVVSLLALDETSGDDAVPAGTTATAALVQALADTGAPAPLWALTRGAVAALPDEQPTAPAQAAVWGLGRIAALELPRHWGGLVDLPADLDERTARRLPAALADAGDEDQLALRATGAYGRRITPAPAPDDAPGTGWQPTGTVLITGGTGALGRHTARWLAAHGAEHLLLLSRSGPDAPGAAELTTELTALGARVTLVACDAADREQLTRVLAEVPRDCPLTGVVHTAGVLDDGVLTGLTPDRFATVFRAKVASAVLLDELTRDTDLAVFALFSSVAGAVGNPGQAGYAAANAVLDALAARRRAQGLAGTSIAWGAWAGDGMAARHTRPGAEPVGLLDPDLAVPALARAVTEPQPTLVLADLQQPRLLESLLALRPSPLLSRLPAARTAARAVQEADRRRAGAAADLRDQLAGTAPADRHAVLLRLVRTTAAAVLGHTGADAIRADKPFRDLGFDSLTAVELSSALAAATGLALPPSLVFDHPSPRALADHLRAELTGDRPESAPAAPPAPVPAADDDPIVVVGMACRFPGGVTTPEEFWQLLAEGRDGIDAFPTDRGWDLDVLGRRRPGPQRPPRSAASSYDAAAFDPGFFDISPREALAMDPQQRLLLETAWEAVERTGTDPTRLRGSRTGVFVGTNGQDYAGLVLRAQEDVEGHAGTGLAASVISGRLAYAFGFEGPAVTVDTACSSSLVALHWAVQALRAGECSLALAGGVTVMTTSTSFAGFTRQGGLAPDGHCKAFSDSADGTGWSEGVGVLVVERRSDALRNGHEILAVVRGSAVNQDGASNGLTAPNGPAQQRVIRQALANAGLAPGDVDAVEAHGTGTVLGDPIEAQALLATYGQDRPADRPLWLGSVKSNIGHTQAAAGAAGLMKMVLALQHGTLPRTLHVTEPSTRVDWSAGAVRLLTERTVWPRTDRPRRAGVSSFGISGTNAHVILEQPPAEPTPTAPADRPTRTPAVLPWVVSARSATALDAQLARLRAFAAERPDLPPADVAHSLVTSRATFEHRAVLLAAPDGITAAARAEARERSTAFLFSGQGAQRSGMGRELHAAFPVFAAAFDEVVAVLDAELATGSGGGVSLREVMWGGGSELLDRTRFTQPALFAVEVALFRLVASWGVGPEFVAGHSVGEIAAAYVAGVFSLVDACRLVVARASLMDALPVGGVMVAVEAAEAEVVPLLVDGVAIAAVNGPVSVVVSGVEAAVGQVVDQLVERGRRVRRLAVSHAFHSPLMDPMLDAFRAVAEGLEYHQPRIPVVSNVTGEVAAAEELCAADYWVRHVRATVRFADGVRTLAERGATAFLEIGPDGVLSALAAACLFDTDAEVVPALRKGRPEEHTALTAAAQLHVAGVDIDWTAVLAGTGGRRIALPTYAFQRERYWPSLAAQAPGDAGGLGLEAGRHPLLGAATTVAGSAEILLTGRLSTTAQPWLAVYEADGRTVLPAAVLAELAVRAGDQADCPTVAELTVAAPLVLTGAAAQRLQVRVAAPDDTGRRALSVHARPDDSPDSPWTLHATAVLTHDTPQPPAPDTGWPPERAVPLDALPTATGPARIAAAWQWGDELCAEIELPEPGPAERAFALHPALLDTAVRAGGLLDGDATLDALGWRGLALHAASATALRVRLTPDGTDTWALEATDPQGAPVVSVTGLTLGTPTVDRSGAGAADDGATLLDLEWVPAPQAAPTGGDHLPYAVLGDQLAELDGQLRIAGDGPGRVASLAALLDGGAPLPRLVLAPVLGVPTGEGDLPAAVRGTTTAVLELLQRWTADARTADSHLVIVTRGAVAAGAEDVHDLAAAPVWGLVRSAQSEHPGSFLLLDLDPADPAGASRAAAPATLAALLDAGETQAAVRADTLTVARLTRAADGPEATAGHPVRDWDRDGTVLITGGTGGLGGLLARHLVTGHGIKHLLLAGRRGPDAPGARALRDELAALGAEVTVAACDVADRAALDRLLAQLPPEHPLTAVVHTAGVLDDATVGTLTPERLDTVLRAKADAAWHLHDATRDRDLAGFVLYSSVAGVTGGPGQGNYAAGNTFLDALAAHRAAQGLPGLSLAWGPWGQDAGMTGTLGAADLARLERSGMPPLTPEQGLALFDAAGARGDGFAVAVRLARGAAAPGADEVPAVLRALVRGRRRTAAAAGHAGVLARRLAALDAEQRHQALLDLVRTETAAVLGHSGADAVPAERDFNRLGFDSLMAVELRTRLATATGARLPATLVFDHPTPDAVARHLASTLPGGTAAGPDRSPLAELDRIAAELSPEGADDATRQGVVGRLRHLLAQWDGTRQDGGGTTVDDRIEAASAEEVLAFIDHELGRQADS

SEQ ID NO: 48816 - protein, 154 aa, Ostreococcus tauri
MSGRGKGKTGKKAMSRSAKAGLQFPVGRVARYLKQGKYATRVGAGAPVYLAAVLEYLAAEVLELAGNASRDNKKSRIVPRHIQLAIRNDEELSKLLGTVTIASGGVLPNIHSVLLPKKIKTSIKNTKKNGSQEPRKPKSWCSFNTTTNKRSPFL

SEQ ID NO: 48817 - protein, 627 aa, Yarrowia lipolytica CLIB122
MCQFIMKYSVYELISKYSQFCPKTSENVTISHHLPQLTPIGILLSPPIYAPHLSLGVQYTRQLNVTHLKPRHCAHSRTMPLSLTSVFVAGCCLKLLLFSAYHSTDFEVHRNWMAITYHLPVREWYTNTVSEWTLDYPPFFAYFEWVLSHLCPASVVEDGALDLVAKGSYGMPTIAYQRITVIVSEILLFVACQWYVNSSVEDRQNLNTKGSHAGVTRKLSTIKESKEETEDADSSLSEHPELAATKTKPTAKLRAFAVASSVVLSPGLLIIDHIHFQYNGFMYGIMIASMVAARNGQPLLCGALFAILLCFKHIYLYLAPAYFVYLLRVVVIPGNSFKSLRINFRDTVLLGLIVVGTFTVCFGPFVAFGQLENLKSRLFPFSRGLTHAYWAPNFWALYSFADKVAVTVMKGRGAVSGGTRGIVGDVAFGVLPNVSPSTTFFLTLFYQLLGLGPLLMKPTYARFVGAITYCAYASFLFGWHVHEKAILMIIIPFTFVVLRDKRLLLVFIPLTISGYISLFPLIYTSAEFMVKILYTFAWFCMYFLWFNHRLVSDHRNSITTREFLLDRASFFYQMGFVPVVALSVILDGRPNMEFLGLMIMSVYSAIGVCGSFVAYSWLYMCEPGMWQ

SEQ ID NO: 48818 - protein, 316 aa, Tulipa gesneriana
MASFPVINLEKLEGGERSRVMEVLHDACANWGFFELLHHGISHELLDKVERLTKDHYKKCMEERFREFASKTLQDGSKVDVDNLDWESTFYLRHLPTSNMSEIPDLSDEYRETMKEFALRLEELAEQLLDLLCENLGLEKGYLKKAFSGSKGPTFGTKVSNYPPCPKPELIKGLRAHTDAGGLILLFQDDKVSGLQLLKDGEWVDVPPMHHSIVINLGDQIEVITNGEYKSVLHRVLAQPDGTRMSIASFYNPGSDAVIYPAAALLEEVENQSEVYPKFMFEDYMKLYAVQKFQAKEPRFETMKAMKIANVQPIAT

SEQ ID NO: 48819 - protein, 130 aa, Glycine max
  misc_feature (24)..(24): Xaa can be any naturally occurring amino acid
  misc_feature (70)..(70): Xaa can be any naturally occurring amino acid
GCTSKQVVLTPGRVQLLLNIETTXFRAYGGRNAKRISKMDRGCIVGADLSELNLVIGQTGARDRPCLTDXETPRMRESKRASKATKLINLHTEDDSRKSADTYPRTYATTAGEIASSAPGIKRLETALTL

SEQ ID NO: 48820 - protein, 313 aa, Escherichia coli K12
MEKRKIILDCDPGHDDAIAIMMAAKHPAIDLLGITIVAGNQTLDKTLINGLNVCQKLEINVPVYAGMPQPIMRQQIVADNIHGETGLDGPVFEPLTRQAESTHAVKYIIDTLMASDGDITLVPVGPLSNIAVAMRMQPAILPKIREIVLMGGAYGTGNFTPSAEFNIFADPEAARVVFTSGVPLVMMGLDLTNQTVCTPDVIARMERAGGPAGELFSDIMNFTLKTQFENYGLAGGPVHDATCIGYLINPDGIKTQEMYVEVDVNSGPCYGRTVCDELGVLGKPANTKVGITIDTDWFWGLVEECVRGYIKTH

SEQ ID NO: 48821 - protein, 311 aa, Tulipa gesneriana
MASFPVINLEKLEGGERSKVMEVLHDACANWGFFELLNHGISHELLDKVEKLTKGHYKKCMEERFREFASKTLQDVSKVDVDNLDWESTFYLRHIPTSNMSEIPDLSDEYRETMKEFVLSLEELAEQLLDLLCENLGLEKGYLKKAFSGSKGPTFGTKVSNYPPCPKPELIKGLRAHTDAGGLILLFQDDMVSGLQLLKDGEWVDVPPIHHSIVINLGDQIEVITNGKYKSVLHRVVAQPEGTRMSIASFYNPGSDAVIYPATTLLEEAKKKSEVYPKFVFEDYMKLYAIQKFQAKEPRFETMKNMESAVI

SEQ ID NO: 48822 - protein, 260 aa, Shewanella sp. ANA-3
MNNQVKIKSAEEIALMRRAGQLLAQVFQMLDTYVRPGISTMDINDAVEAFIVNELKSRPASKGQYGYQYVLNSSINEVVCHGVPSPNEVIKSKDIINLDITLEKDGYIADSSKMYVMPQAPAEAKKLADVTYLAMWQGIKQVKPGATLGDIGHAIQQYAQSFGYSIVRDYCGHGIGQEMHEEPQVLHYGKPNQGLKLKAGMVFTIEPMVNQGTEKIKLKKDGWTVVTRDKKLSAQSEHTILVTPTGYEVLTLRHDEQSPR

SEQ ID NO: 48823 - protein, 228 aa, Borrelia burgdorferi B31
MENQKILVAKHAIDHYIKSNMNLGIGTGTTIYYAIKYLSEKIKSGSLKNLKFYTTSSDTKYLLSKEQIPYESNFSKLNKNLDIAIDGADEILLEKKSLIKGMGGAHLMEKVIAYNSETLLIIADETKIVKKLGTKMPIPIEVAQNAVGFIMTRLEEMNLEATLRICKEKKGPTITDNNNYILDVKMHVENPEGTEKYFKLFPGILEIGIFNHKNTRIVYYQDKQIKEA

SEQ ID NO: 48824 - protein, 516 aa, Coccidioides immitis RS
MPPPAGRYGPSGIAGPFPHLQQAHLQQQQQSQQHHSAHPQTASTGIPPSSLGGHPGFGLGTSGSNINPFTLPGANGMTVTGFPATGAAGSGIPDGGGTGLASHAAQMGFLRGAQMQQQQQQQQQQAQQQQSHLVHDGRLVMDGKADKSRIRDVWKHNLAQEMESLRALVEKYPYISMDTEFPGIVARPMGTFTTKADYHYQTLRCNVDLLKMIQLGVTLFSEEGEVPPAYPTNGTLHANGNHLVPAPCTWQFNFHFSLENDMYAQESTSMLAKAGIDFTMHEKNGIDPLEFGALLMTSGLVLLDDVHWISFHSGYDFGYLMKIMLCKPLPDDEEEFHKLLSIFFPSLYDIKFLMKHASRNQSVNGSPLTQGAVQILANLGQKSGLQDIADELGVKRVGIAHQAGSDSLVTGEIFWKMRQLVFNGTIDQAKYSGQIWGLNGQIPAMPYHTGNQPQQTPNLNGAMVYSNTATPSTPNTGHAAPNSNQTPAPQSHVSGNPSLTPGGGGGVFGAFQLGRT

SEQ ID NO: 48825 - protein, 253 aa, Borrelia burgdorferi B31
MLGDFMYKLVLVRHGESEWNKENLFTGWTDVKLSDKGIDEAVEAGLLLKQEGYSFDIAFSSLLSRANDTLNIILRELGQSYISVKKTWRLNERHYGALQGLNKSETAAKYGEDKVLIWRRSYDVPPMSLDESDDRHPIKDPRYKHIPKRELPSTECLKDTVARVIPYWTDEIAKEVLEGKKVIVAAHGNSLRALVKYFDNLSEEDVLKLNIPTGIPLVYELDKDLNPIKHYYLGDESKIKKAMESVASQGKLK

SEQ ID NO: 48826 - protein, 524 aa, Synechococcus sp. RS9916
MVLAILDGWGHRDSETHNAIRHASTPVMDALWHAYPHSLIQASGAHVGLPDAQMGNSEVGHLTIGAGRIIRQELVRISETVRQGELAQTPALAQLAQSLQANGGTLHLMGLCSNGGVHSHVDHLCGLLRWAAEAGIARVAIHAITDGRDTPTQSAPTFLKQVEDAIQTAGVGEIASLCGRYWAMDRDQRWERTSKAYSLFTDPSLGCSNAPVSEVLQNSYDAGVTDEFLEPVRLSDAFLKDGDGLVVFNFRPDRARQLVQALTVDGFAGFERQHKPRLDVVTFTQYEAGLPVTIAFPPESLDQLLGQVVSEHGLKQYRTAETEKYPHVTYFLNGGIEQPLAGEDRHLVPSPRVATYDEAPAMSADVLTDSCIAAIERGEYSLVVINYANPDMVGHTGVMTAATEAIQTVDHCIGRLLDAVGRMGGTLLITADHGNAELMEGPDGQAWTAHTTNPVPVILVEGEKRKLAGMGNSIRLRENGGLADIAPTLLQILGLPKPKAMSGSTLIEAIETLSPLSARLPQPV

SEQ ID NO: 48827 - protein, 118 aa, Glycine max
  misc_feature (89)..(89): Xaa can be any naturally occurring amino acid
QSSRSESEVDLTCSDGTFARAAAPRKTSNAISVVPAMRDGGSDYLGKGVSKAVDNVNTIIAPALDGKDLTEKTPIHNSLLAYAFTPVYXSTLNPVKLGANAILAVSLAVCKAGATVLK

SEQ ID NO: 48828 - protein, 159 aa, Schizosaccharomyces pombe 972h-
MFSGIKGPNPSDLKGPELRILIVHARWNLQAIEPLVKGAVETMIEKHDVKLENIDIESVPGSWELPQGIRASIARNTYDAVIGIGVLIKGSTMHFEYISEAVVHGLMRVGLDSGVPVILGLLTVLNEEQALYRAGLNGGHNHGNDWGSAAVEMGLKALY

SEQ ID NO: 48829 - protein, 456 aa, Haemophilus influenzae R2866
MTKHYDYIAIGGGSGGIASLNRAASYGKKCAIIEAKHLGGTCVNVGCVPKKVMFYGTHIAEAINNYAPDYGFDVEVKKFDFSKLIESRQAYISRIHTSYNNVLAKNNIDVINGFGKFVDAHTVEVTLADGTKEQVTADHILIATGGRPYRPNIKGQEYGIDSDGFFALTELPKRAAVIGAGYIAVELSGVLNSLGVETHLLVRRHAPMRNQDPLIVETLVEVLAQDGIQLHTNSTPSEIVKNADGSLTVRCDGQSDITVDCVIWAAGRVPATDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 48830 - protein, 111 aa, Solanum tuberosum
MESSRGGQNGIQLLLAAEQEAQRIVNVARTAKQARLKQAKEEAEKEIAEFRAYMEAEFQRKLEQTSGDSGANVKRLEIETNEKIEHLKTEASRVSADVVQMLLRHVTTVKN

SEQ ID NO: 48831 - protein, 333 aa, Sinorhizobium meliloti 1021
MSGKSKSAPKIVVVGAGAFGTALSAVAAAKDKANVTLLARREEAAAECRRTGRNDAVLPGIPLPPGLVYSSQAAALEDADIVLFAMPSQAHRDAARSYGPAIGARAIVVTCAKGMEQSTGQLLTDVLEEELPGRRIGVLSGPGFAADIASGLPTAMVIAAPDTAIATELAEALSGRTFRLYPSADRTGVQLGGALKNVLAIACGIVEGAGLGDSARAALISRGLAEMSRFIVARGGEADTVRGLSGLGDLVLTATSHQSRNLRFGIALGKDGRAAAGSSELVEGAFAASVAARVAGALGIEMPVTEAVAAIVDGKLDVRSALEQLMSRPITHE

SEQ ID NO: 48832 - protein, 838 aa, Rhodobacter sphaeroides 2.4.1
MTSLTRQGEIPRELIQLDARASSKEEAIAQAAAALVAAGCVRPGFEASMLRREAVSNTYLGKGIAIPHGTVEDRDLIQKDAIAVLQVRDGVEWNAGERARLVVAIAARSDGHIEILRRLTRLLQDEDRLAVLAATDDRQALSDALNGVAAGAAATAEPAGDFAQSFDWVLDYPTGLHARPATEWAEAARRFPCRIRIRHGAETADARNMISLLSLGLKSGDAITVSAEGQGAAEALATLKVTMTGLSAREKADAARAEEKRRATAAAGGWVPPSSPRAIEGVPAAPGLAIGRITRIATDGMEIPDEPVELARAADLLHAALGQTAEQLHSLADDTARRLGESDAAIFRAQAGLLADPDLITLASQWLVDGHGLAWSWHRAYEDMAARLSALRNPVLAARAADLRDVGQRVLAHIDPRFARSRLADLPEDTILVAEDISPSDAAGLDPAKVAGLVTALGGPTSHTAILARTLGLPAVVGTGAVVERLEDGACAIVDGHGGRLYLDPSEADLASARDWIAAEEARRARAAETRALPATTRDGHRIDIGANINLAEQAAFALGQGAEGVGLMRTEFLFLERSESPTEDEQAEAYAAMARALEGRPLVIRALDIGGDKQVAHLDLPREENPFLGVRGARLLLRRPDLLVPQLRALYRAAAGGAQISVMFPMVTSLGELLELRATCERIRQELDAPVVPLGIMVEVPSAALLAAEFAAHADFFSIGTNDLTQYALAIDRQNPELAPEADSLHPAVLRLIDLTVKGAAVHGRWVGVCGGIAGDPFGAALLAGLGVDELSMTPRDIPAVKERLRQSDRAGLRALAEHALACSDAEAVRALAAEAP

SEQ ID NO: 48833 - protein, 328 aa, Rhodobacter sphaeroides 2.4.1
MSRVHTVTLNPAIDQTVSLPHLAVGEVNRATAVRHDPGGKGINVASVLADWGVSVAAHGLLGRANAAPFEALFAQKSIADRMLRVAGETRTNVKILEEDGRTTDLNLPGFPADEGHLAALAEGLGSVAAGELVVISGSQPAGLPASATARLAARVQERGARVLCDVSGAPLAEVLAAPVLPDAIKPNRHELEGWVGRSLADRADLAAAAAALAARGIALVVVSLGTEGALFVSSDGAVVARPVQLSRGSTVGAGDAMVAGLASALVEGLPLRATAARATAFAAAKLQNPGPHLPGVDQVRALEARVERMAAADWIRAAGRTADQGERT

SEQ ID NO: 48834 - protein, 327 aa, Solanum tuberosum
MAQESLVLRGTMKAHTDWVTAIATPIDNSDMIVTSSRDKSIIVWSLTKDGAQYGVPRRRLTGHGHFVQDVVLSSDGMFALSGSWDGELRLWDLQAGTTARRFVGHTKDVLSVAFSVDNRQIVSASRDKSIKLWNTLGECKYTIQDGDSHSDWVSCVRFSPNTLQPTIVSGSWDRTVKIWNLTNCKLRSTLAGHSGYVNTVAVSPDGSLCASGGKDGVILLWDLAEGKKLYSLDASSIIHTLCFSPNRYWLCAATESSIKIWDLESKTIVVDLRVDLKQESEMAATESGTGPKNKVIYCTSLSWSADGSTLSSGYTDGLIRVWGIGRY

SEQ ID NO: 48835 - protein, 453 aa, Francisella tularensis subsp. holarctica
MSNNHFDVISLGGGSGGIASAVQAAKFGKKVAIIEKRELGGTCVNRGCVPKKAMWYGANLAEILKHDVAGYGFDVEVKGFNWAKLKEKRATYIGNIHGFYDRLLDKWNITHFNNWGKFKDNKTIVLDDGTELTADHIFISPGAYPIVPKNIEGAELGITSDEFFELEETPKKAVIVGGGYIGVEIAGVLNAHGTDTTIMVRRDKPLMEFDNCISDALVECMQMTDLNIMNHTNITKVEKTGSTLKITTDTDKVLEDVDTLIWATGRAPNTHNLGIENTDIRITDKGVIPANEWSETNVAGVYSLGDASGVPQLTPVAIKTGRYLARRLFNGETNLKANLEYIPTVIFSHPAIGTVGLTEKEARDKYGDENVKVYKSRFTALYCAISGHRMPTVMKLVVTGDNEKIVGCHMIGLNVDEMLQGFAVAINMGATKRDFDDTIAIHPTSSEELVTLV

SEQ ID NO: 48836 - protein, 505 aa, Mycobacterium avium subsp. paratuberculosis K-10
MASRWRTKSVEQSIADTDEPDTRLRKDLTWWDLVVFGVAVVIGAGIFTVTASTTGDITGPAIWVSFVIAAGTCALAALCYAEFASTLPVAGSAYTFSYATFGEFLAWIIGWNLLLELAIGAAVVAKGWSSYLGTVFGFSGGTVKFGAAQLDWGALVIVGGVATLIALGTKLSSRFSAVITGIKVSVVVFVVVVGVFYIKRANYSPFIPKPEAGGQAKGIDQSVLSLLTGAHTSHYGWYGVLAGASIVFFAFIGFDIVATMAEETKHPQRDVPRGILASLGIVTLLYVAVAVVLSGMVSYTQLKTMPGRGQANLATAFTANGIHWASKIISIGALAGLTTVVMVLMLGQCRVLFAMARDGLLPRALAKTGSRGTPVRITVLVALVVAVTASVFPITKLEEMVNVGTLFAFVLVSAGVMVLRRTRPDLERGFKAPWVPVLPIASIGACVWLMLNLTALTWVRFGIWLVVGTAIYAGYGYWHSVQGRRDAGEPDRSDALAADPNSPVP

SEQ ID NO: 48837 - protein, 307 aa, Ralstonia metallidurans CH34
MSPTPIKHYLQFSDLSADEYEYLLDRARILKAKFKNYETWHPLHDRTLAMIFEKNSTRTRLSFEAGIHQLGGHAVFLNTRDSQLGRGEPIEDAAQVISRMVDIIMIRTFGQEIIDRFAKHSRVPVINGLTNEYHPCQVLADVFTYIEQRGTIAGKTVAWIGDANNMAYTWIQAAERLDFTFHFSAPPGYQLDPAMVPDWAASRVKVFDNPLDACQGAHLVTTDVWTSMGFEAENDARKRAFKDWMVTTAMMDRAADDALFMHCLPAHRGEEVEAAVIDGPRSVVWEEAENRLHVQKALMEYLLCGRY

SEQ ID NO: 48838 - protein, 417 aa, Ostreococcus tauri
MDAMTEDEPSSKRVREETPGKRVNGDASGTPERGDKAKYESDAKPSTASPTSPVRGAYATRESHLRKQERDGELKWEVITNDGVERHSKHLVALKNIFSKQLPNMPKEYIVRLVFDSRHKSMLCMKNGNVIGGITYRPFPKQRMGEIAFCAISANEQVKGYGTRLMNHIKEYAKETENMTHLITFADNNAVGYFQKQGFTKEIMMEREKWNGYIKEYDGGTIMECQLDGQVSYVDFVNQIREQRKAVEAKVREMSTAHKVYNGLKDHFKPSADGKYTPIDVKHIKGLKEAKWERTGLPKFRLVHPGCGDGLPTKENMHKFMRAIVNIVQAHADVWPFGGPVNPIEVPDYYEVRVASGNYYVSLEMFCADFRLMFNNCRLYNSPDTVYFKCANRLETFFESKIAAGINWKVREPPTKR

SEQ ID NO: 48839 - protein, 369 aa, Escherichia coli K12
MATLIRLFIHPVKSMRGIGLTHALADVSGLAFDRIFMITEPDGTFITARQFPQMVRFTPSPVHDGLHLTAPDGSSAYVRFADFATQDAPTEVWGTHFTARIAPDAINKWLSGFFSREVQLRWVGPQMTRRVKRHNTVPLSFADGYPYLLANEASLRDLQQRCPASVKMEQFRPNLVVSGASAWEEDRWKVIRIGDVVFDVVKPCSRCIFTTVSPEKGQKHPAGEPLKTLQSFRTAQDNGDVDFGQNLIARNSGVIRVGDEVEILATAPAKIYGAAAADDTANITQQPDANVDIDWQGQAFRGNNQQVLLEQLENQGIRIPYSCRAGICGSCRVQLLEGEVTPLKKSAMGDDGTILCCSCVPKTALKLAR

SEQ ID NO: 48840 - protein, 635 aa, Escherichia coli K12
MSLISMHGAWLSFSDAPLLDNAELHIEDNERVCLVGRNGAGKSTLMKILNREQGLDDGRIIYEQDLIVARLQQDPPRNVEGSVYDFVAEGIEEQAEYLKRYHDISRLVMNDPSEKNLNELAKVQEQLDHHNLWQLENRINEVLAQLGLDPNVALSSLSGGWLRKAALGRALVSNPRVLLLDEPTNHLDIETIDWLEGFLKTFNGTIIFISHDRSFIRNMATRIVDLDRGKLVTYPGNYDQYLLEKEEALRVEELQNAEFDRKLAQEEVWIRQGIKARRTRNEGRVRALKAMRRERGERREVMGTAKMQVEEASRSGKIVFEMEDVCYQVNGKQLVKDFSAQVLRGDKIALIGPNGCGKTTLLKLMLGQLQADSGRIHVGTKLEVAYFDQHRAELDPDKTVMDNLAEGKQEVMVNGKPRHVLGYLQDFLFHPKRAMTPVRALSGGERNRLLLARLFLKPSNLLILDEPTNDLDVETLELLEELIDSYQGTVLLVSHDRQFVDNTVTECWIFEGGGKIGRYVGGYHDARGQQEQYVALKQPAVKKTEEAAAAKAETVKRSSSKLSYKLQRELEQLPQLLEDLEAKLEALQTQVADASFFSQPHEQTQKVLADMAAAEQELEQAFERWEYLEALKNGG

SEQ ID NO: 48841 - protein, 387 aa, Geobacillus stearothermophilus
MKKKCIAMLLAGGQGSRLRSLTTNIAKPAVPFGGKYRIIDFTLSNCTNSGIDTVGVLTQYQPLLLHSYIGIGSAWDLDRRNGGVTVLPPYSVSSGVKWYEGTANAVYQNINYIEQYNPDYVLVLSGDHIYKMDYQHMLDYHIAKQADVTISVIEVPWEEASRFGIMNTNEEMEIVEFAEKPAEPKSNLASMGIYIFNWPLLKQYLQIDNANPHSSHDFGKDVIPMLLREKKRPFAYPFEGYWKDVGTVKSLWEANMDLLDENNELDLFDRSWRIYSVNPNQPPQYISPEAEVSDSLVNEGCVVEGTVERSVLFQGVRIGKGAVVKESVIMPGAAVSEGAYVERAIVTPDSIIPPHSSVCPEDADDVVLVTAEWLKQSNEETARKDEA

SEQ ID NO: 48842 - protein, 425 aa, Triticum aestivum
LGPLPARPGAFLGLTATGATGTLPFIAAFGAFTNEVIWLIVISFFFARGFVKTGLGDRVATYFVKWLGGSTLGLSYGLTISEACIAPAMPSTTARAGGVFLPIVKSLSLSAGSKPNDPSAKKLGAYLVQSQLQASGNSSALFLTAAAQNLLCLKLAEEAGVKIASPWISWFKVASLPAIISLLATPYLLYKIFPPEIKDTPEAPALAAQKLKKMGPVTKNEWVMVATMILAVSLWIFGDAIGVSSVVAAMIGLSILLLLGVMNWDDCLNEKSAWDTLAWFAILVGMAGQLTDLGIVSWMSNCVAKVLQSFSLSWPAAFGVLQASYFFIHYLFASQTAHVGALYSAFLAMHLAAGVPAILSALALTYNSNLFGALTHYSSGQSAVYYGAGYVDLPDVFKLGFTAAAINALIWGVVGTFWWKFLGLY

SEQ ID NO: 48843 - protein, 80 aa, Oryza sativa Japonica Group
MVANGDAPARGSAAAAASLRRRRTTSSGTGGGGASTMLQFYTDEAAGRKMSPNSVLIMSIGFIAVVALLHVFGKLYRTSA

SEQ ID NO: 48844 - protein, 300 aa, Rhizobium etli
MITVFGSINMDLIATTDRLPKPGETVAGNSFATAAGGKGANQALAARRAGRYVHMAGAVGKDGFAADALALLDDAGTDLSLVKHVDGPTGTALILVGGDGENMIAVVPGANGLVTAADAETAVGKMSEGDILMLQLEVPVDAVERALSEARVRGVTSILNLAPLTPDAPRLGRLADIVIANETEFERLAGQDGMDAEAREAALHRLHQETGQTLIVTLGGDGVIAIRNGVISRAQGLKIEPVDTVGAGDTFCGYFTASLDEGLRIFASALRRAAVAGSLACLKAGAQPSIPLSQDVADRI

SEQ ID NO: 48845 - protein, 150 aa, Actinobacillus pleuropneumoniae
IDMPPGTGDIQLTLSQQIPVTGAVVVTTPQDIALLDAVKGISMFQKVSVPVLGIIENMSVHICQNCGHHEDIFGTGGAEKVAKKYGTKVLGQMPLHIRLRQDLDAGTPTVVAAPEHDTSRAYIELAAKVASELYWQGSVIPSEIMIREVK

SEQ ID NO: 48846 - protein, 165 aa, Synechococcus sp. CC9311
MLLIAALVLAAGLFLLRNGLNQEAPLDQLARQSLDPEVALNNSRPTILEFYADWCEACQAMAPAMLQTEQKHADQLDVVLVNIDNPRWLDLIDRYDVTGIPQLNLFSADGVMRGRSLGARTADQLESLAVALIDNEPLPQLAGVGSISSVTPAETVSSPGPRSHS

SEQ ID NO: 48847 - protein, 458 aa, Glycine max
  misc_feature (165)..(165): Xaa can be any naturally occurring amino acid
MVKNKVPDWLNSSIWSSSSPSSPPSSAVASPFEQPPRPPSPAVVTPFEPPPPRPPSPPSVHDPPPTQRIDDSPREDHGDGFRSAHDVSRQAQLLAELSKKVVDMSELRSLACQGIPDAAGIRSTVWKLLLGYLPPDRGLWSAELAKKRFQYKQFKEEIFMNPSEXTRKMYNSANCDTDDASCARALLSRSEITHGEHPLSLGKTSVWNQFFQDTEIIDQIDRDVKRTHPDMHFFSGDSQFAKSNQEALKNILIIFAKLNPGVRYVQGMNEILAPLFYVFKNDPDEENAAFAEADAFFCFVELLSGFRDNFVQQLDNSVVGIRATITRLSQLLREHDEELWRHLEVTSKARQFLFIRWVMFSGSECQVNPQFYAFRWITLLLTQEFNFADSLHIWDTLLSDPDGPQETLLRVCCAMLVLVRKRLLAGDFTSNLKLLQNYPTTNISHLLYVANKFRVQSV

SEQ ID NO: 48848 - protein, 273 aa, Bacillus subtilis subsp. subtilis str. 168
MKIGFIGTGNMGTILIESFIESKAADPSNMTITNRTIEKALHIKNRYNSINVTESLEKLVSENEMIFICVKPLDIYPLLARALPYLRKDHILISITSPVQTEQLEQYVPCQVARVIPSITNRALAGVSLVTFGTSCGESAKAKINELMQHISHPLQIESDITRVASDIVSCGPAFMSYLIQRFIDAAVSETSVSKQDAILMCKEMLVGMGKLLETELYTLPALQEKVCVKGGVTGEGIKALESGVQDMFHRVFQNTHMKYEEDISAVKKQFHV

SEQ ID NO: 48849 - protein, 624 aa, Agrobacterium tumefaciens str. C58
MSDTVPPKSSESQVGTGYRVLARKYRPKDFSDLMVGQEPMVRTLTNAFETGRIAQAYMLTGVRGVGKTTTARILARALNYKTDTIDKPTIDLRIPGEHCQAIMEGRHVDVIEMDAASHTGIDDIREIIEQVRYRPVSARYKVYIIDEVHMLSTQAFNGLLKTLEEPPEHVKFIFATTEIRKVPITVLSRCQRFDLRRISAADLVGLFTAIAGKEGFEAEPQALSMIARAAEGSARDGLSLLDQAIAHGGGRVEAEAVRGMLGLADRARIVDLFQHVVKGDVAAALSEFNGQYEAGANPVVVLNDLADFTHLVTRMKYVPDAAEDPSLSEIERTRGAEFAETIAVTALSRIWQMLLKGIPETENASRPAGAAEMVLIRLSHAANLPAPEDAARRLLELSSADGSYTNGGPSGGGNGGGARAYSSAQTVAAARPAEFAAPRQAGPQPSTMLRAVPDSRPQEMQVAAPKTEERPEPKVPVNSLQDIADLCQKNRDPVMRAKVRNFVRLVRLEPGRLDMRLGEGAPGSLPGELGVKLKEWTGIHWIVSLSKEQGEPTLVEAEGNARDARLVDARQDPDVAAILAQFPGAKITDVRIRAAIQDEAEDITPPSVAESSEGDILPGDDIEF

SEQ ID NO: 48850 - protein, 515 aa, Crocosphaera watsonii WH 8501
MIVILDFGSQYSELIARRIRETQVYSEVLSYRTTVEKLRQLNPKGIILSGGPNSVYDDRAPQCDPEIWQLGIPVLGVCYGMQLMVKQLGGQVEKATRGEYGKASLCIDDPTDLLTNVEDGSTMWMSHGDSCTRLPEGFSILAHTENTVCAAIANHEKKLFGVQFHPEVVHSVDGIALIRNFVYHICECEPTWTTEAFVDETIREIRAKVGDKRVLLALSGGVDSSTLAFLLHQAIGDKLTCMFIDQGFMRKGEPERLMDIFDRQFHIPVEYVHARDRFLNKLEGITDPEKKRRLIGHEFIQVFEEESKRLGPFDYLAQGTLYPDVIESADTNVDPKTGERVAVKIKSHHNVGGLPKDLRFKLVEPLRKLFKDEVRKVGRSIGLPEEIVRRHPFPGPGLAIRIIGEVTSERLNILRDADFVVRDEIAKQGMYHDFWQAFAVLLPVRSVGVMGDQRTYAHPIVLRLITSEDGMTADWAKVPYDLLEIISNRIVNEVKGVNRVVYDITSKPPGTIEWE

SEQ ID NO: 48851 - protein, 345 aa, Vitis vinifera
MDKRLRLLFILFIIRLPTLVLGECACDEEDEDRDRDKALRYKIAAIASILVGGTIGVCIPIIGKKIPALQPEKNVFFVIKAFAAGVILATGFIHVLPDAFESLTSPCLSENPWANFPFTGFVAMLSAIGTLMVDSLSTSYYTRSHLKNSLPVLGDEEKVGEHEGQVYVHTHATHGHTSADEVGSDLIRHRVISQVLELGIVAHSVIIGISLGASESPQTIRPLVAALTFHQFFEGMGLGSCIVQAKFKSRAATIMGLFFSLTTPVGIGIGIGISQVYDENSSTALIIEGIFNAASAGILIYMALVDLLAADFMSPKMQTNEMLKVMANISLLLGAGCMSLIAKWA

SEQ ID NO: 48852 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNACCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 48853 - protein, 475 aa, Staphylococcus epidermidis ATCC 12228
MRNFTKQYINGEWVDSASGETIDVINPATEEVMGKIAKGNEEDVNKAVDAADKVYLEFRHSSVEERRELLDKIVKEYQNRKNDLIEAITDELGAPLSVSENVHYQMGLNHFTAARDALDSFQFEEQRGDDLVVKEAIGVAGLVTPWNFPTNQTSLKLAAAFAAGSPVVLKPSEETPFAAIILAEIFDKVGVPKGVFNLVNGDGSGVGNPLSEHPKVRMMSFTGSGPTGSKIMEKAAKDFKKVSLELGGKSPYIVLDDVDVEEAANATTKKVVNNTGQVCTAGTRVLIPESIKEDYLTAVKEAFSKVKVGQPREEGTQVGPIISKKQFDQVQDYIDKGINEGAELFYGGPGKPEGLDKGYFARPTIFINVDNHMTIAQEEIFGPVMSVITYNNLDEAIEIANDTKYGLAGYVIGKDKDTLRHVARSIEAGTIEINEAGRKPDLPFGGYKESGLGREWGDYGIEEFLEVKSIAGYFK

SEQ ID NO: 48854 - protein, 177 aa, Sinorhizobium meliloti 1021
MRIDAISIGKNPPEDVNVIVEVPVGGHPIKYEMDKEAGTLVVDRFLYTPMTYPGNYGFVPHTLSDDGDPIDVLICNTRPLVPGCVINVRPIGVMMMEDNSGQDEKIIAVPSAHLTKRYDKVHDYTDLPEITLKQIEHFFEHYKDLEPGKWVKIFGWKDASMAKQLIREAVERAKTKK

SEQ ID NO: 48855 - protein, 287 aa, Agrobacterium tumefaciens str. C58
MNLITNRIAFQGEFGANSDMACRDMFPDMEPLPCPTFEDAFNAIENGEADLGMIPIENTLAGRVADIHHLLPESRLHIIGEYFMPIRFQLMVVPGVTKDEIRTVHSHIHALGQCRKIIRSNGWKPVIAGDTAGSARLVSEKGDRSMAALAPRLAADLYGLDILAENVEDSENNVTRFVVLSRDENWAKRQSSDEIVVTTFVFNVRNIPAALYKAMGGFATNGINMTKLESYQLGGKFVATQFYADIEGHPDDEPVRHALDELRFFSEKVRILGVYNGHAMRGKLNQS

SEQ ID NO: 48856 - protein, 268 aa, Solanum tuberosum
MGTLGKASYTVGFWIRETGQAIDRLGCRLQGNYYFHEQLSRHRTLMNLFNKAPMVDKDAFVAPSASLIGDVHVGRNASIWYGCVLRGDVNSISIGAGSNIQDNSLVHVAKSNLSGKVLPTIIGNNVTVGHSAVLHGCTVEDEAFVGMGATLLDGVVVEKNAMVAAGALVRQNTRIPCGEVWGGNPARFLRKLTQEELLYLGSQPANYSNLAQVHAGENAKSFDAIEFEKVLRKKFARKDEEYDSMLGVVRETPPELVLPDNIQAPKAI

SEQ ID NO: 48857 - protein, 441 aa, Francisella tularensis subsp. holarctica
MKFSDLGLNSLICNALEKKGYTKPTPIQAQAIPIVLKGNDVMASAQTGTGKTAGFTLPIIQRLLDQPKAQANRIKTLILTPTRELAAQIQEQIQIYAANTHIRSAVIFGGVSINPQMMKLRKGVEILIATPGRLLDLYSQNAVKFDSLNTFVLDEADRMLDMGFINDLKKIHNLLPKKLQTLMFSATFSSEIKNLANEFLNNPQFVSADVVNTTVKKITQKIYTLDKSNKINALISLIKDQNLHQVLVFSRTKNGANKISEKLNNAGISSSAIHGNKSQTARTKALADFKSNDINVLVATDIAARGIDIAQLPCVINLDLSNVAEDYVHRIGRTGRAGQEGLAISLVSADEVESLSNIEHLIGHLLPREELEGFEATHNVPITSMSHKNKAKKIDEVKIIAAKRAKKNNNNKKPSNKNDFAKKIRQKIHQNKSVRKPKAKD

SEQ ID NO: 48858 - protein, 212 aa, Pediococcus pentosaceus ATCC 25745
MRKLKYTQQDQWESEARETQSPILIETAKLKAKKNQIVDGLKNYTATELHKNYNSLSLTANGKMEADQRSFQLEEVHFHHPAEHCFKGEATPRVLEAHFVHYGCLRQPLVVSVTFKLGAKNATFEKILTAMDDNKVEQFILLDDLIPKRGYFYRYIGSLTTPPLTEGVEWVVFEQAQMIDIDQLNLYMATFKEQNNRELQKLNHRKIEKYEI

SEQ ID NO: 48859 - protein, 492 aa, Glycine max
MAETLNLPLLLSVCIIFTTLSLTTSRTITTPSHTNVLDVSSSLHQAHQILSFNPQLLEEQSSETETPTSPSSSSSSFSLQLHPRETLLNEQHPNYKTLVLSRLARDTARVNSLNTKLQLALSSLNRSDLYPTETELLRPEDLSTPVSSGTAQGSGEYFSRVGVGQPSKPFYMVLDTGSDVNWLQCKPCSDCYQQSDPIFDPTASSSYNPLTCDAQQCQDLEMSACRNGKCLYQVSYGDGSFTVGEYVTETVSFGAGSVNRVAIGCGHDNEGLFVGSAGLLGLGGGPLSLTSQIKATSFSYCLVDRDSGKSSTLEFNSPRPGDSVVAPLLKNQKVNTFYYVELTGVSVGGEIVTVPPETFAVDQSGAGGVIVDSGTAITRLRTQAYNSVRDAFKRKTSNLRPAEGVALFDTCYDLSSLQSVRVPTVSFHFSGDRAWALPAKNYLIPVDGAGTYCFAFAPTTSSMSIIGNVQQQGTRVSFDLANSLVGFSPNKC

SEQ ID NO: 48860 - protein, 611 aa, Mycobacterium sp. MCS
MAVSVQMPALGESVTEGTVTRWLKQEGDTVEQDEPLLEVSTDKVDTEIPSPASGVLQKIVAQEDDTVEVGGELAVIGEGGEDSGDSSDDSSSDEDEDEEPAEEAESETTSEESDSSEETDSSEETESEPEPEPEPKKESKPKPKSSGSATPVTMPELGESVTEGTVTRWLKKVGDSVEVDEPLLEVSTDKVDTEIPSPVAGTLLEIIAEEDDTVEVGGELAKIGDADQAEAEEPEPEPEPEPEPEPEPEPEPEPKQESKPEPKPEPKQESKQEAKPEPKKEPEPQQDAEPSDGSGPYVTPLVRKLAAEHDVDLAAVKGTGVGGRIRKQDVLAAAEADKKAKSGPEDAAEAPGKAPAAATASANASDAPLAHLRGTKQKANRIRQLTAKKTRESLQATAQLTQTHEVDMTKIVALRAKAKNDFAEREGVNLTYLPFIARAVIDALKQHPNVNASYNEDTKEITYYDAEHLGFAVDTDQGLLSPVIKNAGDLSLAGLARAIADIAARARSGDLKPDELSGGTFTITNIGSQGALFDTPILVPPQAAMLGTGAIVKRPRVIVDEFGNESIGVRSICYLPLTYDHRLIDGADAGRFLTTIKRRLEEGSFEADLGL

SEQ ID NO: 48861 - protein, 1592 aa, Aspergillus oryzae
MDGQRQQQYIPVQPPPSAPASQSHILLPPPPPRYQPTQTQGVVPPPPPGPPPGTGYGAAKITNPQVQAQNTIGWQQKWAARQALSQGYLPPPPPPPLVPANQQLYNRTHLSIPSGEGRTSATYVPQPGTFGPGVGIPAFDSHTLSAYENQATLMDSDRQRPQVNQLYEYPSPDTAYKRDGTIPPTPSARTIPSALAANDGAHEQLPNHGQTTELTKSSSHRHNSSNTLPGGMSPSEAAAQWPLERVLLWLAKNGFSKDWQETFKALELQGADFIELGHGLNGRPNLGKLHNVVYPQLAKECESSGTGWDQTREREEGKRMRKLIRQIQEDGGYDAGIPIPKQRDSQTLPGSAPEGVLEASPMLTHEPLSAGPAANSPNLKTLQPAYPQRQSVQTRSFTTPIPASHDHLSSEPNSNDGTNWTRSDISRAALSSIAGDHRRQSPSVSSDGGHFFPPARPYEGSPKSGSPATQHATLAHQGASSSTSDLGVRFEHSRGNSSDSTTGRRYYESIRQDNTRPSPYDPYNRQLSGDNPSSYSKDHSNRLLHFFKKRSRTGDSNHPSPEEQFLESPTSPVNMRQNASHLPYTKPNFSSSDMSLGERPSSSSVSDHDRLALRAKSGHKGRKWAFATLDGWNYRLVDITETESVEVLRATICQNLGLSDWTGAQIFLTEPGQTEHDEPLNDPSLTLCRKTKSDSLGSLKFFVRGSHTYAGASSSPHVAGLGVSFPDKHTASPTSGQHQLHRKPLDDEALNRIAKPTSPQVASRQQLRTPAVKLPARDISHTPLSASPVDGGQDAGHLDPDKADLLARHEEHQREVERKQKAYRISKVSSVPQPRKDAYGETGYRREGVIDFDSPRISPYEDKKAEPLVPLRKPPTAPHESHTLTKVNSLRKKDADRPRVHQPVQTHGLGAVLASVGRMTSAIGTPTPSVSTSQAGTNNHANIEAPSESNIPDETKSTSQSPAGQDSQETPTSHTNQSPAKTAVPEEPRPTVQSRKSFGPEFDFEETNVSFQRSPMPQEDSDDDDSDDGLFAIPLANSKSPTKEKDSATGFSASQKLSAKPSLTVNTENRLRKGLSVSFRSPSATRETFASSSGDPDPRTGSLSDLTASPEEEKPPRRDSFARGDIWASRPPVEGVIEYLDDFFPNIDLDAPYLDGQGASPPSSPASRVAAESELSQKERPQPPPNPSESTLGSSEPTIKPQEANIVARRNVNRSGGLTRMKSIREVARGANQTSRNRSVTSSTGNQKSGDILRRKSTKMFGARIMQISPKPGSRLSQLDPIPQNNAPTTSVPQRQPTFRIIRGQLIGKGTYGRVYLGMNADNGEVLAVKQVEINPRIAGQDKDKMKDMVAAMDQEIDTMQHLEHPNIVQYLGCERGELSISIYLEYISGGSIGSCLRKHGKFEESVVKSLTQQTLSGLAYLHNQGILHRDLKADNILLDLDGTCKISDFGISKKSDNIYGNDSTNSMQGSVFWMAPEVIQSQGQGYSAKVDIWSLGCVVLEMFAGRRPWSREEAIGAIFKLGSLSQAPPIPEDVSMNISPAALAFMYDCFTIDSLDRPTAETLLTRHPFCEPDPKYNFLDTELYAKIRHVL

SEQ ID NO: 48862 - protein, 459 aa, Brassica rapa
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVKKSCPSRNGTCDDSSWLDFLRKIQERSGLGDETHGPEGLLQVPPRKTFAAAREETEQVIIGALENLFKNTNVNPKDIGILVVKSSMFNPTPSLSAMVKNNFKLRSNVRSFNLGGMGCSAGVIAIDLAKDLLHVHKNTYAFVVSTENITYNIYAGDNRSMMVSNCLFRVGGAAILLSNKPGDRRRSKYELVHTVRTHTGADDKSFRCVQQGDDENGKIGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFK

SEQ ID NO: 48863 - protein, 579 aa, Aspergillus oryzae
MWTSRVRQPVTNIVTVSRRLPRSARPAVIPWRRGYASNGPNASEQSGSSSRWLKTSLGLAGTGAAAFLVYTYATLDKSQAGSQADTKGLSQATEQLDSQYVQHKRSLKSPGVYLWGTNSHRVVDPNSKETVIKTPRRLHYFDGQVLRDLKLSDKSGAAIAENGDLIQWGKGYSESDFKPTKTLTGKNLTSLCMSNDRILALSSDGSVYSLPIAKDDQLSGRKLKESSWVPFWSGKSGVSYRLLQPSLKLGEKVTMLRGGLEHALLLTNHGRVFSVASSTESYPSFGQLGVPGLTWATRPNGPVDMCHEIEAFKGIKITQIASGDYHSLALSKDGSLFTFGDNSFGQLGMAFDAALPFSDTPTSLPIKNLYKGNTTFPKVTGIAAGGANSFFTVDAQRIVGPGENPSTVRDLDRITADTWTCGRGIWGALGTGKWTHMQDAPTKVKSLSGLFEYDERKKKLTPIRLRDLSVGTTHVSAVMDNDAHIDPSPSNSLDDATNFGFDVLFWGGNEHFQLGTGKRSNQSKPTHINAPPEDKGELAEQEARLQVMPRHKGKVGPRTVNMEQRVECGRHISAIYSSV

SEQ ID NO: 48864 - protein, 226 aa, Brassica napus
ESGETYTDMLGYLMKKEDNRYLLTDKEIRDQVLTILYSGYETVSVTSMMALKYLHDHPKALEELRREHLVIRDRKRPDEPLNLDDIKSMKFTRAVIFETSRLATVVNGVLRKTTHDLELNGYLIPKGWRIYVYTREINYDTSLYEDPMIFNPWRWMEKKMESMSYFLLFGGGARHCPGKELGISEVSSFIHYFVTRYKWEEKGGEKLVVFPRVSAPKGYHLRVSPY

SEQ ID NO: 48865 - protein, 133 aa, Oryza sativa Indica Group
MAPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKEL

SEQ ID NO: 48866 - protein, 885 aa, Arabidopsis thaliana
MERHCVFVATFLLMLHLVHAQDQTGFISVDCGLAPRESPYDAPQTGLTYTSDAGLVAGGKPGRLAKEFEPLADKPTLTLRYFPEGVRNCYNLNVTSDTNYLIKATFVYGNYDGLNVGPNFDLYLGPNLWTTVSSNDTIEEIILVTRSNSLQVCLVKTGISIPFINVLELRPMKKNMYVTQGGSLKYLFRGYISNSSTRIRFPDDVYDRKWYPLFDDSWTQVTTTLDVNTSLTYELPQSVMAKAATPIKANDTLNITWTVEPPTTQFYSYVHFAELQALRANEAREFNVTLNGVYTFGPFSPIPLKTASIVDLSPGQCDGGACLLQVVKTLKSTLPPLLNAIEAFTVIDFPQMETNGDDVAAIKNVQGTYGLSRISWQGDPCVPKLFLWDGLNCNNSDISTPPIITSLDLSSSGLTGSITQAIQNLTHLQVLDLSDNNLTGEVPEFLADIKSLLVINLSGNNLSGSVPPSLLQKKGMKLNVEGNPHLLCTAGSCVKKGEDGHKKKSVIVPVVASIASIAVLIGALVLFLILRKKRSPKVEGPPPSYMQASDGRSPRSSEPAIVTKNRRFSYSQVAIMTNNFQRILGKGGFGMVYHGFVNGTEQVAVKILSHSSSQGYKQFKAEVELLLRVHHKNLVGLVGYCDEGENLALIYEYMANGDLKEHMSGTRNRFTLNWGTRLKIVVESAQGLEYLHNGCKPPMVHRDVKTTNILLNEHFQAKLADFGLSRSFPIEGETHVSTVVAGTPGYLDPEYHRTNWLTEKSDVYSFGILLLELITNRPVIDQSREKPHIAEWVGVMLTKGDIHSIMDPSLNEDYDSGSVWKAVELAMSCLNPSSARRPTMSQVVIELNECLASENARGGASRDMDSKSSIEVSLTFGTELSPTAR

SEQ ID NO: 48867 - protein, 458 aa, Brassica rapa
MTSINVKLLYHYVITNLFNLCFFPLTAIVAGKAYRLTIDDLHHLYYAYLQHNLITIAPLFAFTVFGSVLYIATRPKPVYLVEYSCYLPPTHCRSSISKVMDIFYQVRKADPSRIGTCDDSSWLDFLRKIQERSGLGDENHGPEGLLQVPPRKTFAAAREETEQVIIGALENLFKNTNVSPKDIGILVVHSSMFNPTPSLSAMVNNFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDYSFRCVQQGDDENGKTGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFK

SEQ ID NO: 48868 - protein, 188 aa, Staphylococcus aureus subsp. aureus MW2
MILVVDNYDSFTYNLVDIVAQHTDVIVQYPDDDNVLNQSVDAVIISPGPGHPLDDQQLMKIISTYQHKPILGICLGAQALTCYYGGEVIKGDKVMHGKVDTLKVISHHQHLLYQDIPEQFSIMRYHSLISNPDNFPEELKITGRTKDCIQSFEHKERPHYGIQYHPESFATDYGVKIITNFINLVKEG

SEQ ID NO: 48869 - protein, 459 aa, Brassica oleracea var. alboglabra
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALGNLFKNTNVSPKDIGILVVNSSMFNPIPSLSAMVVNTFKLRSNVRSFNLGGMGCSAGVIAIDLAKDLLHVHKNTYALVVSTENITYNIYAGDNRSMMVSNCLFRVGGAAILLSIKPGDRRRSKYELVHTVRTHTGADDFSFRCVQQGDDENGKTGVSLSKDITDVAGRTVKKNIATWGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFK

SEQ ID NO: 48870 - protein, 380 aa, Lactuca sativa
MSSTTNQVIRCKAAVAWEAGKPLVIEEVEVAPPQKMEVRIKILFTSLCHTDVYFWEAKGQNPVFPRILGHEAGGVVESVGEGVTELQPGDHVLPVFTGECKECAHCKSEESNMCDLLRINTDRGVMIHDQKSRFSINGKPIFHFVGTSTFSEYTVVHVGCLAKINPLAPLDKVCVLSCGISTGLGATLNVAKPKKGSSVAIFGLGAVGLAAAEGARIAGASRIIGVDLNANRFELAKKFGVTEFVNPKDYKKPVQEVIAEMTNGGVDRSVECTGHIDAMISAFECVHDGWGVAVLVGVPHKDAVFKTSPLNLLNERTLKGTFFGNYKPRSDIPSVVEKYMNKELELEKFITHELPFSEINKAFDLMLKGEGLRCIIRMGE

SEQ ID NO: 48871 - protein, 313 aa, Cryptococcus neoformans var. neoformans JEC21
MGYTLAVLGCGTMGIAILSGVISSLETRASLPRNPNASSEPPSGISTPTASQFLDAPEASLPSTFIATVGREETGRKLRRTLADMGSIGKQVQVRAGQGNVKTVDEADVILVCSKPQIARSILEEEGMSKALEGKLLISICAGVTISQLKSWVPESTRVVRAMPNTPCKIGEGMTIVTPLSDALSRTLILNIFTSCGRCRFLDEKHFDACTALAGSGPAFVALVLEAMADGGVMMGLPRSEALELAAQTMQGTGRMALQTGLHPAQLKDSVTTPGGCTIAGLLTLEDGRVRSTMARAIQVATNHASGLGQDKK

SEQ ID NO: 48872 - protein, 114 aa, Brassica napus
MKDPSAKRKVVVRHLPPSLSQSDLLSQIDPRFGDRYNWVSFRPGKSSYKAQKYSRAYFSFKAPEDVYDFAAFFNGHVFVNEKGAQFKAIVEYAPSQRVPKPCDKKDPREGSITK

SEQ ID NO: 48873 - protein, 384 aa, Bordetella pertussis Tohama I
MPRLATRTNDFLTFQVVELFKEAQALQAAGRDIISLGIGEPDFTAPPQVVEALERATRAGLNGYSAPAGLSALREAIAAFYESEFGARVDPARIIVTAGASGALALACAALVNPGAQVLMPDPSYPANSNFVLAAGGQPRLIPSTAAKRFQLSAQDVRDHWNDATQGVLIASPSNPTGTSIAHDELAELLAAVRERQGFSIVDEIYLGLSYESQPRSALLLDDNIIVINSFSKYFHMTGWRLGWMIVPESMAAKVEKMAASLAICAPTLAQHAALACFTPDALKIFEHRREAFKQRRDYLLPEFERLGIPVPVRPDGAFYIYADIAALGTTSMAFSHRLLHEGGVAAVPGLDFGPAHGERTMRFSYATGLDRLQEAVARIEKLL

SEQ ID NO: 48874 - protein, 450 aa, Silicibacter pomeroyi DSS-3
MAPVIYPTTNLTATEQLVLDRGKGIYVYDTDGNEYIEGLAGLWCTSLGYDNAEVIGAITDQLNRLPFTHTFGGKTHEPIMKLAEKLKAMVPVEDAYFFFGNSGSDANDTHYKMLRYYFNAIGKPEKRKIITRERGYHGVTVAAGSLTSLPANLAHFDAPVEALHILRSDAPHYYTGRQGNETEAQFVDRILDNLEQQILAEGADTIAAMIVEPITGASGVIVPPEGYYEKLQTLLRKHDILVWADEVICGFGRTGADFGCTTMGIKPDLMTFAKQLSSAYFPISASVIPGWMYEKMIAPSAAVGVFGHGYTYSGHPVACAAALKTLEIYERDDLFGHAAEVGAHMQEQLRAIFTDHPLVGEVRGKGLIAALELVSNKTTGATIEKGAGGATVQRLAQENGLLIRAVAGNSAALCPPLIITKEEVDEMLRRLKTAVDGAYAELKDKGLLAA

SEQ ID NO: 48875 - protein, 762 aa, Bordetella pertussis Tohama I
MDANFRKAALEYHEHGRPGKISVTPTKQLSNQRDLSLAYSPGVAAACEEIVDDPVNVFRYTGRGNLVGVITNGTAVLGLGNIGALASKPVMEGKAVLFKKFAGLDVFDIEINETDPDKLVEIIAGLEATFGGINLEDIKAPECFTVERKLRERMKIPVFHDDQHGTAITVCAAVVNGLAVAGKRIEDVKLVTSGAGAAALACLDLLVDLGLPLEHIWVTDIEGVVYEGRKKLMDADKERFARKTKARTLAEVIEGADVFLGLSAGNVLKPEMVATMAANPLILALANPNPEILPEAAHAVRDDIVMATGRSDYPNQVNNVLCFPYIFRGALDVGATTITREMEKAAVLAIASLAREEQNEVVAAAYGTYDISFGRDYLIPKPFDPRLIVRIAPAVAKAAMEGGVATRPIADLDAYAEQLQQFVYHSGAFMKPLFSQAKQIVRDGGRARIVFTEGEDERVLRAVQVIVDEKVAKPILVGRPQVLLSRIEKFGLRLRLGQDVEVCNPEYDERFHQYWTTYWDMMCRNGITKEMARVEMRRRLTLIGAMMVHLGDADGMICGAVSGFHDHLRFIDQVIGRKPGAQTYAAMNILLLNERTVALVDTHVNEDPSAEQIAEYTVAAAEEMQRLGLAPKVALLSRSNFGSGSSASGAKMRHALELVNRQAPGLEIDGEMHGDCALDESLRLRLLPDSPLKGSANLLVCPNVDSGNIAYNLLKTTAGGNVAVGPFLLGANAAVHILTSSSTVRRIVNMAAMAVVNADAVR

SEQ ID NO: 48876 - protein, 378 aa, Haemophilus influenzae R2866
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGDHVIPLYTAECGECEFCRSGKTNLCVSVRDTQGKGFMPDCTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFDLAKQFGATDYLNPNDYDKPIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDQINEAFELMHEGKSIRTVIHY

SEQ ID NO: 48877 - protein, 520 aa, Synechococcus sp. CC9311
MLGELWSFQGRYRTLHLTWFAFFLTFVVWFNLAPLATTVKADLGLTLGQIRTVAICNVALTIPARVLIGMLLDKYGPRLTYSSLLVFSVIPCLMFASAQDFNQLVVARLLLSIVGAGFVIGIRMVAEWFPPKEIGLAEGIYGGWGNFGSAFSALTLVGLAGWLSFSGGFELPSGAVLNWRGAIALTGIISAVYGFIYYFNVSDTPPGKTYQKPERTAGLEVTSMRDFWGLLGMNVPFAAILCVLCWRLQKVGFLNAGTYPLALGAVLIWFIFQTWGIIRTNRELIMGTKTYPKEDRYEFKQVAILELTYIVNFGSELAVVSMLPTFFETTFDLPKATAGILASCFAFVNLVARPAGGLISDKLGSRKNTMAFLTGGLGIGYLVMSMIKPGTFSGTTGIIIAVLITMLASFFVQSGEGATFALVPLVKRRVTGQVAGLVGAYGNVGAVTYLTIFSLLPMWMGGGKDPSPEIIAASNSAFFQVLGVAGLIVAFFCFFFLKEPKGSFDDLHEGETASPEFANN

SEQ ID NO: 48878 - protein, 275 aa, Arabidopsis thaliana
MFGAQSSDSLPEISRPTATECQEVKSDEALTEPNPDWALVLVKDPSPPLIIEVEDETLPSIDSVQNPKPKDPEATPSQPSVASRLRKRKSSAADPRIKRMKQGKGVTGSSSFDGIRFVSTEAEKRYAQFSQRNFIEEVELSRKTNEAAREFIKQAGLIRTVTKFNPFTQNLVFEFWANLPTMKVDTYMVKVLVRNREYELSPGKINEMYGLPSVDARQQRMDIAGLVDEQVAEFLTGGKVSVLSKLQVSAFTPTSLELFKLCCSNSSPTSNAGGR

SEQ ID NO: 48879 - protein, 474 aa, Shewanella sp. ANA-3
MNMATDPAKISPLTELLQRQRASYLAAPNPDYAIRKERLLRLKAALLKFQQPLVEALSQDYGHRSVDDSLISDIMPVVNNINYSLKNLKKWLKPSRRHAGILLAPAQVKVHYQPLGVIGIIVPWNFPVMLSIGPLVTAIAAGNHAMLKLSEFTPATNSVIKQLLAEVFEESHVAVVEGEADVAAQFSALPFDHLLFTGSTTVGRHVMRAAANNLTPVTLELGGKSPVIIAPDMPLEIAVERMIYGKCLNAGQICVAPDYVLCPKAKVAEFIQAYQAKFQAMYGAITHNKDYGSIINARQFERLLTVLEDAKAKGAKVIPASNDVIDSQHRKLATQLITDTTEDMLLMQEEIFGPLLPVTGYDNLDEAISYVNHRARPLALYVMSFDEASQQKILKQTHSGGVCINETVFHVAADDAPFGGIGPSGMGHYHGKEGFLTFSHAKTVLSRGRFNTGKFVHPPYGTFIQRMLMKLFLR

SEQ ID NO: 48880 - protein, 437 aa, Schizosaccharomyces pombe 972h-
MLARNLRCLHPNTFASLKTNVSYHGVKCLASQSKRGFKVWADVPMGPPDPIFGITEAYKKDGDVKKMNLGAGTYRDDAGKPYVLPSVRQAETELLSQKLDKEYAPITGIPSFRVQATKLAYGDVYESIKDRLVSAQSISGTGALCIAANFLASFYPSKTIYVSDPTWGNHKNVFSRAGLTVKSYKYYDPATRGLDIKGMLSDLTSAPDGSIILLHACAHNPTGVDPTKAQWDDILKTMQKKNHFALLDMAYQGFASGDFARDAYATRLFASSNVPMLLCQSFAKNMGLYGERAGCFSILANDAEEAARIESQTKILIRALYSNPPVNGARIANHILSNPALREQWAGEVVGMSERLKSMRKALRNILEKDLKNKHSWKHITDQIGMFCYTGLNPQQVDVLAKQYHIYLTKNGRISISGLNTSNVRYFAEAINAVTSN

SEQ ID NO: 48881 - protein, 299 aa, Streptococcus pyogenes M1 GAS
MTKVRKAIIPAAGLGTRFLPATKALAKEMLPIVDKPTIQFIVEEALKSGIEEILIVTGKSKRSIEDHFDSNFELEYNLQAKGKIELLKLVDETTSINLHFIRQSHPRGLGDAVLQAKTFVGNEPFVVMLGDDLMDITNPNVKPLTKQLIDDYEETHAATIAVMRVPHEDVSNYGIIAPQAKAVKGLYSVDTFVEKPQPQDAPSDLAIIGRYLLTPEIFSILEKQEPGAGNEVQLTDAIDTLNKTQRVFAREFKGKRYDVGDKFGFMKTSLDYALKHPQVKDDLKAYIIQLGKALEKTKP

SEQ ID NO: 48882 - protein, 305 aa, Mycoplasma genitalium
MIWELFTNILKNKPKLSLSLTLLNAGIIIFGMIGTFVVVYFYKWNATVNGIWTLSFTLSVVLLWIIYIACMSKTRIKFSLQLSYSLGAIACFIASIGTIYFSVIRGWTTIFLLMSLAVSVDTFPFLFGKRFGKNPLIKISPSKTWEGAFFGIISTIVVVALLCVLYSIPFFVAKPTFNQTNGIALNTPQNYDSHNLITNIFLIAFISGGSSFYIYWWVSTLALIFTGSVFAIGGDLFFSYIKRLISIKDFSKVLGKHGGVLDRFDSSSFLISFFFVYHLIAGTISNQRLLMEPNTYFSAITSIQS

SEQ ID NO: 48883 - protein, 338 aa, Streptococcus pyogenes M1 GAS
MTKQKVAILGPGSWGTALSQVLNDNGHDVRLWGNIPDQIEEINTKHTNRHYFKDIVLDKNITATLDLGQALSDVDAVLFVVPTKVTRLVARQVAAILDHKVVVMHASKGLEPETHERLSTILEEEIPAHFRSEVVVVSGPSHAEETIVRDITLITAASKDIEAAKYVQSLFSNHYFRLYTNTDVIGVETAGALKNIIAVGAGALHGLGYGDNAKAAVITRGLAEITRLGVKLGADPLTYSGLSGVGDLIVTGTSVHSRNWRAGAALGRGEKLEDIERNMGMVIEGIATTKVAYEIAQDLGVYMPITTAIYKSIYEGADIKESILGMMSNEFRSENEWH

SEQ ID NO: 48884 - protein, 239 aa, Arabidopsis thaliana
MSLIEDCLRSYRFIAIDTEFPSTLRETTQHATDEERYMDMSFSVDRAKLIQLGLTLFDINGRIGGTWEINFSDFGVDDARNEKSIEFLRRNGLDLRKIREEGIRIEGFFSEMFWMLKKTRRNITWVTFHGSYDIAYLLKGFTGEALPVTSERFSKAVARVLGSVYDLKVMAGRCEGLSSRLGLETLAHEFGLNRVGTAHHAGSNNELTAMVFAKVLSPFPLFLRFGSLELRTIESEAIV

SEQ ID NO: 48885 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDANEMCAFVRQTIADLSSEEVSEATRIQYGGSVKPNNIKEYMAQTDIDGALVGGA

SEQ ID NO: 48886 - protein, 1145 aa, Vitis vinifera
  misc_feature (586)..(586): Xaa can be any naturally occurring amino acid
  misc_feature (1009)..(1009): Xaa can be any naturally occurring amino acid
MPSGNVVISDKMQFPGGGGGGGGGGAAEIHHHRQWFPDERDGFISWLRGEFAAANAIIDSLCNHLRLIGEPGEYDAVIGCIQQRRYNWSSVLHMQQYFSVAEVIYALQQVGWRRQQRHLDPVKGAGKEYKRYGVAYRQGQRGETAKDSHNSNFENHSHDANSSGTLEKGERVSEIYDDVKGGDKGDVVGKLEDKDLSAAAEKKEVMNFVIFGQLEQMLLQNPMQIAVRRVQKTQKDPDVAFQRLRPMTWMMEARSCNMIMENNAHPVQNQNEKPNPTTSPKTFVGTEIFDGKAVNVVDGLKLYEELFDDSEVSKFVSLVNDLRAAGKRGQLQGQTFVVSKRPMKGHGREMIQLGVPIADAPLEDESVVGTSKGMFHNRRTESIPSLLQDVIGQLVGSQVLTVKPDACIIDFYNEGDHSQPHIWPTWFGRPVCILFLTECDMTFGRVIGADHPGDYRGSLKLSLVPGSLLVMQGKSADFAKHAIPSLRKQRILVTFTKSQPKKTTASDGQRLLPPAAQSSHWVPPPSRSPNHMRHPMGPKHYGAVPTTGVLPAPAPPMRPQLPPPNGMQPLFVTTAVAPAMPFPAPXPLPTGSPGWPAAPPRHPPPRLPVPGTGVFLPPPGSGNSSSPQHISTEATSTSVETAAPTEKENGSGKSSSNSNTVSPKGKLDGKVHRQECNGSMDETGVDERAVTKEEQQHNDELKELEFIHKSCCTVGYRPNVFSTTLSHLIATRSPHLILPFVPIRERLKEKLEECFGCEYELFIEFTGLISWTRGASIGWHSDDNRPYLKQRDFAAVCYLNSYGKDFKGGLFHFQDGDPTTIVPLAGDVVMYTADCRNIHSVDEAGCCSDFLIICLGTSSASPGSVTDPDLSHKKPLKCAVLDLKIWRAGIVLEYNSNEMQNSKDAQITDGERLTLTLWFSRDCSHDEDAKLVSHLSQSQLHSSNNEPDSYLPLPASSSMYWFSPDHISQHQSGFDICWARMHILGYDLFSPQDKSCFSALDSSCDFSEXLMEQLQLARGDELFGQEFVNILHVLQVVQFYSWKASKLQTSKVERETENLVVKLSESQREKINSLRTTFLNDQQLAETVLGTSCGESRQHSFQWVSFSAAVGAWEDYTRELRKELVLSLPYWINHQAIFSVPFDGS

SEQ ID NO: 48887 - protein, 428 aa, Francisella tularensis subsp. holarctica
MYSSNIWHPCTQMKDFEKSPPLNVYRTEERYIYTKDNRKLFDATSSWWCKSLGHRHPYIIDKLKKQLDKYEHTIFANTTNDEIDRFSQRICNLTGMDKTLYTSDGSCAVEIALKMTIHLRSFQNQTKKIKFVCLENSYHGETLATMSVSDCGLYSDPYKPLLFDSFKLKNIPYVTGKNDPLWANAERYWNKSQQYLEQHKEFINALIVEPICQGAGGMLIYSKDYLNRLCKWCKENDIYIIFDEIMTGLGRLGKLFAYEYLDITPDFLCVSKGLTSGIIPFSIVLTKNQYYEMFYDDQLTKAFLHSHTHSGNVLGAVVANAVLDIFEEENILTNVKDLEKQFSESFLELQEQLPIIKNVRGIGAVIAADLNIDKKRAGLDVYREAIKLGALLRPLGNTIYWLPPFNSTYQEIDLLKQITKQSIINAFK

SEQ ID NO: 48888 - protein, 559 aa, Solanum tuberosum
MGSSGDAWKLKDHPKLPKGKTVAVIVLDGWGEAKPNEYNAISVAETPVMDSLKQGAPEHWRLIKAHGNAVGLPTEDDMGNSEVGHNALGAGRIFAQGAKLVDLALASGKIYDGEGFKYVQECFEKGTLHLIGLVSDGGVHSRLDQLLLLLKGAAERGAKRIRVHALTDGRDVLDGSSVGFMETLENDLAKLREQGVDARVASGGGRMYVTMDRYENDWDVVKRGWDAQVLGEAPHHFKDPVEAIKKLRQEPNTSDQYLAPFVIVDDNGKPVGPILDGDAVVTFNFRADRMVMLAKALEYEDFDKFDRVRVPKIHYAGMLQYDGELKLPNKYLVSPPEIDRTSGEYLVRNGVRTFACSETVKFGHVTFFWNGNRSGYFDEKLEEYVEIPSDSGITFNVKPKMKALEIAERTRDAILSHKFDQVRVNIPNSDMVGHTGDIKATIEACKAADDGVKMILEAIEQVGGIFLVTADHGNAEDMVKRNKKGEPLLDKNGNIQILTSHTLEPVPIAIGGPGLLPGVRFRTDLPTGGLANVAATFMNLHGFEAPSDYEPTLIEVVDN

SEQ ID NO: 48889 - protein, 213 aa, Debaryomyces hansenii CBS767
MKTINPKPLYVPPLNFSLVEDGIYRSGFPMPINYPFLEQLGIKTIIYLGDLGEKKKDEKLKKKNKKNKEEGDKTPKEKEKKDKHGTAEIMDNYKKWIETTDIKFHDLFIKSALEPFTLEEDRTQALETIKTALQLIVNKQNFPILIHSNKGKHRIGVLVGLMRKLLQGWCLSGIFEEYEKFAMGKSEFDLECIELWQPELYVENEWKPDFVRS

SEQ ID NO: 48890 - protein, 142 aa, Zea mays
  misc_feature (111)..(111): Xaa can be any naturally occurring amino acid
MEKNTMFLLSVLRVVAAWSILAAYTIPFFIIPRTVHPLLGWPLYLLGSFALSSIVINIFLFHPITVLTTWFGFIGALLVMAFPWYLNGFVRALAVFAYAFCCAPLIWASLXVKTMSSLQVLIERDAFRLGEPSQNAEFTKLY

SEQ ID NO: 48891 - protein, 773 aa, Oryza sativa Japonica Group
MVSAADAVIPACAAVGIAFAVWQWLLVSRVKVSPYSAAAAAARNGGAGRAVFRPEGEVDDDDGGCGDDEGADGDGGVAAMARCAEIQSAIRVGANSFLFTQYKYLAAFTAVFAVVIFLFLGSVHRFSTESQPCQYTRGKACKPALANAVFSTIAFLLGAATSVASGFLGMRIATAANARTTVEARRGIGPAFAAAFRSGAVMGFLLASLGLLVLYVAIKVFGLYYGDDWEGLYESITGYGLGGSSMALFGRVGGGIYTKAADVGADLVGKVERNIPEDDPRNPAVIADNVGDNVGDIAGMGSDLFGSYAESTCAALFVGSISSFGADHNFAAVSYPLLISSAGLIVCLITTLFATDLYRVKTVDGVAPALKLQLLISTVLMTVGVLVVTFTALPHEFTMFDFGEVKRVKNWHLFFCVTIGLWAGLAIGFTTEYFTSNAYSPVRDVADSCRTGAATNVIFGLALGYKSVIVPVFAIAVSIYVSFTLASIYGIAVAALGMLSTVATGLAIDAYGPISDNAGGIAEMAGMSHRIRQRTDALDAAGNTTAAIGKGFAIGSAALVSLALFGAFVSRAGMAVINVLSPKVFVGLVVGAMLPYWFSAMTMKSVGSAALKMVEEVRREFAAIPGLMEGRATPDYASCVRISTDASLREMMPPGALVLLAPLVAGTFFGVQTLAGLLAGALVSGVQVAISASNSGGAWDNAKKYIEAGASDHAKALGPKGSDAHKAAVIGDTIGDPLKDTSGPSLNILIKLMAVESLVFAPFFAAHGGLIFK

SEQ ID NO: 48892 - protein, 533 aa, Yarrowia lipolytica CLIB122
MSWETITPPTPIDTFDSNLQRLRDSFETGKLDSVDYRLEQLRTLWFKFYDNLDNIYEAVTKDLHRPRFETELTEVLFVRDEFSTVIKNLRKWVKEEKVENPGGPFQFANPRIRPVPLGVVLVITPWNYPVMLNISPVIAAIAAGCPIVLKMSELSPHTSAVLGRIFKEALDPGIIQVVYGGVPETTALLTQHWDKIMYTGNGAVGRIIAQAAVKNLTPLALELGGKSPVFITSNCKSVMTAARRIVWGKFVNAGQICVAPDYILVAPEKEAELVACIKEVLQERYGSKRDAHHPDLSHIISKPHWKRIHNMIAQTKGDIQVGGLENADEDQKFIQPTIVSNVPDDDILMQDEIFGPIIPIIKPRTLGQQVDYVTRNHDTPLAMYIFSDDPKEVDWLQTRIRAGSVNINEVIEQVGLASLPLSGVGASGTGAYHGKFSFDVFTHKQAVMGQPTWPFFEYLMYYRYPPYSEYKMKVLRTLFPPVLIPRTGRPDATVLQRVLGNKLLWIIIAALVAYAKRNELLITIAQIMSVFIK

SEQ ID NO: 48893 - protein, 192 aa, Photobacterium sp. SKA34
MPFKVGLKSNIPADLLSFNGLESGKEHVAVIFKDAEKTTAPLVRMHSECLTGDVFHSSRCDCGEQLDETIEKMGELGGIILYLRQEGRGIGLYNKIDAYKLQSEGMNTYEANNHLGFGDDLRDFSEAAYMLKALGLTEIRLVTNNPKKIRELSENGINIVEVVGTKAHIKDGNESYLKTKASHGHHRFNFEN

SEQ ID NO: 48894 - protein, 494 aa, Arbutus unedo
  misc_feature (8)..(8): Xaa can be any naturally occurring amino acid
PTTSGPGXSMLEKKNLGRIVQIIGPVLDAAFPPGKMPNIYNALVVKGRDTVGQPINVTCEVQQLLGNNRVRTVAMSATDGLTRGMEVIDTGAPLSVPVGGATLGRIFNVLGEPVDNLGPVDTRITSPIHRSAPAFIELETKLSIFETGIKVVDLLAPYRRGGKIGLFGGAGVGKTVLIMELINNIAKAHGGVSVFGGVGERTREGNDLYREMKESGVINEQNIAESKVALVYGQMNEPPGARMRVGLTALTMAEYFRDVNKQNVLLFIDNIFRFVQAGSEVSALLGRIPSAVGYQPTLSTEMGSLQERITSTKKGSITSIQAVYVPADDLTDPAPATTFAHLDATTVLSRGLAAKGIYPAVDPLDSTSTMLQRWIVGDEHYKIAQRVKQTLQRYKELQDIITILGLDELSEEDRLTVARARKIERFLSQPFFVAEVFTGSRGKYVSLAETIRGFQLILSGELDGLPEQAFYLVGNIDEATAKAMNLEMESNLKK

SEQ ID NO: 48895 - protein, 323 aa, Triticum aestivum
  misc_feature (122)..(122): Xaa can be any naturally occurring amino acid
  misc_feature (144)..(144): Xaa can be any naturally occurring amino acid
  misc_feature (302)..(302): Xaa can be any naturally occurring amino acid
MDANRSLGTPSSLPHLSPKAKSSGEAPAMEGKEEDVRLGANRYSEHQPIGTAAQGGGADEKDYKEPPPAPFFEAGELTSWSFYRAGIAEFLATFLFLYISVLTVMGVVGNPSGSKCGTVGIXQGIAWSFGGMIFVLVYCTAGIXPAGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGXAALAAIYHVVVIRAIPFKSRD

SEQ ID NO: 48896 - protein, 429 aa, Methylobacillus flagellatus
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLSRQCARAVGDPDRAGRYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEAKPRKRAQTTSQSASA

SEQ ID NO: 48897 - protein, 111 aa, Synechococcus sp. RS9916
MSDTSAATYSITVDLDGEQHSFSCRSDQTVLAAAEAAGVMIPSSCCAGVCTTCAARIGEGEVHQPDAMGVKEDLRKDGFALLCVSYPRSDLKVLAGQEDALYEAQFGQYQK

SEQ ID NO: 48898 - protein, 312 aa, Borrelia burgdorferi B31
MKIKCKVHASLALIKYWGKKDVFLNIPATSSLAVSVDKFYSISELELSNRDEIILNSKPVILKNREKVFFDYARKILNEPNVRFKIKSKNNFPTAAGLASSSSGFASIAACILKYFNKYSCNSASNLARVGSASAARAIYGGFTILKEGSKESFQLRDQSYFNDLRIIFAIIDSNEKELSSRAAMNICKRHKFYYDAWIASSKKIFKDALYFFLKKDFIHFGATIVKSYQNMFALMFASSIFYFKNSTIDLIRYAADLRNEGIFVFETMDAGPQVKFLCLEENLNTILKGLKQNFTGIDFIVSKVGCDLEWI

SEQ ID NO: 48899 - protein, 263 aa, Medicago sativa
DPMGAFWLQGVHMIHCSYNSLWMGQMIRPDWDMFQSDHICAKFHAGSRAICGGPIYLSDNVGSHDFDLIKKLVFPDGTIPKCIHFPLPTRDCLFKNPLFDKTTVLKIWNFNKYGGVIGAFNCQGAGWDPKEHKFRGFPECYKPIVGTVHVTEVEWDQKKEASDLGKAEEYVVYFNQAEELSLMTPKSEPIQFIIQPSTFELYNFVPVTKFGGNIKFAPIGLTNMFNSGGTILDLEYVESGAKIKVKGGGNFLAYSSESPKKFQ

SEQ ID NO: 48900 - protein, 557 aa, Chlamydomonas reinhardtii
  misc_feature (537)..(538): Xaa can be any naturally occurring amino acid
MAHDYKLKAHPAIPAPEGPLLVCILDGFGENEYKDEFNAVHVAKTPTVDALRAVPHRFRSIKAHGKAVGLPSDADMGNSEVGHNALGSGQVVDQGARLVDLALETGRMFSDPGWKLISEAFPSHTVHFIGLLSDGGVHSRADQLHGCLRGAVERGAKRVRVHILTDGRDVPDGSSIRFVEELEAVLAELRGKGCDIAIASGGGRMQVTMDRYEADWSMVKRGWDAHVLGKAPHYFKDAKTAVTTLRGSEDAPVSDQYVAPFVIVDEADKPVGTIEDGDAVVLFNFRADRMVEISKAFEYEDGFTAFERERFPKGLRFVGMMQYDGDLKLPANFLVPPPLIEHVSGEYLCKNGLSTFACSETQKFGHVTFFWNGNRSGYLDAKQEQYLEIPSDKIEFNKAPDMKAREITAAGIEALKSGKYKVVRINYANPDMVGHTGDMAATVRACETVDGCVKELLEVVDSLNGRWIVTSDHGNADDMVQRDKKGKPLLGEDGKPLPLTSHTLAPVPFFIGGKGLPDGVVLRDDLPDAGLANVAAXXFNLLGFEAPGIYKPSMVKA

SEQ ID NO: 48901 - protein, 347 aa, Oryza sativa
  misc_feature (236)..(236): Xaa can be any naturally occurring amino acid
  misc_feature (244)..(244): Xaa can be any naturally occurring amino acid
  misc_feature (281)..(281): Xaa can be any naturally occurring amino acid
  misc_feature (300)..(300): Xaa can be any naturally occurring amino acid
MAETLQSIAQAMVANGKGLLAADESTSTIQKRFDAIGVENTEANRQAYRELLFTTPDFEKYISGVILFDETIRQSTKSGIPFPQLLKSKGVIPGIKVDKGVKPLPNSPNETGTEGLDGLRERLKEYYALGARFAKWRAVIDIADGIPTDYAIHVNAFQLASYSALCQAEGIVPIVEPEVLMDGAHSIETCYNVTTRVLHAVFAELHAQHVALDGMILKPNFVIDGIKSGVKSTPQXIAELTVKXFQETVPVSVPRIVFLSGGQGEVEATLDLQVANTLGPXPGELSYSYGRAPPAGPRKXWSGKPQNVEKGQNRVPTPPRKKNPPGPPGVPPPREPGVGRVLYFLKE

SEQ ID NO: 48902 - protein, 518 aa, Zea mays
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTAAYVAPEVLGRRGYDGAKADVWSCGVILFVLMAGYLPFHDKNIMAMYKKIYKGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 48903 - protein, 395 aa, Bacillus halodurans C-125
MELAKRVSTLTPSSTLAITAKAKELKEQGHDVIGLGAGEPDFNTPQYIIDAAVRSMEEGHTKYTPSGGLPKLKEAIIEKFKQDQGLTYTAKEIFVGTGAKHVLYTLFQALLNEGDEVIIPSPYWVSYPEQVKLAGGEPVFVEGKESNDFKLTPAQLEPVLTDRTKAIIINSPSNPTGSLYTQEELAALGEVCLKHNVLIISDEIYEKLVYDGAKHTSVAEISPQLKENTVVINGVSKSHSMTGWRIGYAAGPEALIQAMTNLASHSTSNPTTSAQYGAIAAYTEDDGSVEKMRVAFEERLHTIYDKLVAIPGVSCVKPKGAFYLFPNVEEAAALTGHETVDDFVKVLLEEEKVALVPGSGFGAPDNVRLSYATSLELLEAAIDRIFRFVEAKRSK

SEQ ID NO: 48904 - protein, 377 aa, Agrobacterium tumefaciens str. C58
MAKADFYETLGVSKTADEKELKSAFRKLAMKFHPDKNPDDADSERKFKEINEAYETLKDPQKRAAYDRFGHAAFENGGMGGGGMGGGGFANGGFSDIFEDIFGEMMGGGRARRSSGGRERGADLRYNMEITLEEAFAGKTAQIRVPTSITCDVCSGSGAKPGTQPKTCATCQGSGRVRAAQGFFSVERTCPTCHGRGQTISDPCGKCHGQGRVTEERSLSVNIPSGIEDGTRIRLQGEGEAGMRGGPAGDLYIFLSVRPHEFFQRDGADLYCTVPISMTTAALGGTFDVTTLDGTKSRVTVPEGTQPGKQFRLKGKGMPVLRSAQTGDLYIQIQIETPQKLSKRQRELLQEFEQLSSKENNPESTGFFARMKEFFDG

SEQ ID NO: 48905 - protein, 389 aa, Nostoc sp. PCC 7120
MKAMILAAGKGTRVRPITYTIPKPMIPILQKPVMEFLLELLRQHGFDQIMVNVSHLAEEIENYFRDGQRFGVQIAYSFEGKIDDEGKLVGEAIGSAGGMRRIQDFSPFFDDTFVVLCGDALIDLDLTAAVKWHKSKGSIATIITKTVPEEEVSSYGVVVTDENSRVKAFQEKPSIEEALSTNINTGIYIFEPEVFNYIPSGVEYDIGGQLFPKLVEIGAPFYAIAMDFEWVDIGKVPDYWRAIRGVLQGDIKNVQIPGHEVAPGIYTGLNVAVNWDKVDITGPVYIGGMTRIEDGAKIVGPAMIGPNCWICGEATVDNSVIFEWSRLGHGARLVDKLVFGRYCVDKTGAAIDVQAAALDWLITDARQTPPEHTPVERQAIAELLGTNAT

SEQ ID NO: 48906 - protein, 475 aa, Frankia sp. CcI3
MTIPNPAATGIGLPATGGPRLPQEPRLHTEIPGPRSRALAARRVGAVARGVGETLPVYAHAAGGGVVVDVDGNSLIDFGSGIAVVSVGNAADGVVEAVREQIGRFTHTCFMVTPYEGYIAVCEALNRLTPGTHEKRSALFNSGAEAVENAVKIARSATGRGAVVVFEHAYHGRTNLTMAMTAKSMPYKSGFGPFAPEVYRMPLAYPYRWPTGPDRCGEEAAERVIELVRDEIGAASVAAMVIEPIQGEGGFIVPGTGFLPRLAEFCTVAGIVFVADEVQTGFARTGTMFACEHEGVVPDLITTAKGIAGGLPLAAVTGRAEIMDAPQVGGLGGTYGGNPAACAAALAAIDLIESEDLAGRARRIGEIALPRLHALRERYDFVGDVRGRGAMVALELVRGAGDDSPDKVLTAAAAAACHRRGLIVLTAGTWGNVLRLLPPLVIEEPLLLAGLDLLDEAFAELAARRQPPSPARPEG

SEQ ID NO: 48907 - protein, 117 aa, Nostoc sp. PCC 7120
MGLKFLQVSKELAEQHYGVHRERPFFPSLVEFITSGPVVAMVWEGDGVIASARKIIGATNPLTAEPGTIRGDFGINIGRNLIHGSDAPETAQKEVSLWFTDAELVNWQPHLTPWLHE

SEQ ID NO: 48908 - protein, 110 aa, Glycine max
MATTTFSSRGVQTMNTMFVKPMLRKSIHKKSASHDIVRETVKTDGAGCAGEEMKTTRGFSVAGDTSSSESSWIPHEGTGIYYPKGQEKVMQDVPPPPAGSNVDELVNWFS

SEQ ID NO: 48909 - protein, 374 aa, Rhodobacter sphaeroides 2.4.1
MKITAAVLERDGIAGNYAEERPLAIRELDLAEPGPGEVLIRVAAAGICHSDLSVINGTRRRPLPMVLGHEASGHVEALGEGVEDLEHGDHVVCIFAPGCGRCTPCAEGRPALCEKAARHHAVGELMTGHRRLSLGGRSVHHHLGISGFATHAVVARPSLVRVPREVPPHVSALFSCAMLTGAGAVFNTAQIRPGSKVAVVGLGGVGLSAILGAAAAGAAEIVAIDPFPAKMEAARAMGATLSVPADGDTVAAVRDLTAGGVDYAFELAGSVRALETAFAVTRRGGMTVTAGLPHPDDRMSLEALKLVAEERTLKGSYIGSCVPQRDLPRMLALHRRGLLPVEKMLTHRLKLDEINLAMDRLAKGSAIRQVVDLG

SEQ ID NO: 48910 - protein, 272 aa, Cryptococcus neoformans var. neoformans JEC21
MALYAPPPPSYQDHAAGPVQHHGFNPYSDNGGSILAIAGKDFSIIAGDTRQSEGYSIQTRYARKVWQLTDKVVLATNGFAADGNNFVKRVKQRLEWYEHAHNKAMGLKSIARMIQTMLYGKRFFPYYVYNILGGIEEDGSGAVYSFDPVGSYEREACRAAGAAQSLIQPFLDNQVYFKNQQPEPGAAPFVPGNLPLSTVLSLVVDSFTSATERHIEVGDGMEIYVVMAKGRSTDDLLGEGNLVPGMEVEELPSLGESGSERAFLVRMPLKRD

SEQ ID NO: 48911 - protein, 380 aa, Frankia sp. CcI3
MSLSRPSPDAIQSALATVHDPEIGRPITELDMVSSVRVLDDGSVDVGVLLTVSGCPMRDEIINRVSRAVSAVEGVREVRVDLQVMSDEQRGALHAKLRGGNAPKAIPFAQPGSTTRVYGVASGKGGVGKSSITVNLAAAMARSGLSVGVLDADIYGHSVPRMLGIDRPPTQVEKMIMPPQAHGVRVISTGMFTRGNQPVTWRGPMLHRALEQFLSDVFWGDLDVLLLDLPPGTGDIAISLAQLVPSSELLLVTTPQLAATEVAERAGTIAVQTRQNVVGVVENMAWLPCPHCGERVDVFGSGGGAAVAERLTRVLGHDVPLLAQIPVDVRLREGADNGMPLVIGEPDSEAGKALHAVAGRLTYRSRGLAGRSLNLTPVGR

SEQ ID NO: 48912 - protein, 623 aa, Vitis vinifera
MGETGKRFRSQRDQDGDNKIQKRRVNERDEKGSDELIVYRILCPDGVIGSVIGKSGKVINSIRQDTRAKIKVVDPFPGAKDRVITIYCYVKEKEEVEVDDEFNDKQPLCPAQDALLKVHAAIVNAVASLENSDKKKKDKEECQILVPSSQSANVIGKAGATIKRLRSKTRANIKITAKDSTDPSHSCAMEFDNFVLIAGDSEAVKKALFAISAIMYKFTPREEIPLDTTVPEAPPSIIIPSDVPIYPAGGFYPSADSIVSARSVPPVLAATHVPELQGYSDMGSTWPVYSSNLPVVSGYGASRSEELIIRVLCPFDKIGRVIGRGGSSIKSVREASGAHVEVDDTKADRDECLITVTSTESVDDLKSMAVEAVLLLQAKINDEDDDTVAIRLLVPSKIIGCIIGKSGSIINEIRKRTRADVRISKSERPKCADANDELIEVVGEVGSVRDALVQIVLRLRDDALKDRDTGHNTSAGTDSLYSGGAGLSVSSVLPSAPPVAPLSYDQRAETGSGLGLLSSSSLYGYGSLSVGENAYGSMSSYSSKLYGGLPTPSTFDMVIPANAVGKVMGKGGANIANIRKISGAVIEISDSKSSRGDRVALISGTPEQKRTAENLIQAFIMAT

SEQ ID NO: 48913 - protein, 546 aa, Mycobacterium avium subsp. paratuberculosis K-10
MTSVTDHTAEPAAEHSIDIHTTAGKLAELHKRREESLHPVGEEAVEKVHAKGKLTARERILALLDEDSFVELDALARHRSKNFGLENNRPLGDGVITGYGTIDGRDVCIFSQDATVFGGSLGEVYGEKIVKVQELAIKTGRPLIGINDGAGARIQEGVVSLGLYSRIFRNNILASGVIPQISLIMGAAAGGHVYSPALTDFVVMVDQTSQMFITGPDVIKTVTGEDVTMEELGGAHTHMAKSGTLHYVASGEQDAFDWVRDLLSYLPPNNATDPPRYAEPHPAGAIEDNLTDEDLELDTLIPDSPNQPYDMHEVITRILDDDEFLEIQGGYAQNIVVGFGRIDGRPVGIVANQPTQFAGCLDINASEKAARFVRTCDCFNIPIIMLVDVPGFLPGTGQEYNGIIRRGAKLLYAYGEATVPKITVITRKAYGGAYCVMGSKDMGCDVNIAWPSAQIAVMGASGAVGFVYRKQLAEAAKKGEDVDALRLQLQQEYEDTLVNPYVAAERGYVDAVIPPSHTRGYIATALRLLERKIAHLPPKKHGNIPL

SEQ ID NO: 48914 - protein, 234 aa, Picea sitchensis
MQTALVEQPQPMAVEQSTLQATIGEADMQHGTSKIAPMKPRFEPLTAYEMSGGQPEFRKVSVPAHRYTPLKKIWMEIYTPVYEQMKIDIRMNLKTRKVELKSRLDTPEIGNLQKCADFVHAFMLGFDVPDAIALLRLDDLYVETFEIKDVKTLQGEHLSRAIGRLSGKGGKTKFAIENSTRTRIVIAESKIHILGSFLNIKVARDALCSLILGSPAGKVYSKLRAVTARMAEKF

SEQ ID NO: 48915 - protein, 229 aa, Ralstonia metallidurans CH34
MSVIAANLQAVKNDIAAAAQQASRDPSGVTLLAVSKTVSPDRVREAFEAGQPAFGENYVQEGLDKIAALGDLRSRIAWHFIGPLQSNKTRPVAEQFDWVHAIDRLKIAERLSAQRPADLAPLQVCIQVNISNEDTKSGVLPEEVLALARAVAALPNLRLRGLMAIPAPAADLAAQRVPFAALRRLLEELRQSGLDVDTLSMGMSADMPAAIAEGATMVRIGTAIFGARG

SEQ ID NO: 48916 - protein, 337 aa, Bordetella pertussis Tohama I
MSSPDWRLCVAPMIDVTDRHCRYFHRLLAPRARLYTEMITTGALLHGDVARHLDFDAAEHPVALQLGGSEPDALAQAARLGRQWGYDEINLNCGCPSERVQRGAFGACLMAEPALVADCMKAMQDAVDIPVTVKHRLGLDYDESYGFVRDFVGQIYDTGCRVFVVHARNAVLKGLSPKDNREIPPLRYDVARQLKRDFPDCVIVLNGGLADAQAAQAVAGEFDGVMLGRAAWHTPRVLSEVSLQWWPAIRLPSDAQVVDAMMQYAATQIARGVPLRVMTRPLLGLVNGQAGARRWRRLLSDPVRLAANDPSLLYEAWRSLQGAPRERDACADPLPAV

SEQ ID NO: 48917 - protein, 242 aa, Glycine max
MALSSPSLFSAVNATYSVPHFHALPLSLSSSYFPINVRPSTHHVLVSDHNHKWRTKVSFFTSFLKQKGKDAKIIKEELLEAIAPLDRGADATPQDQQTVDQIARELEAVTPIKEPLKSNLLDGKWELIYTTSQSILQTKRPKLLRSVANYQAINVDTLRAQNMESWPFFNQVTADLTPLNPRKVAVKFDTFKIGGIIPIKAPGRARGELEITYLDEELRLSRGDKGNLFILKMVDPSYRVPI

SEQ ID NO: 48918 - protein, 152 aa, Bordetella pertussis Tohama I
MLKVSEILRVKGDTLYTASPDTHVSVAVQTMSEQDIGSLVIMESGMLAGMLTFREIIRHIDQHGGNVGDTTIRAIMDDAPVSVSPNTSADEVQRLMLEKHARYIPVMDGPTLLGVISFYDMAQAIVAAQQFENNMLKAYIRDWPMESAPSKP

SEQ ID NO: 48919 - protein, 452 aa, Zea mays
MDYGPSDTSGTDDDLPQLPHRSIRGSGRVSGNGRTIVPAGSYARAPTDMEAQIQQLEQEAYCSVLRAFKAQSDAITWEKEGLMTELRKELRVSDKAHRELLNKVNNDNIICSIREWRSTGGLQASMSNNPQPIHDPVPSPTTSGRKRQKTSQSVPALPAPPAMHSQQLATPTQPSSSTARKAVPPVPKGKKTKPGQKVPGGSAAKPMPSSAGPSGRGPHMNRNFPGGSAPEAQAQNVDPLVGRKVMSRWPEDNSFYEAVISDYNAETGLYVLVYDINTANETWEWVDLKEMGPEDIRWKEDDSGIDPVVYLRSRGAPSSGVRKPTGRGGPMPGSGRGRGLPKNMSRKDFPPPQNGVGKRSSDDIDILHTESLIKEVEKVFSVSNPDPQEVEKAKKALKEQEQSLIDAIARLAEASDGESDGLNRGRRNLYAGNQHQANYVDDMPVGDQADAM

SEQ ID NO: 48920 - protein, 487 aa, Bordetella pertussis Tohama I
MKWLRLQDLPTDNSFAALPAEFYTRLQPRPPAAPRLLHANAEAAALIGLDPAEFSTQAFLDVFSGHAPLPGGDTLAAVYSGHQFGVWAGQLGEVRGPAGGWELQLKGAGMTPYSRMGDGRAVLRSSVREYLASEAMHGLGIPTTRSLALVVSDDPVMRETVETAAVVTRMAPSFVRFGSFEHWSARRQPEQLRVLADYVIDRFYPECRVAGAGRLDGEHGEILGLLAAVTRRTALLMADWQAVGFCHGVMNTDNMSILGLTLDYGPYGFMDTFQLGHICNHSDSEGRYAWNRQPSVGLWNLYRLASSLHTLAPDPEALRAVLDGYEAVFTQAFHGRMAGKLGLPQFLPEDETLLDDLLQLMHQQGADFTLAFRRLGEAVRGQRQPFEDSFIDRAAAGAWYDRLAARHASDGRAAQARAAAMDEVNPLYVLRNHLAEQAIRAAARGDAGEIDILLKLLRNPYKHQPGYDAYAGLAPDWAAGLEVSCSS

SEQ ID NO: 48921 - protein, 378 aa, Arabidopsis thaliana
MSTMSDLFPDLVEEILSRVPITSLKAVKLTCKQWNDLSKDSSFTKNHYGKEAKEIQVIMICDLKACLMSVNLHNHKDLADPSIKQIGKLNQVEIDSVFHCDGLLLLLLCNPKDNSKLMVWNPYLGQTRWIQPRNNSHKHRPAGRFNHRPAGRFYMGYDSNNNHKILWFSSMYREYEIYDFKSDAWTVIDVNTDQDHIIDNQRVSLKGNVYFIAHDILKEEAFLLSFDFTCERFGPSLPLPFHCCHEDTVLLSTVREEQLAVLFQKSDAYEMGIWITTKIELNIVLWSKFLKVDMTLPNSYWFEDLSFFLVDEKKKVAMVSELDIETCKNYKTYILGENGYYREVDLRKSKGCVYLCVLMFQVWCKSSKVPVLARCERK

SEQ ID NO: 48922 - protein, 642 aa, Kluyveromyces lactis NRRL Y-1140
MFAAKRASKVLLGSAVSAAAVFGAVSMVNQSRDTNTLQNDVSVSTIKKSNVDLPSRANLLSRLSKTDKFDVLIIGGGATGTGCALDASTRGLNVALVEMNDFASGTSSKSTKMAHGGVRYLEKAFWELSKAQLDLVIEALNERAHMLNTAPHLCKILPIMIPVYNYWQVPYFYVGTKMYDLFAGSQNLKSSYLLSPSRASEVAPMLDASKLKAGLVYHDGSFNDSRMNSSLAITAIEKGATVLNYVQIKQLVKNKETGKVEGAIAVDRETGDEYQIKAKVVVNATGPYSDRLLQMDQSPTGLPDDSVLQKINENATVSTKIAVPNPKMVVPSAGVHIVLPSFYCPKEIGLLDAQTSDGRVMFFLPWQGKVLAGTTDIPMKQIPENPTATEADIQDILKELQHYINFPVKREDVLSAWAGIRPLVKDPRKADSGSGSTQQLVRSHFLFTSPSNLVTISGGKWTTYREMAEETIDEVVKVGQFNSKPCVTKKLKLVGGENWNPNLSALLSQKYHLSSAMSEHLANNYGTRAPLICELFNEDPRNKLPVALAGQENVSVFGHVDYDSFRYPYTIGELKYSLKYEYARNCLDFLMRRTRYAFLDAKQALNAVEGTVKVMGDELGWDSKKRQDEIQQATEYIKTFGV

SEQ ID NO: 48923 - protein, 225 aa, Oryza sativa Japonica Group
MATSIVDDFGDGTYTVAFDEDYIHTTVTYSGDDVDDWLDEILRIHRRRLNYLVVGLDVEWRPATYYHGPGPVAVLQICVGRRCLIFQILHADYVPDSLFDFLADGRFTFVGVGIHDDVAKLRSHHGLEVENVVDLRYLAAQTIGKPALRSAGLQGLVREVMGVWAPKPYHVRVSAWDSWNLTPEQVMYACADAFASFEVGRTHPHLPSIPKLEEAGQEWKGERGG

SEQ ID NO: 48924 - protein, 254 aa, Oryza sativa
ICKTSTSTELEIFQNAKLMASPAQVERSSSSYSQHRPRRPPPDLPSLLLHGRIVYIGMPLVPAVTELVVAQLMYLEWMNSKEPVYIYINSTGTARDDGEPVGMESEGFAIYDAMMRMKTEIHTLCIGAAAGHACLVLAAGKKGKRYMFPHAKAMIQQPRIPSYGMMQASDVVIRAKEVVHNRNTLVRLLARHTGNPPEKIDKVMRGPFYMDSLKAKEFGVIDKILWRGQEKYMADMLSPEEWDKVAGVRRPDIM

SEQ ID NO: 48925 - protein, 223 aa, Oryza sativa Japonica Group
MRLGLNLKTPKAERDLSTSIVNDFGDGTYTVAFDEDKIYTTVTDSGEEVEEWLDEIVRIHHRRLDHLIVGLDVEWNPASGFCALGPVAVLQICVGRRCLVFQIIHADYVPDQLGDFLGDGRFTFVGVGIHDDVDKLREHYDLEVENAVDLRYLAAQTIGKPALRSTGLQGLVWEVMDVWMEKPHHVRVSAWDSRQLTLDQVMYACADAFASFEVGRSLYDDYE

SEQ ID NO: 48926 - protein, 353 aa, Kluyveromyces lactis NRRL Y-1140
MDFDYENAKFSMPEKRIFDSQGTLDFQNSVAMVRIQYHLQKYITLCKGQQIPDTIKESFFTNIVVELLKRLSALIDETPPERMHSRYGNLSYRDWQTKFQNQLENWLHELLPEKYNNSIIELSYYISNAFGSKERIDYGTGHELSFLAVIICLDMLKIETIKGPALLYCFNSYYDVIQKLILTYKLEPAGSHGVWGLDDHFHFSYILGATQLLDVNTSLIPKDISNTRLMEQNSSSNLFCKSIRFINVVKSGPFSNHSPLLYNISRSVHTWHKMQQGLIKMYKVEVLNKFPVVQHFWFGTAFFPWTSYGNNHSLPIYQPAENNDDADFLTANNATTKMPPPLSTSTSRFIHRR

SEQ ID NO: 48927 - protein, 501 aa, Tuber borchii
MQLSLLWKAPTVNPVNHKAQSVPILNPFDKYGRTFFFCTFGFMIAFLSWYAFPPLMGKTIKKDLHLSQTEVANSNVLALTATLVVRFLIGPLCDRFGPRLCFAGVLLAGAVPTALAGLVTNATGLLALRFFVGVLGATFVPCQVWSTGFFDKNVVGTANGIMAGIGNAGGGITYFVMPAVFDSLVHERGLTPHKAWRVPFVVPFILIVIMALGMIFLCEDTPTGAWADRHNFSPRTIEGKIVDATRNISDAPTTDKDAKGTSYTEKDKKNSDPESASSNGSIDLETVAQSEVIQAPTFKEAMQVIFSLTMSYARGTYACSFGGELAINSIWIFYMKNFLPCETKSGRWAAMFGLLNLFCRPAGGIIADIIYRHTKSVAAKKWWLVFIGSIEGVFCLAIGLVNPHHESTMFGLVAGLAFFMDASNGASFRIVPHVHPFANGILSGVVGASGNLGGVQFFSIIFRYNGVKYDRVIMIIGGICIGINLSISWIRPIPKGQIGGK

SEQ ID NO: 48928 - protein, 602 aa, Magnaporthe grisea 70-15
MSELVSRLTDLNPFSSKTRAEREVDDEDKGEEIDDHTVAGGGHGGRSSDITKTQLRISHALRCLIASKGILTEAEAGLASQTMTPALRQLLDRPHIHVPPELTDRSHPLPEYFVSSSHNTYLVAHQLYGTSCATAYRTALRTGSRCVEIDAWDNGDNRSEPKVTHGYTLVSNIPFRLVCETIRDVVDEEAAQAQKLPVGADAAEREDERYRPAPILLSLENHCDAAGQLRLVEIMREVFGHRLLDKPVRDKGHAEQEGSGEHVRLDELGSKIAVIVEYHLSEEAELSDDEDDSSSCDEAERKDREQYKAEAKATRETIIIPELEELGVYAQSVKLANDAWFDATEQARDQTQPLALPHHHLINISESGLSRHLPEAAGKIAAHNAQHLMRVYPKGTRISSRNMKVIPFWAVGAQICAMNWQTFGANMQMNEALFAGTDGYVLKPQALRSGGSGVTKPRRRRLRLHVAGASDIPLPSGREPDEIKPYLTCTLAYGGTSLKEVKRKTSPYKQHKVGFLHRGENPPPTDPVWDEELVWDEFEDDELVFLRLYIKSDDSFARNPILTVAPIRLLYAVDGWTFIRMLDLKGHETRCALLVRFEIEDL

SEQ ID NO: 48929 - protein, 416 aa, Vitis vinifera
MALATRRFFNTICRGTRSFGALPEGIPSSSQHLINLEYEYSAHNYHPIPIVFSQAKGSTIWDPEGKKYLDFLSAYSAVNQGHCHPKVLKALVEQAERLTLSSRAFYNDRFPIFAERLKNMFGYDMVLPMNTGAEGVETALKLARKWGYEKKKIPKDQAIIVSCCGCFHGRTLAVISMSCDNEATRGFGPLLPGHLKVDFGDEVALEKIFEENGDRIAGFLFEPIQGEAGVIIPPDGYLKAVRELCSKFNILMIADEIQSGLGRSGRMLACDWAEVRPDVVILGKALGGGVIAVSAVLADKDVMLSIQPGEHGSTFGGNPLASAVAVASLDVITEEGLSERQEICYLMNQLMKIHQLFPNLIKEVRGKGLFNAVELNSKVLFPVSAYDICLKLKERGVLAKPTHDTIIRLTPPLSIR

SEQ ID NO: 48930 - protein, 426 aa, Saccharomyces cerevisiae YJM789
MSHQNQLIPQAYISNFHNRLTNEDDGIPIFTMAQQTRQHKRAKVVNYAEYDNDLFDEFNMNGSNFNNADTHYKDNAVSHENTPALTNGVTMDGSEYNVLENMNGADSIISNNKYDAGSNMVVESLSGLNNNNNASNGPSNKAQAQDIGNAVLPDLQDQHHNPFNILRYPKIRDTFINGKVVSPYRLNTDQETKANANSGEAIMIPITLDIEHMGHTIKDQFLWNYNDDSISPEEFASIYCKDLDMTSATLQTQIANIIKEQLKDLENIAATEIMSDLHVIINLTCNLQDRFFEDNFQWNLNDKSLTPERFATSIVQDLGLTREFIPLISQSLHETILKIKKDWVDGHLIQDHVPNDAAFGYLSGIRLDIDELGSNWCPRVEILTKEEIQKREIEKERNLRRLKRETDRLSRRGRRRLDDLETTMRM

SEQ ID NO: 48931 - protein, 734 aa, Crocosphaera watsonii WH 8501
MKNCYCINPYCREPNHPSNNNTQTKFCGSCGSILLLNNKYRVSRLLSDNSGFGIIYEAFAGFNSKILKVLQEKWNNDTKAVELFRREYDVLLSLTQQNITGIPQAEDYFQYQNREGKIFYCLVMEKVEGIDLEKWVKKDNKLHQKQALNCLREVTLILDKIHQQNWFHRDIKPANIMKRNNGKLVLIDFGTAREETQTYYQKVKGESITGINSPGYTPNEQQHGQAVVQSDFFALGRTFVHLLTGKHPSDLYDALNDEFKWRGEIKDIDPLFLDLIDHLMQRFPKHRPKNTRVILEKLDEIEKKINPPPKPIKKQPQVIAKIPQPTVKQKPSQVISNKSQGVIKKKTPKKKEHIFVRVIKTGLISTSIFGVLAFILVEGYVLFKYKYNILKNFTYPINLLYDFKLLSSDIRSSRFLDKTIRGHFKSVNSVAYSPDGKYLASGSWDNTVKIWEVKTGKLIRTFEGDFSSVAYSPDGRYLATYREPDFDTIENPIKIWEVKTGKLLRTLKGHSKGVHSIAYSPDGKYLAISNWENPVKIREVNTGKLIRTFEGYSILVAYSLDGKYLATESENTIKIWEAKTGKLVRTLTGHSDSVVSVAYSPDGKYLASGSWDNTVKIWEVKTGKSIRTLTGFSGWLSSLTSISYSPDGKYLAARCNIARVSHDSMLDDTVKKWDVGHPICTWEVATGKVIQTLTGHASNINSVAYSPDGKYLASSSSDRQIKIWRVEQITCVGA

SEQ ID NO: 48932 - protein, 317 aa, Triticum aestivum
IDRMFKDAITAGKRVRSETNISCGAVSVSSAAVELALMKLPKSECLSARMLLIGAGKMGRLVAKHLAAKGCKKVVIVNRSVERVDAIREEMKGIEIVYRPLTEMYEAAADADVVFTSTSSESPLFTKEHAEALPPVSGALGGVRLFVDISVPRNVSACVSDVGHARVYNVDDLKEVVEANKEDRIRKAMEAQTIISEELKRFEAWRDSMETVPTIKKLRSYADRIRASELDKCLQKIGEDALTKKMRKSIEQLSTGIVNRLLHGPLQHLRCDGTDSRTLDETLENMHALNRMFGLDTEKAVMEQKIKTKVEKQQTQN

SEQ ID NO: 48933 - protein, 273 aa, Ralstonia metallidurans CH34
MLDSLTFGFLGGGNMASALIGGLVARGVPANAIRVVDPFEDARQRLATTLGVQTLAAPDAAFGASNVIVLAVKPQQFKDAVGALAPQLKNSLIISVAAGIRLQDMQRWLGTNRLVRAMPNTPALAGMGMTGLAAAPGLSDEDRAIAKAVAEAVGQCVWVEGDDQIDAVTAISGSGPAYVFYFVEAMERAAIEMGLSAEQGRKLAVETFRGAAALAAESSEPVSTLRERVTSKGGTTYAALTSMDASGIQDAFVRAMLAAAARGREMGAEFGKD

SEQ ID NO: 48934 - protein, 419 aa, Rhodobacter sphaeroides 2.4.1
MTVLLDTLPNGFRIVTEHMPGLHSASIGIWIAAGGRHERPEQNGIAHFLEHMAFKGTKTRSALRIAEEIEDVGGYINAYTSREMTAYYARVLEADTGLALDVIADIVLNPVFDPKEIEIERHVILQEIGQALDTPDDIIFDWLQEASYPGQAFGRTILGPEERVSTFGRADLTRFVGEHYGPDHMILAAAGGVDHGRIVAQAQALFGHLKPVGQRPMQPADFLGGERRELKSLEQVHFAMAFEAPNYRAPDVYAAQVYAMALGGGMSSRLFQKVREERGLCYSIFAQSGAYEDTGQITIYAGTSGEEVADLAGLTVDELKRATEDMSEAEVARARAQLKAGLLMGLESPSNRAERLARLLAIWGRVPGVDEAVEKIDAVTVGAVRDYAERMAQARSALALYGPAEAAPALAQIRERLAA

SEQ ID NO: 48935 - protein, 422 aa, Thermotoga maritima MSB8
MRIDEIVEKYVDRKTQRRFLILTSIAWMFDAAGVMLLSFVLPYVIKEWNLTSTQGATIASATFLGMLFGALSVGFVADLLGRKVSNLFFFIVTITFTFLSGFSSSFETLLVLRGLSGFGYGGLMPSFNAYLAEFTSIRLRGRYLVLLESSWAVGSILIGLFAVNVLPNWRWVFWIFSIGYLFVPVFLRMPETPKYAFLKGGKEALERSLGKRVEEEVELPKKEKVPILALLKREHLKDTVVIWIAWFVVSFVYYALFTWAPRIFSSLGVSVVKSSWFTFYMMVAQLPGYLSAAYFIEKWGRKASLGVYFIGTGLAALLWANVRGDASLLAAALVLSFFCLGVWGLVYAYTPELYPTSLRGTGNGAAGVWARIAGIIAPYYTGFMMEKGKSIAETLAWISAMAMFAGVIVLIFGRETKGKYVD

SEQ ID NO: 48936 - protein, 254 aa, Rhodopirellula baltica SH 1
MSRRILIAGNWKMNMRAESGASLAKGIVDAVGKSPAVEVVLCPPSVYLSGVADAVVGTPVELGAQNLYAAEDGAFTGEVNASMLTDVGCRFVILGHSERRQLMGETDACVAKKLHAALAGNLVPIVCVGETLEQREADDTESVIETQIRGSLEGLDEARAANIVIAYEPVWAIGTGKTASKEQAEAVHAFIRELLGKMFSTEVAEQIRIQYGGSVKPGNAEELLSQPNIDGALVGGSSLKVDDFAGIIKAAPSA

SEQ ID NO: 48937 - protein, 402 aa, Silicibacter pomeroyi DSS-3
MLHRRGIMAAPLKRRIGLGLLTAYGVGVMVGAGIYVLVGAVAGDAGVWAPVAFLLAGLIAAPTALSYAEFSTRLPEAAGEAAYVGTGLNSQSLALLVGLAVVVAGTVSAGAVLRGGVGYLSAVTEINPVWAMIGLGGALTLVAVAGVLESLALAAVFTVVELAGLALVVWAGLGADPSPDWVAPAPPVWTGIGLGGVLAFFAFIGFEDIVNMAEEVEAPERTLPRAILISLVVTSVLYALVAWAAVRAVPLDVLGQSESPLALVWQYGRGSGAGFLSAIAVFAALNGILAQIVMATRVLYGLGGRTKALALFHTAHPRFGTPVLATFLVGAAVIFCALYVPVETLAETTSSILLAVFALVNGALIVQKRRAPEARFRVPMAVPVLGLVLSLAALSVAVRGIL

SEQ ID NO: 48938 - protein, 468 aa, Thermotoga maritima MSB8
MAKGSKGFIVSIMGPVVDVKFPEEELPDIYNALEVVNPQTGQKVVLEVEQLIGDGVVRTVAMDSTDGLTKGLEVVDTGAPITAPVGKEVLGRILNVIGEPVDEAGEIKAKERWPIHRPAPELVEQSTEIEILETGIKVIDLLAPFPKGGKIGFFGGAGVGKTVLVMELIRNIAIEHKGFSVFAGVGERTREGNELWLEMQESGVLGNTVLVFGQMNEPPGARFRVALTALTIAEYFRDVEGRDVLLFIDNIFRFVQAGSEVSALLGRMPSAVGYQPTLATDMGELQERITSTRRGSITSVQAIYVPADDITDPAPATTFAHLDATVVLSRRIAELGLYPAVDPLDSSSKILDPAIVGREHYEVARGVQEVLQRYKDLQDIIAILGVEELSPEDKLVVHRARRIQRFLSQPFHVAERFTGRPGRYVPIEETIRGFKEILDGKLDDVPEQAFLMAGNIDEVKERAKEMRS

SEQ ID NO: 48939 - protein, 167 aa, Brassica napus
LAPIFYIFKNDPDKGNAAYAEADAFFCFVELMSGFRDNFCQQLDNSVVGIRYTITRLSMLLKHHDEELWRHLEVTTKINPQFYAFRWITLLLTQEFNFVESLHIWDTLLSDPEGPQETLLRVCCAMLILVRRRLLAGDFTSNLKLLQNYPPTNISHMLYVADKLRSK

SEQ ID NO: 48940 - protein, 366 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCG

SEQ ID NO: 48941 - protein, 751 aa, Silicibacter sp. TM1040
MPKAKITDEEALAFHLEPSPGKWEVTATVPMTTQRDLSLAYSPGVAVPCEAIAENPETAYDYTNKGNLVAVISNGTAVLGLGNLGALGSKPVMEGKSVLFKRFADVNSIDIELDTEDPDEFIKAVRLMGPTFGGINLEDIKAPECFIIEQKLKEEMDIPVFHDDQHGTAVICAAGLINALHLSGKKIEDVRIVLNGAGAAGIACIELLKSMGARHENCIVCDTKGVIYQGRTEGMNQWKSAHAVKTELRSLEEAMNGADVFLGVSVKGAVTQDMVKSMADNPVIFAMANPDPEITPEEAHEVRVDAIVATGRSDYPNQVNNVLGFPYLFRGALDIHARAINDEMKIACAHALARLAREDVPDEVALAYGKSLSFGRDYIIPTPFDPRLIHRIPPAVAKAGMDTGVARRPIIDMDAYEHGLRGRMDPTQSILRGLNARARAAQSRMIFAEGDDPRVLRAAVTYQRSGFGKALVVGRQDDVKAKLEEAGLGDAVRELEVVNAANTHHFETYKDFLYERLNRKGFDRKDIHRLVGRDRHVFSALMLAHGHGDGLVSGATRKSAHVLDRINHVFDADAEHGAAGVTALLHKGRIVLIGDTLVHEWPDENDLATIAERAAGVARHMGLDPRVAFVSFSTFGYPVSERAEKMHIAPTVLDKRGVDFEYEGEMTVDVALNAKAQEHYPFQRLSGPANILVVPARHSASISVKLMQEMGGATVVGPILSGVDKPIQICSTTSTANDVLNMAVLAACNIG

SEQ ID NO: 48942 - protein, 332 aa, Triticum aestivum
MGNCKSSSRARLGKAHVVPDSEWRMQDFGKTHVPDLEWRINDFSSLLETGAKSAKSDAFHCSGYNWYLQVSPMHKETGSETPYVALCLKTSQPSMVPGHTVHVVFELSIYNHTKGMYCGCKDTYNFHFKNTYSKEQCLIPLQELLKSSAFLVDDSCVFGVEILKIDVSSPEKKAVVVQKKDTTVQNLFVQKKGFVKGTYTWNMNNFLELDSDHFVRSPTFEVGGHKWYVCIYPRGDKYSTDCLSLYLYLDASDELRLESKKVVVMTLSILDQKNGKHLTATSGLLVFTGGRGWGWADFLGLKNLKDPAGGYVVGSSCVVKADLTIVGSSNDG

SEQ ID NO: 48943 - protein, 607 aa, Streptomyces avermitilis MA-4680
MPVSVTLPALGESVTEGTVTRWLKAEGERVEADEPLLEVSTDKVDTEIPSPAAGVLASIKVAEDETVEVGAELAVIDDGTGAPAAAPAPAAEQAAEQVAPPAPEPAPQATPSTEQAAPAPAPTAEAAAGAGSAEGTDVVLPALGESVTEGTVTRWLKEVGEEVSEDEPLLEVSTDKVDTEIPAPASGTLLLEIVVGEDETAEVGAKLAVIGAPGAAPAAAPAQAAPAPAAAPAAPAPAPAAPAPAAPAPAPAAPAPAQAAPAAPAAPAQAAPAPAAPQAPAAPAPAPVTPAAAPAATSGDDGAYVTPLVRKLAAENGVDLATVKGTGVGGRIRKQDVTAAAEAAKAAAPAPAAAPAAAKKAPALEVSPLRGQTVKMPRIRKVIGDNMVKALHEQAQLSSVVEVDITRLMKLRAQAKDSFAAREGVKLSPMPFFVKAAAQALKAHPAVNARINVDEGTITYFDTENIGIAVDSEKGLMTPVIKHAGDLNIAGIAKATADLAGKVRANKITPDELSGATFTISNTGSRGALFDTIIVPPNQVAILGIGATVKRPAVIETEEGTVIGVRDMTYLTLSYDHRLVDGADAARYLTAVKAILEAGEFEVELGL

SEQ ID NO: 48944 - protein, 290 aa, Silicibacter sp. TM1040
MAIWNLGSINIDMVYSLPHMPQPGETLAATSFDQGLGGKGANMSVAAARAGAHACHIGAIGPEGKWCVDRLMEYGVDTRHIVQSDTATGHAIIAVDPAGENQIILYPGANRGLGADQIGQALSAANAGDILLMQNETNMQAEAAEMGRKLGLRVAYAAAPFDAAAVQAVLPFVDLLFLNEVEAAQLQDATGKPPQDLGVDDVIVTLGAEGARHFDGRTGAVSDVAAQKVTAVDTTGAGDTFTGYVLAALDRGLPMAQAMAQASRAGALMVTRHGAADVIPDLKEVQDAKF

SEQ ID NO: 48945 - protein, 227 aa, Triticum aestivum
  misc_feature (171)..(171): Xaa can be any naturally occurring amino acid
  misc_feature (184)..(184): Xaa can be any naturally occurring amino acid
  misc_feature (220)..(220): Xaa can be any naturally occurring amino acid
MLSTLRVASRRAARPAQYNLAAIRAASNWANVPQGPPDAILGITEAFKADKFDKKINLGVGAYRDDAGKPYVLPSVREAEMKVVESKLNKEYAGITGVPEFPPAAAKLAYGANSPALDRITITQTISGTGALRVGAAFLAKFFPGEKKIYIPQPSWANHKAVFNHAGLRVXEQYGYYDKKTIGXLDFEGLIADVKSAPNGSVFLFHACAHNPTGVDPTQXQWKQISD

SEQ ID NO: 48946 - protein, 248 aa, Triticum aestivum
  misc_feature (9)..(9): Xaa can be any naturally occurring amino acid
  misc_feature (52)..(52): Xaa can be any naturally occurring amino acid
  misc_feature (196)..(196): Xaa can be any naturally occurring amino acid
MCTLERRGXRVFVLTLTGEDQHRLGHPLIAAIRSALAEVLAAAQAQPQGPGXAALVTVAEGRFFSNGLDIGWAGTSRARLGELVDALRPVAADLLALPMPTVAAVTGHASAAGFLLALCHDYRVMRADHGVLYMSEVDIGLPLPPYFVHVLRAKISQAQALRARGAAPGRSSGRPRAREMGVVDVVCPGAPETAAXEALKLAEQLAARKWDGAVYASIRMSMFPDACRAVGIAVESDEEKSRHFASRL

SEQ ID NO: 48947 - protein, 438 aa, Glycine max
  misc_feature (281)..(281): Xaa can be any naturally occurring amino acid
MSSFSGAIQRPLVAAAAVAVASFSADLSDKLPSRDCSTSDLAHSTPCSNIQESDSSWVSHISDSKLANLSFVTQIPVPVPNVQFRVPSLGQNCVSNLYHSSVASSPLLRNLYHSADLPRVSRSAAYSHGISNSTSEAEVMYKWHLPELNALDDSSCSLTKSRTVVVLLGWLGARQKHLKKYAEWYTLRGFHVVTFTFPMGEVLSYQPGGKAEQNVHLLVDHLAEWLEGESDKNLVFHTFSNTGWLTYGVILEHFQNQDPTITERIKGCIVDSAPVAYPDPXVWASGFSAAFLKKNSVATKGRVFSDQSGIKVSIGSEDDLGLKPALTEAALLLILKKFFEIILDLPSVNRRLSDVMSMLSSKQPSCPQLYMYSSADRVIPADSVESFVEAQRRAGHDVRACNFVSSPHVDHFRNDPRLYTSQLSQFLEECVLSRCKSY

SEQ ID NO: 48948 - protein, 220 aa, Streptococcus pyogenes M1 GAS
MSTLKIAPSILAADYANFASELARIEETDAEYVHIDIMDGQFVPNISFGADVVASMRKHSKLVFDCHLMVVDPERYVEAFAQAGADIMTIHTESTRHIHGALQKIKAAGMKAGVVINPGTPATALEPLLDLVDQVLIMTVNPGFGGQAFIPECLEKVATVAKWRDEKGLSFDIEVDGGVDNKTIRACYEAGANVFVAGSYLFKASDLVSQVQTLRTALNV

SEQ ID NO: 48949 - protein, 355 aa, Staphylococcus epidermidis ATCC 12228
MLTVNQVKEIVGALKDPIIDVPLRESEGIVDVSIKDNINHVSVKVAMAQLGGQPQLDLQMAIVKALKENGANTVGIRFEELPSEVVERYIGKGSEKPKTIEELLSQNNPVEFISIASGKGGVGKSTVAVNLAVALAREGKKVGLVDADIYGFSVPDMMGIDERPGIDGKEIIPVERHGVKVISMAFFVEENAPVIWRGPMLGKMLTNFFTEVQWGELDYLLLDLPPGTGDVALDVHSMLPSSKEIIVTTPHPTAAFVAARAGAMAKHTEHTILGVIENMSYFESKETGKKEYVFGKGGGKKLSDELETQLFAELPLEQPTWNPNDFSPSIYQSDDRLGELYTLIARKVIASTQKQ

SEQ ID NO: 48950 - protein, 415 aa, Bacillus halodurans C-125
MGKIQIEDIIIANQTLKDVVVHTPLQKNQVLSERYECNVYLKREDMQVVRSFKIRGAFHQISSIPKEELNNGVVCASAGNHAQGVAYSCHTLQIPGKIFMPTTTPRQKVDQVKFFGKEYVEVILTGDTFDDSFNEAKEYGIKHKMTFIHPFDQEKIVAGQGTVGMEIMNDIDDNIDYLFCSIGGGGLISGVGTYIKSISPRTKVIGCEPAGAPAMKESLKQGKVIELEKIDKFVDGAAVKKVGEIPFEICQKILEDIVLVPEGKICTTILNLYNQDAIVAEPAGAMPIAALDFFKDEIKGKTVVCVLSGGNNDIGRMQEMRERSLIYEGLQHYFIIQFPQRAGALKEFILDVLGPDDDITRFEYTKKNNKSNGPVLIGIELKCDEDYHRLMDRLNKKGFEYREINKNESLFNLLI

SEQ ID NO: 48951 - protein, 133 aa, Zea mays
KQSDINSTVTTNAHKQHHMSKGHMTYTSASFAYRLSHISPNPDSSDHDLLTARTEVDKAARASPYIYSGGRRLVCLGEHLAYLHIKAIWTHLLRNFELELVYPFQENDCHDMVDGIKADVMVHYKRRKLDVDN

SEQ ID NO: 48952 - protein, 285 aa, Populus trichocarpa
MAKDMEVAEAGSFSAKDYHDPPPAQLFDAKELTKWSFYRALIAEFIATLLFLYITVLTVIGYKSQIDGSADSCGGVGILGIAWAFGGMIFVLVYCTAGISGGHINPAVTFGLFLARKVSLIRAVMYMVAQCLGAICGVGLVKAFQKSYYKKYGGGANTLADGFSTGTGLGAEIIGTFVLVYTVFSATDPKRSARDSHVPVLAPLPIGFAVFMVHLATIPITGTGINPARSLGAAVIYNQDKAWDGHWIFWVGPFAGAAIAAFYHQFILRAGAVKALGSFRSAQRF

SEQ ID NO: 48953 - protein, 178 aa, Rhodobacter sphaeroides 2.4.1
MTHKSVRDYIRTIVDFPHEGILFRDVTTLFADPRGFRIAIDQLLAPYAGMRFDKVAGLEARGFILGGAVAHRLSTGFVPIRKKGKLPGRTISVSYQLEYGEAVVEVHDDAIQAGEKVLLVDDLLATGGTAEAGIKLIEQLGGQVVGCAFVVDLPDLGGRKRLEAMGMEVHALCAFEGL

SEQ ID NO: 48954 - protein, 312 aa, Vitis vinifera
MKTENLRGLGLIGQHKLQACKPVLTPGWVIATFLLIGAIFIPVGLVSLHASQNVVEIVERYDAECIPEKYQSNKVAYIRDSSIPKNCTRYLKVHKHMKAPISVYYQLDNFYQNHRRYVKSRSDQQLLHGLKYNDTSSCKPEQLNNGLPIVPCGLIAWSLFNDTFNFVRRSEEMKINRKNIAWKSDRDHKFGKEVYPFNFQNGTLIGGGKLDPRIPLSDQEDLIVWMRTAALPSFRKLYGRIEEDIDADDVIVVHLSNNYNTYSFGGKKKLVLSTSSWLGGKNNFLGIAYIFVGSSCIFTSIVFMLLHVKNPR

SEQ ID NO: 48955 - protein, 221 aa, Brassica napus
MGNVTSNVAAKFAFFPPTPATYGVSKDEETGKLTFTGVTPEKSMEVHQVTTKSGNKVVATFWKHPFARFTLLYSHGNAADLGQMVDLFIELRAHLRVNIMSYDYSGYGASTGKPSESNTYHDIEAVYNCLRSEYEIQQEEMILYGQSVGSGPTLYLASRLKRLRGVVLHSAILSGIRVLYPVKMTFWFDIYKNLDRIRHVACPVLVIHGTKDEVVNMSHGK

SEQ ID NO: 48956 - protein, 215 aa, Frankia sp. CcI3
MKNVVLRDIDRFVYYDNDGRRPRSIGASRIAAVLNNPGLQAILVYRFGAFVASPQKGVAGAAGRLLGTVVYRVLSRVSQIVTGIWISPAARIGPGFFIAHFGGVIIGACEIGENCNVGHDVTIGKSGTGEKFGRPTIGDRVSIGTGARILGRLEVGDDALVGANAVVTRSLAARSVAVGAPARVVSSRGAFEYVEYFGMVRDEARRASLGLVSSP

SEQ ID NO: 48957 - protein, 403 aa, Debaryomyces hansenii CBS767
MVQYEFFGDLTLAPKDEMNDLKIKLENCQSSKVDVSAGVYRGENGESYTLSSVKAAKGVLHANDPGHDYNFTLGIKNFNLMAADIIFGKDISTGGYIATCQTISGTGACSIAIKFLVDCCKLTNFYIGTPTWPNYAPMIKAANAEVVEYVHYNPLTRSLDFESVLEAISKAKMHSVFILQLCCHNPTGTDFSIDQWKILADKMQEKKIMPVFDSAYQGFGSGDIAVDAKPIRLYYAKGLQFLVCQSFSKNLGLYSERVGALHVVVCEKKLAEIVSDQLRSIFRRECSSAPAYGARLAVIIANDPKLTEQWRNDLRTIYKRLVDKRIELHDLLIKYQTPGSFDHLLNQNGLFWFSGLSKVQCKLLVEEYHIFIPSNGRVNIAGLNNSNIHYFAKSFSEVIKISV

SEQ ID NO: 48958 - protein, 459 aa, Physcomitrella patens subsp. patens
MLTRVGGLHCTGSFWTASAHVITAVIGSGVLSLAWSMAQMGWVAGPLVLLLFSFVTYYTSSLLADCYRHPDPVTGKRNYTYMDAVKANLGPRQVLLCGVVQYANLLGTSIGYTITAASSMVAITRSDCFHHKGTKGPCQASNIPYMSMFGFVQIILSQIPEFGELWFLSVLAAVMSFLYSTIGLGLGIAKAVDHQHGYGSITGISVGDPSVGYVSMSNKIWGICSALGNIAFAYSFSMILIEIQDTLKSSPPENKTMKRASLFGIITTTIFYMSVGCAGYAAFGDNAPGNLLTGFGFYNPYWLVDFGNACVVVHLVGAYQVYTQPLFAFFENTLSSRWPKSQFIHKEYYLKVPWGEPLHFNLFRLVWRSMYVVVTTVLSMVLPFFNDVMGLIGAFAFWPLTVYFPVQMFIVQRQVQRWSPKWCWLHLLSVSCFAVSLAAALGSSECMISDLKKYKPFQG

SEQ ID NO: 48959 - protein, 138 aa, Zea mays
  misc_feature (18)..(18): Xaa can be any naturally occurring amino acid
  misc_feature (70)..(70): Xaa can be any naturally occurring amino acid
SRAEHVQPCELAVRQNVXGLARDALICQENGLVPIVEPDILTDGGHDMGTCAGATERVLAALYESLSDHXVLLEATLLMTNMVTLGYDSPKVSAHEIAEYTVAVMRCTVPSAVPWVLILSGVHIEEDATHNLYSMNKL

SEQ ID NO: 48960 - protein, 287 aa, Populus trichocarpa
MQGEEVSIEELASNLSTYKEQLHQVRQLLVDDPGNSEYVDMEKELIEVIALTEELLETAKQNEISGSHLGTGASASPGYAEPQEADQHEKFPIGSKVQAVWSEDGEWYDATVEDLTPNGYYVTFDGWGNREEVDPDNVRPVEFNALLEAEKVAEATKQAIKRKIAQAASVDFQSRTLPAKLRIEPDDSEDVKAAKRKKIHSFKSKMRFEQLEVAQNKRQNAWQQFQTTKGKTKKVGFFSGRKRESIFKSPDDPNGKVGVTGSGKGLTEFQKREKHLHLKDGSVEIDD

SEQ ID NO: 48961 - protein, 1000 aa, Ostreococcus tauri
MGGRDDPRAARSSRTARNGHDDDDDDDDDDDGRASRPRECSVEEEEKEEAETELNAWGIPVRRYTEEDIMRQKFVETIHRVEWRDRRGGGFRNPDDVDELRWNESDDENDEMELVKIIRRIEAENDGEQDEDEGTSSARDVVGDSARAETEDVTRRNREPGAYQTLLFRDRATEADATAEERAQYFETRMKNMRGVPPDLHRFVKPVAIELPIGSRVKKVSGGDDHALILLESDPEVLEVIDPTYTEHEGRVLVMGSDEFSQLGLSTSTAQDIPVALDTLGEARAADIAAGAKHSVVVTLAQECATWGKDTSGCTGHGLSGTNRTHDVPRWMYWMTNATTKVVSCAAGDAHTFLKTASGHVYSFGSGTYGQLGHGDGETYAKPKLVEPIYKLSVSSIACGGNSTLILTNDGLVYGCGSNSHGQLGSGDFTSVFLPRRLAHNELVGGVPTTIDIKELYMDSHDIERRFVEEMAALTVKSDSKTRTTENIQSKVVQVTMGKAHTVLLSERGRVYVCGRGDRGQLGLGTTENRCSVTLVSSIVNVRISQIAAGEAHTVMMTTLGDVFVCGSNDFGQLGDGSVKSCSDPQKMQPTISMTDRVALKKSEIDDLLRHPLYGIQAKQVYASKSSTFIVTQDSNTLYICGSGAFGHPTNTTPTNLSALTQEPLTKWNETQVLVMGSTFANLKLDEHIFNNLVKQMVMYGPYPEHVLAHVFKTGFEEILLHPHMCSVYVNMINAIDKHSKGCTSLSFRRVIMHGIEDIGVRLLKCRNEAQRRRLLSHLGPVSFQKLQSRDVKFDLQKKLNSFIMDIPPVLTLNRLVRELEEAKILLAEDLDDMASGFLGSAHSISLIDSVDAGHKVELFKAIANVKKKAKGALEVDRHTGNMRTKERVPDLLSTAAEEASWGSATYGREDPNTWKVYKENSLKERELKALTHGITAEGKKSGNKVSVDAESMLSASTRAVRRVKIADGPMKDLHQTSRTSSVADIVSRLRQKQYASEYF

SEQ ID NO: 48962 - protein, 585 aa, Oryza sativa
  misc_feature (120)..(120): Xaa can be any naturally occurring amino acid
  misc_feature (176)..(176): Xaa can be any naturally occurring amino acid
MAQVVAAAGTAAAVAAVGRPLVGGGSGADALRPAVRLSFAPRWCGGSAGAARARRESAVTSVISRAPRLDAEVLPVSADDDADVKEEENFQHLKAIQQLATSANGVWSKPNVRRKTKIVXCTIGPSTNTKEMIWKLAEAGMNVARLNMSHGDHASHQKVIDLVKEYNAQTKDNVIXAIMLDTKGPEVRSGDLPQPIMLETGQEFTFTIKRGVGTETCVSVNYDDFVNDVEVGDMLLVDGGMMSLLVKSKTEDSVPGLQEFGTRLKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQVRKV

SEQ ID NO: 48963 - protein, 548 aa, Ostreococcus tauri
MELRAHGTIPRKKPVLVCVLDGWGENAIEDEHNAVHVAKTPTMDGLKARGPSRYRTVKAHGTAVGLPTDADMGNSEVGHNALGAGKVIAQGASLVDIALETKNAFSDAGWSYIKPAFANNTLHIIALLSDGGVHSRTDQIFGMMRGAVADGCKRLRVHPLTDGRDVADGTCHEYMEKLVAELDSYAAQGCDAKVASGGGRMAVTMDRYEADWAMVERGWRAHVLGDAPNKFTCPKEALKELKKDGTTDQYIAPFVIVDEAGKAVGTIEDDDAVVIGNFRADRVVEISKAFEYVDFNEFDRVRFPKTKFVGLMQYDGDLKLPANYLVPPPLIERTSGEWLAKNGLKTFACSETQKFGHVTFFWNGNRSGYFNEALETYVEIPSDNVPFNQAPLMKAREITAAGKEALLSGKYDVVRVNYANPDMVGHTGDMKATVAACEECDACVKELLDLVEELGGMFLVTADHGNADDMVQRDKKGNALTDKATGALLPLTSHTLAPVPVAIGGPALPESVKFRDDLPDAGLANVTATYINLMGFQAPAEMEPSLIA

SEQ ID NO: 48964 - protein, 436 aa, Oryza sativa Japonica Group
MAAAKRPYCKPPPPTTTTTAITSSSGQNHKRLRPSLPAAAAMDGGMEEEAVAPPPPTTMTTTTPPQPLLPGLPDHLAQLCLSPLPPRLLHAVCRPWRRLMYAPSFPPFLSLYALLDDADADAGVSFAAYDPLAGRWDALPSPPMPSPPPMLWHPSFLARRLPLQSVAAAGRLVLVSGSTQSLHPALSRPLVFDPAAPTPRWQLGPRIPLSPRRWCAAGAARGRVFVAGGVGAGYDPAVARSGATWDPAASPPPAAAWEPIPPLRDGRFSRDAAEAVCSGGKVCMVNLRTPGAKEGAVFDLRAGRWEDMPPGMLAGWKGPAAASPPDDGETIYVVDEERGALTAYDWGADRWRTVAESDRLKGAAEMTVAGGKACVVAPGGGKVLIVDVTPPPPPPPAARRESWAAPPPPPRMWEVAAPGGKRVVSLHVLPRMTRPE

SEQ ID NO: 48965 - protein, 98 aa, Oryza sativa Japonica Group
MRKRERENPCGICGHYHKYELGEVCGVCGHRPPASAGAQAAAGAAQAAAPRQDSAFPSEILKDFLFLGSYDNASRSELLKTIGISQNPKLPPPVLGMP

SEQ ID NO: 48966 - protein, 329 aa, Ustilago maydis 521
MSTIQALQIQSQGGPEVVQVRCIPAPTLSGSGQVIVRNEYAGVNMIDTYHFGGLYPLKCPIVIGQESAGVVEAVDADVTSVAVGDRVVQYGGGSYTEKQLLNAERVIKLPESISTKTAAAAYLQGLTALTLLKEAHPVKQGDWILVTAAAGGVGLLLCQMGKAFGANVIAVTSTEEKCQLAKQHGAIHALRYNKQDPAQYIAAIKHITQDHGVDAILDGVGADTWESNFEIAARKATIVTFGNASGPVPAFAPLKLASKNLKVVRPTLFNYVTTREERERYSQELFDLIQQGNVKINVHEEYPFTTEDMRRAFADIKSRKTTGKLVVKM

SEQ ID NO: 48967 - protein, 249 aa, Zea mays
MAKTKTKESKAKVAEPLSTVKAGGITKPSKSSKSKSKELAKAAAKKVTKEKDTKKSKKKIEPESSSESESESESESEASDSDSDSSSSEEEKKVTKKTVSKPKAKAAESSSESESDSGSDSDSDSDSESEDEKPKAKAAKTNGTAKAAAPAKKAESSDSSDSESGSGSDSDSDSDSDDESEEEKPKTKATEKAAEKKADSSDNSDSDDSEDDSDDSDSSDSDEEAGAKIEKTEEAPSKKRKAEDDGDAD

SEQ ID NO: 48968 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 48969 - protein, 408 aa, Silicibacter sp. TM1040
MTNFRTQAKAAEAAMRDVFPPTPLQRNELLSQRFGAEIYLKREDLSPVRSYKIRGALNAMRKQTSKDLFVCASAGNHAQGMAYMCRQMDKRGVIFMPVTTPQQKIQKTRMFGGDNVEVHLIGDYFDDTLSAAQAWCAEKGGYFLSPFDDADVIEGQASIAVEIEAQLGKAPDHIVLPVGGGGMSSGVVRYFGEDVHALLVEPEGGACLKAALEAGHPTPLNRVDTFVDGAAVGKIGERPFDILRSVPLPDVLTVSEDRICTTILEMLNVEGIVLEPAGALAVEALGDLRTWIKGKTVVCLTSGGNFDFERLPEVKERAQRYSGVKKYFLLRLPQRPGALKEFLNILGPDDDIARFEYMKKSARNFGSVLIGIETKRPENFAPLFAQLDAAGFTYTDITNDETLAQFVI

SEQ ID NO: 48970 - protein, 390 aa, Methylobacterium extorquens
MDVHEYQAKELLASFGVAVPKGAVAFSPDQAVYAATELGGSFWAVKAQIHAGARGKAGGLKLCRTYNEVRDAARDLLGKRLVTLQTGPEGKPVQRVYVETADPFERELYLGYVLDRKAERVRVIASQRGGMDIEEIAAKEPEALIQVVVEPAVGLQQFQAREIAFQLGLNIKQVSAAVKTIMNAYRAFRDCDGTMLEINPLVVTKDDRVLALDAKMSFDDNALFRRRNIADMHDPSQGDPREAQAAEHNLSYIGLEGEIGCIVNGAGLAMATMDMIKHAGGEPANFLDVGGGASPDRVATAFRLVLSDRNVKAILVNIFAGINRCDWVAEGVVKAAREVKIDVPLIVRLAGTNVDEGKKILAESGLDLITADTLTEAARKAVEACHGAKH

SEQ ID NO: 48971 - protein, 336 aa, Streptococcus pyogenes M1 GAS
MVVKVGINGFGRIGRLAFRRIQNIEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 48972 - protein, 464 aa, Carboxydothermus hydrogenoformans Z-2901
MVETEKELKRGLEARHIELIALGGTIGVGLFMGSASTLKWAGPSVILAYIIAGIFIFFIMRTIGEMLYIEPITGSFATYAHKYIGPLWGYLTAWSYWFMWVAVGMSEVTAVGIYMKFWFPTLPQWVPGLIAILIVGTANLAAVKYYGEFEFWFALIKVVTIVVMIILGIGMIFFGFGNHGRPIGLENLYIHGGFFPNGIKGFLFALCLVVAAFQGVELVGVTAGEAKDPQRTLRRAVQNITWRILIFYIGAIFVIVALYPWNKLGTIGSPFVLTFAKVGIPAAASIINFVVLTAALSGCNSGIYSSARMLYTLSQNGQAPKFLAKVSPSGVPVNSLLVTIACLLIGVALNYIAPQKLFVYIYSASVLPGMMPWFVILISQLKFRKLKDNEIKDHPFKAPLSPYSNYLTIIFLVLVLVGMWLNSDTRLSLIIGAAFMALIIISYYVFGIDKKQVPEVKKIKEEAI

SEQ ID NO: 48973 - protein, 364 aa, Zea mays
  misc_feature (38)..(38): Xaa can be any naturally occurring amino acid
  misc_feature (67)..(67): Xaa can be any naturally occurring amino acid
  misc_feature (235)..(235): Xaa can be any naturally occurring amino acid
HVYRIFAALLNKIGVKARQYDAFDLGFITTDDFTNADXEATYPAVARRLHVEWINDPAIPIVTGFLXGWRSGAITTLGRGGSDLTATTIGKALGLREIQVWKDVDGVLTCDPNIHPKAKPVPYLTFDEAAELAYFGAQVLHPQSMRPAREGDVPVRVKNSYNRRAPGTLITKARDMSKTVLTSIVLKSNITMLDIVSTRMLGQYGFLAKVFSIFEDLGISVDCVATSEVSISLTXMDPSKLWSCELVQHKNELDDVIEELEKIAVVHLLQNRSIISLIGNVQRSSLILEKAFNVLRRNGVNVQMISQGASKVNISLVVHDSEAKQCVQALHSAFFENGFLLEADELDVLHDGFTSHSNGTIHSH

SEQ ID NO: 48974 - protein, 708 aa, Kluyveromyces lactis NRRL Y-1140
MSASLIIGAKAPVIAYPELIAARKVNASKGDNTIEISFVEDKKAAAASFNGETEDVLTKLSAAYPDILNDNSDSSAEWIEFGAKQLVIKNFQQLAESLAKLNAHLNLRTYILNTLEPSLADIAVWGYLRSNGMVGSIIKNKVYINVSRWYSTFELIPEFGQAHEFLTKSLQELKKASNVNKKKETHKANFEIGLPDAKVGEVVTRFPPEPSGYLHIGHAKAALLNQYFAQAYKGKLIIRFDDTNPSKEKEEFQDSILEDLELLGIKGDRITYSSDYFQEMYDYCVQMIKEGKAYCDDTPTERMREERTEGIPSSRRERTVEENLKIFTEEMKNGTEEGLKNCVRAKIDYEALNKAMRDPVIYRCNLTPHHRTGTAWKIYPTYDFCVPIVDSLEGVTHALRTIEYRDRNPQYDWMLNALHLRKVHIWDFARVNFVRTLLSKRKLQWLVDKDIVSNWDDPRFPTVRGVRRRGMTIEGLRNFVLSQGPSRNVINLEWNLIWSFNKKVIDPVAPRHTAIVSPVKVHLEGDDVPQTPNVEMKLKHKKNPAIGEKKVIYYKDIVIDEEDAKLLSEGEEVTLMDWGNAIITKKNDDGSFNAKLHLEGDFKTTKFKLTWLADTDDKVEADLVDFDHLISKDKLEEGENFEDFLTPKTEFHTTAYADLNVKDMKVGDIIQFERKGYFRLDSLPKDGKPYVFFTIPDGKSVNKYGAKK

SEQ ID NO: 48975 - protein, 464 aa, Carboxydothermus hydrogenoformans Z-2901
MAFDRPTKKYPMPEQDPKVRAKNFDEVALGYSLELAMKEAERCLDCKKPACKQGCPVEVDIPDFIRFIKAGDIDSAINKIKEKNALPAICGRVCPQESQCEGQCVLGKKGEPVAIGRLERFAADYELAKGTQNVTVAPPTGKKVAVIGSGPAGLTCAADLAKLGHKVTIFEALHVPGGVLMYGIPEFRLPKRIVQQEIDNLKKLGVEIKTNTVIGKSLTVDELLDEEGYDAVFVGTGAGLPNFMGIPGENLNGVYSANEFLTRTNLMKAYLFPEYDTPIKVGEKVAVLGAGNVAMDAARTALRLGAKEVYIVYRRSRNEMPARLEEIHHAEEEGVKFMLLTNPTRIIGDENGWVKAMECLKYELGEPDESGRRSPVPIPGSEFIIEVDTVVVAIGQSPNPLVPRTTKGLEVGRKGNIIADENGKTTREGVWAGGDIVTGAATVIKAMGAGKKAARAIHEYLMSK

SEQ ID NO: 48976 - protein, 492 aa, Chromobacterium violaceum ATCC 12472
METRSTPTPAFDMVLFGGAGDLVMRKLLPSLYQAHNAGLLNEQGRILALGRKDLSRDDYLASVEKQSRIHIKSHFDDAAWQSFCSRIDYLRVDASQAADYPALAEKVGDDAGKVVVCYLATAPNLFAGICENLAAVGLNRPNVRVVLEKPLGTDLDSSNEINDDVARFFKEEQLYRIDHYLGKESVQNLMAIRFANALFEPLWRREWIHDVQITISEELGVGSRGDFYDGTGALRDMVQNHLLQLLCIVAMEPPANLEADAVRDEKLKVLKALRPFTEHDVAAKTVRGQYKAGASGGQPVVGYQDEAGIPAGSQTETFVAIKAEIDNWRWAGVPFFLRTGKRMQERLAEIVINFRDVPHQVFTGPLGGSHHANRLVIRLQPEESIRLYFLAKEPGDTMRLQPAYLDLDFYKAFKVRRADAYERLLLDVIRGKLALFMRRDELIEAWRWVEPIMDTWAASTNNPPKQYTAGSWGPAASSALLSRDGISWHEEC

SEQ ID NO: 48977 - protein, 499 aa, Oryza sativa Japonica Group
MYRIAGSHLRSLKRYSYSRFASTSVVKQSSGGLFSWLLGEKSSQLPPLDVPLPGITLPPPLPDFVEPSKTKVTTLPNGIKIASETSVSPAASVGLYIDCGSIYETPASSGASHLLERMAFKSTTNRSHLRLVREVEAIGGNVSASASREQMCYTYDAFKAYVPEMVEVLIDSVRNPAFFNWEIKEQLEKIKAEIAEVSDNPQGLLLEALHSAGYSGALAKPLMAPQSAIHRLDSSILEEFIAENYTAPRMVLAASGVEHDELVSIAEPLLSDLPSVKRPEEPKSVYVGGDYRCQADSDKTHIALAFEVPGGWFEEKTAIIVTVLQMLMGGGGSFSAGGPGKGMHSRLYLRILNNYHQIESFSAFNSIYNHSGLFGIHATTSPNFASKAVDLAAGELLEVATPGKVTQEQLDRAKQATKSAVLMNLESRVVASEDIGRQILTYGERKPIEHFLKDLEAITLNDISSTAKKIISSPLTLASWGDVIHVPSYESVSQKFFSK

SEQ ID NO: 48978 - protein, 304 aa, Vitis vinifera
MGESLIAHDAHFRAEDQMYLDGGDDGDEEGARHGPSLMPGGSSKTHRYIEDILLERAAQVSDNSSGVTYIGRGGSGIFIKMVYDALRPVGKLSHEDLCDVFSEWDRGELLSFLVRITADIFGIEDDEEVLTETSEDNVEFIGEDYTVELTDGGEGHSSSFLDVGLVNDLTREIVTAAGVLLAVRSINGDSLAVINTSQPPSDSLLSVTREDHQKGEDGSCNHQLQGGISFAPQVHVPWQRKIYPRLRIYERVSKGTSEILELAFCKIFQTRAHPEYSHKSKGKSTVASSMMWFSDQLTCTPGDP

SEQ ID NO: 48979 - protein, 547 aa, Chromobacterium violaceum ATCC 12472
MSELTELPAWQALWDHFAEAKHLHMRDLFAADPGRAERYSLEVGGLFLDYSKNRITDATLLGLMELAREAGLPARIKAMFKGEKINRTENRAVLHVALRNRTNSPIRVDGEDVMPKVNSVLERMGKFAHAVRSGDWLGFTNQPITDIVNIGIGGSDLGPLMVCSALKPFGHPRLNMHFVSNVDGAQLKETLKKVHPETTLFVVESKTFTTQETLTNALTAREWFLSHARDEGAVAKHFVAVSTNQKAVAEFGIDPANMFEFWNWVGGRYSLWSAIGLPIMLYLGEENFTELLNGAHIMDQHFMNAPFEQNMPVLLAMIGVWYINYYGGGSHVIAPYDQYLHRLPAFIQQLDMESNGKQVTLSGQPVDFETAPIIWGETGINGQHAFFQLLHQGTHISPIDLIASLGNRASLPGHHEILLANVFAQAEAFMRGKTADEVRAELAEQGLSGEEMEALVPHKVFGGNRPTNTLLMSRLDPRNLGSLIALYEHKIFVQGVIWHINSFDQWGVELGKQLAKTIHAELTGKLEQAEHDSSTRRLIQLYRKANG

SEQ ID NO: 48980 - protein, 439 aa, Nostoc punctiforme PCC 73102
MLSIPINLNLPRIPHLITSLPGPLAQAIVQRDRAVTSPSYTRDYPLVVSRGQGCMVEDVDGNVFLDMTAGIAVTATGHAHPEVVKAIQEQSERLLHMSGTDFYYEPMVELAEQLAIRAPFPQPQGNSAFPAKVFFTNSGAESNEGALKLAKYYTKRSLIVAFLGAFHGRTYGAMSLTGSKAVQRANFGPLVPGVTHIPYGTHASLDYLEQQLFGTILPPQEVAAIVVEPIQGEGGYIVPEDGFLKRIRDICDRHGILMVVDEVQAGMGRTGRLFAIEHWGVMPDIITTAKGIASGLPLGAILAKPELMTWPPGSHATTFGGNPVACAAGIATLRLLESGLMANATQMGELLQASLSELHQRFPRVSPPRGKGLMVAVDLLDEQGNLDRELRDRIIQEAFLRGLLLLGCGKAAIRFCPPLVIDSDQIQIALQIISNILTS

SEQ ID NO: 48981 - protein, 356 aa, Xanthomonas oryzae pv. oryzae KACC10331
MPACCRISVKAARVHRHNGLITARRVSFSHSSQSFKARIFMSSVVVVGSFNVDHVWRCDALPLPGATIAGRYSTGPGGKGFNQAVAAARAGAKTHFLCALGDDAGGALARSLAAQDGFALIAEPSNEPTGTGGIYVDGHGRNTIVIGAGANAVLSPAFIDNQRPLIAAAKVLLAQLESPAETIESALALAHECGVLTVLNAAPANAPTSIGLLKLSDVLTPNETEFAALLGRHVGERINADNVAALDGNTLHSLCRKLLPGGSVVVTLGAVGAFISHAEEQLRGDTQAHYRVRAESAQTIDTTGAGDAFNGALVASLAQLPAAGFATHVRFATRYAARSTEVEGAAVSMPRLRADD

SEQ ID NO: 48982 - protein, 508 aa, Rhodobacter sphaeroides 2.4.1
MDGVAERQMMGEDSPPSGDDPRAEARALLAELTALRADLFRRADARMADWATRVRRLEFLPSVANMADWLALREADLTTLQPRLSRLGLSTLGRLDGHVPPSLEAVIAALSAIAGLEGPAFPDRESFDPELRSLHARRDALFGARDTAPGTRILVTLPSEAASDPAIVRELVAAGADAFRINCAHDGPEAWAAMIGHIRKSERMTGRKLPISMDLGGPKFRVTKTGGPLPKRLQAGDRFAFVEKPSLAPEGRGWAMLGHPALLAALAPGVQVSVDDGKLWATVIQTGRGHALLEVDRVGERGLKLKPGRGVNLPGSHLDVAALTEEDLAALDVVVAEADLVAFSFVQTPGDVRALIAAMEARACHPRPLPAILLKIETPMGLHLLPELIVEAGGSLPVGVMIARGDLAVEIGFDRLSEIQEEILWLCEAAKVPVVWATQVLEGMVKEGQASRAEVTDAAMSQRADCVMLNKGPHVAAAIEFLRDILIRMDRHQTKKSARLGPLRVWAG

SEQ ID NO: 48983 - protein, 419 aa, Rhodobacter sphaeroides 2.4.1
MPLLVMKFGGTSVADLARIKNAAQKVKREVERGYDVIVIVSAMSGKTNELVGWVEQTSPLFDAREYDAVVSSGENVTAGLMALTLQEMEVPARSWQGWQVPIRTTSQHSAARFLEIPRENLDAKFAEGFKVAVVAGFQGVSPEGRITTLGRGGSDTTAVAFAAAFAAERCDIYTDVDGVYTTDPRIASKARKLEKIAYEEMLELASLGAKVLQTRSVELAMRYKVKLRVLSSFEDTDETSGTLVCDEEDIMESKVVSGVAYSRDEAKMTLVTVEDRPGVAAAIFGPLAEAGVNVDMIVQNISEKDYGSHPGSVTDMTFSCPINQVARARKALEDAKAEGTIVYDDLVVDTEVAKVSVVGIGMRSHAGVAATMFKALAADGVNIKVIATSEIKISVLIDRKYMELAVQALHDAFALETAN

SEQ ID NO: 48984 - protein, 528 aa, Nostoc punctiforme PCC 73102
MDARALWQRYQNWLYFHEGLGLYLDISRMRFDDAFVESLQPKFDKAFADMAELEKGAIANPDENRMVGHYWLRNPDLAPTPELTQEIVQTLEQIEAFAEKVQTGAIHPPRASRFTDIISIGIGGSALGPQFVAEALAPDFPPLKIHFIDNNDPAGIDRVLNHLRNSLASTLVLVISKSGGTPEPRNGMIEVKKAYAGHNLEFAQYAVAITSVDSNLDKLAKDEGWLARFPMYDWVGGRTSEMSAVGLVPAALQGIDVRAMLDGAKEMDDATRVPDVKNNPAALLALSWYFAGNGKGEKDMVVLPYKDSLFLFSRYLQQLVMESLGKEKDLDGNVVHQGIAVYGNKGSTDQHAYVQQLREGVANFFATFVEVLEDRQGPSTEIDPGVTSGDYLSGFLQGTRQALYENHRDSITVTIPQVNPRTVGALIALYERAVGLYASLVNVNAYHQPGVEAGKKAAASILDLQTRVVAVLQKEKTPISLDELAKKAGASDQIEAIYKILRHIHANQRGVVLQGDLHKPGSLTVSAS

SEQ ID NO: 48985 - protein, 433 aa, Frankia sp. CcI3
MSGPGRPGNISGVPRSPARSRVRLPDFPWDQLVSFKEKARLHPYGLVDLSVGTPVDATPAVVQQALAGSADAPGYPLTAGTPELREAAAGWLARRLGVLVDPGAVLPVLGTKELVAQLPGQLGLEPGDRVWVPTPAYPTYEVGALLARCEPVAGPADGVTLIWLNSPGNPTGRVLTVDEMRAVVTWARERGVIVASDECYIELGWESRPVSVLHPDVCGGSHEGLLAVHSLSKRSNLAGYRAGFVTGDPALVEGLLAVRKHAGFMMPTPVQAAMAAAYADDMHVADQRARYANRRAVLAAALAVAGFTIDHSEAGLYLWATRGEEAWATVDALAEVGILVAPGTFYGEAGRYHVRIALTAADSQVATVPERMTMLSPVAATGQPGHGARPGHGARPGRGARPDHGARPGHGARPDYGQPVTQGSYGGAEPDIR

SEQ ID NO: 48986 - protein, 560 aa, Arabidopsis halleri subsp. gemmifera
MASSPALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 48987 - protein, 488 aa, Diospyros kaki
MMNTTGSGNHHHRLLSKIATNDEHGENSLYFHGWKAYDDNPFHLTQNPNGVIQMGLAENQLSFDLIEDWMKKNQRASICTTEGVHMFKEIANFQDYHGLPEFRNAVAKFMGKVRGGRAEFDPKRIVMGGGATGANELLMFCLADPGDAFLVPSPYYPAFDRDLRWRTGVKLLPVECKSSDSFRITREALEEAYEKASESNIRVKGLIIGNPSNPLGTIMDRNTLKSLVSFVNDKNIHFVCDEIYAATVFKQPEFISVSEIIQEMDCNLDLIHVVYSLSKDMGMPGFRVGIVYSYNDEVVTCARKMSSFGLVSSQTQHLLASMLSDDEFVERFIGESSRRLENRHRTFTEGLKEVEIKCLEGNAGLFCWMDLRPLLKEATFEAETELWKVIINQVKLNVSPGSSFHCSEPGWFRVCFANMDDETVQVALQRIRTFVDEKKGAGKAAPEKKKKQWQRNLRLSFSSGRIYEDGCLSPHVLSPHSPMLRAQT

SEQ ID NO: 48988 - protein, 196 aa, Ustilago maydis 521
MASIKGPAPAPTSFPGADKLRIGIVHARWNEECITPLVKGCVDSITKAGVKPENIVIESVPGSWELPFGVSRLISASQVQASSNVSDLMGATSLLDDSKPATPTTSSATAGKASKAALDAVIGIGVLIKGSTMHFEYISESCCSGLMRIGLDTGVPVILGVLTALTEDQALERSGVGRGANKGHNHGLDWGSAAVE

SEQ ID NO: 48989 - protein, 315 aa, Thermotoga maritima MSB8
MSFSNEMKVFSGNANRPLAEKIANYLNLQLGDCEVGRFADGEINVRINETVRGHDIFLIQPTSPPVNENLMELLIMIDAFKRASANTIAVVIPYYGYARQDRKAKGRDPISAKLVANLITVAGATRVLTVDLHAEQIQGFFDIPVDNLWSYPVFAEELLKRENIVPEETVVVSPDVGGVRRARRMAERLGTSLAILDKRRPSDNVAEVVNIIGEVEDKVVIMFDDIIDTAHSIVKGAEALKNAGAKRIIACATHGVFSDRALERIENSSIDTVYITDTIYHENLPEKVKVISVANLIGEAIMRIRKHLSVSTLFR

SEQ ID NO: 48990 - protein, 560 aa, Arabidopsis halleri subsp. gemmifera
MASSTASISDPEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPHSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 48991 - protein, 760 aa, Bordetella pertussis Tohama I
MDENLTKLALDYHAYPTPGKISVTPTKTLANQDDLSLAYSPGVAAACMAIFDQGNDAASKYTSRSNLVGVITNGTAVLGLGNIGSLAAKPVMEGKGCLFKKFAGIDVFDIELAENDPDKLVDIIAALEPTLGGVNLEDIKAPECFYIEKKLRERMNIPVFHDDQHGTAIISSAAILNGLKVVGKDIGQVKLACSGAGAAAIACLDLLVHLGIKREHIYVVDSRGVIWEGRDENMEPNKRRYAQKTEARTLADVVNGADVFLGCSTAGVLTPEMVKTMAAQPLILALANPEPEIRPELAKAARPDCIVATGRSDYPNQVNNVLCFPFIFRGALDAGATRITEEMKLACVKAIAELAQAEQNDEVARAYAGQELSFGPDYIIPKPFDPRLIVQIAPAVAQAAADSGVATRPIEDIEAYRQKLMGFVYHSGQLMRPLFQQAKQAPKRVVYADGEDERVLRAVQTVIDEKLAEPILVGRPSVIEMRIKKFGLRMVPGQNVEIVDPEDDSRFNDTWNGYYQLRGREGVTPAIAKAMIRKHNTLIGAMLLRRGDADALLCGVASKYDNQLKYVEEVIGRKPGQTYGALNVLMLPNQTLFVTDTHVNENPSADEIANITIQAAEEMLRFGVMPKIALLSHSNFGSRPTDSSRKMAHARKLVAERAPHLEVDGEMHADAALSESIRLQAYPDSTLKGRANLLVMPNLDTGNITYNMLKMTGSNGIAMGPILLGSARPVHILTTSATVRRIVNMTALAVVDAQQEAAEG

SEQ ID NO: 48992 - protein, 226 aa, Saccharophagus degradans 2-40
MQPIQAQIESVRQQITACANAAKRDPASIKLLAVSKTQPAERLQAAYEAGQRAFGENYLQEALDKINALSNLDIEWHFIGPVQSNKTRDISENFDWVHTLDRLKIAQRLNDQRPAGTPPLNVCIQVNIDQEASKSGCLPDELEALALNVADKPNLQLRGLMAIPSPNQQGNCAFSRMRALLEQLQKHPKLSAMDTLSMGMSGDMAQAIAQGATIVRIGTAIFGARD

SEQ ID NO: 48993 - protein, 320 aa, Diospyros kaki
MEAFPVINMEILNGEGREAAMEKLRNACENWGFFEVVNHGISHELMDSVERLTKEHYKKFMEQRFKEMVASKGLEVVQSEINDLDWESTFFLRHLPSSNLSELPDLEDDYKKAMKEFAEDLEKLAEQLLDYLCENLGLEKGYLKKAFYGSKGPTFGTKVSNYPPCPRPELIKGLRAHTDAGGIILLFQDDKVSGLQLLKDGQWIDVPPLKHSIVINIGDQLEVITNGKYKSVMHRVIAQTDGNRMSIASFYNPGSDAVIYPAPALVEKEADHEQKQVYPKFVFEDYMKLYAGLKFQAKEPRFEAMKAMETPLNLGPIATV

SEQ ID NO: 48994 - protein, 325 aa, Pseudomonas syringae pv. syringae B728a
MAKRIQFNTVGGPEVLEYVDFEPQAPGPQAVVVRNKAIGLNFIDTYYRSGLYPAPSLPSGLGAEGAGVVEAVGAEVTRFKVGDRVAYGTGPLGAYSEVHVLPEANLVKLADSISFEQAAALMLKGLTVQYLLRQTYQVKPGEIILFHAAAGGVGSLACQWVKALGGKLIGTVSSPEKAAHAKALGAWETIDYSHEDVASRVLELTDGKKCPVVYDGVGQDTWLTSLDCVAPRGLVVSFGNASGPVSGVNLGILAQKGSVYVTRPTLGSYANTAQNLQAMADELFDMLASGKLKVDGIQQYALKDAARAQTELSARRTTGSTILIP

SEQ ID NO: 48995 - protein, 285 aa, Saccharophagus degradans 2-40
MSETNLVNDAKIAFIGAGNMAAAIIAGLVKQGVAPANIEVCAPSEGNRARLASEYGVVHSADNNAAAAKADILVLAVKPQMMREVCAQLAEHRNPNCVVLSVAAGITCQSLANWLATPAQPAENIAVVRTMPNTPSHIGLGACGLFASSAVAQTQKDQAQAIMAAVGLAVWVNSEDEINIVTAVSGSGPAYFFLVFEAMIDAAEKMGLDRQTATQLTLQTALGAAKLAQTSEDDAVTLRKKVTSPNGTTERAIASFEQNKLRDTFAAAMQACSDRAQQLATELAK

SEQ ID NO: 48996 - protein, 560 aa, Arabidopsis halleri subsp. gemmifera
MASSTASISDPEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLLELTAYNVGQLLAIYEHRVAVQGFVWGINSFDQWGVELGKVLATHVRKQLHSSRTQGTTLEGFNYSTTTLLKRYLETSSEPQM

SEQ ID NO: 48997 - protein, 522 aa, Pseudomonas syringae pv. syringae B728a
MRWLNRHKFLPFLAWLPQQNRASVGRDALVGLSGAILALPQSIAYALIAGLPPEYGLYAAIVPVLVACLWGSSWHLICGPTAAISIVLYASVSPLAVPASQDYIMLILLLTFIAGVFQLLLGMMRFGALVNFVSHSVVLGFTLGAAVVIALGQMPNLLGIDLPSQTTALKSLSAVLEHWREVDLSSLMLGLLTLALGIGLKLLVPRWPTLLIALVSSSLLVWLWPAMFGHVRVVSAFVGHLPPFSPLPLDLELILKLLPTAVAVGMLGLVNSLSIARSLSARSQQMLNANQEVRAQGLSNMVGSLFSGYLSAGSFTRAALSYEAGARSPLAGVFSALWVALFAVAGASLISHIPIPAMAASILLICWGLVDRRGIRALFRVSRAEFFVMALTCLATLLLELQTAIYAGVLASLFFYLKRTSQPRVQQWREGDEEVLRVGGSIFFGASHYLQTRLQRTEGVRVVIDAQQINFIDYSGVEMLHQEARRLGRQGRVLVLRNARPQVIEELHKLEGAEKCPILFED

SEQ ID NO: 48998 - protein, 408 aa, Streptococcus pyogenes M1 GAS
MLDAKDIKQDFQILNQQVNDEPLVYLDNAATTQKPALVLEALQSYYQEDNANVHRGVHTLAERATLKYEASRQQVADFIHAKSSKEVLFTRGTTTSLNWVARFAEQVLTPEDEVLISIMEHHANIIPWQQACQKTGARLVYVYLKDGQLDMDDLANKLTTKTRFVSLVHVSNVLGCINPIKEIAKLAHAKGAYLVVDGAQSVPHLAIDVQDLDCDFFAFSAHKMLGPTGLGVLYGKEELLNQVEPLEFGGEMIDFVYEQEATWKELPWKFEAGTPHIAGAIGLSAAISYLQRLGMADIHAHEAELIAYVLPKLEAIEGLTIYGPSQPSARSGLISFNLDDLHPHDLATALDYEGVAVRAGHHCAQPLLSYLGVPATVRASFYIYNTKADCDRLVEAILKAKEFFNGTL

SEQ ID NO: 48999 - protein, 532 aa, Borrelia burgdorferi B31
MFMLNYKNLNELENFKILEGIAPEVLKTALTGKRIKEYDITIEGDSVHYNYASKQINETHLKIFQNLSDEANLIEKYKEVLDGEKINISENRKVLHHLTRGQIGKDVIEDNKENMREFFQSELEKIYNFAKQIHSGNIKSSNGKKFKNVVQIGIGGSSLGPKALYSSIKNYAKKHNLALMNGYFISNIDPDESEEVLSSINVDETLFIIVSKSGNTLETKANMQFLINKLKLNGIKEYKKQMVIITLKDSMLAIEEKGYLEYFFMHDSIGGRFSPTSAVGLTLLTLCFTEKVAKEILKGANEADKKSLNKNVKDNASLLAALISIYERNVLNYSSNCIIAYSKAMENFYLHLQQLEMESNGKSVNRFNETINYKTVRIIWGGIGTDVQHSFFQMLHQGTDIVPMDFIGFNETQLKEDVISDNSSSNDKLKANLIAQIIAFSKGKENSNKNKNFQGERPSALIYSKELTPYAIGAILSHYENKVMFEGFLLNINSFDQEGVQLGKIIANQILKNDNFKDEVIESYSKKILKKF

SEQ ID NO: 49000 - protein, 165 aa, Oryza sativa Japonica Group
AFVVVGDGDGHVGLGVKCAKEVATAIRGAIILAKLSVVPVRRGYWGNKIGKPHTVPCKVTGKCGSVTVRMVPAPRGSGIVAAHVPKKVLQFAGIEDVFTSSRGSTKTLGNFVKATFDCLMKTYGFLTPDFWRETRFIKTPFQEYTDLLARPKGLVIEAPAEKIEA

SEQ ID NO: 49001 - protein, 495 aa, Bacillus halodurans C-125
MGKPTGFMEYKRETPPKKDPFERSKNWQEFTLLMPESALRQQGARCMDCGVPFCQTGTSMDGSGEIGCPVYNLIPEWNDLVYRGHWKEALERLHKTNNFPEFTGRVCPAPCEGSCTVAISDDAVAIKSMEFHIVERGFQEGWIVPNPPRSRTGKKVAVVGSGPAGLAAAAQLNKAGHWVTVFEREDRIGGLLTYGIPDVKLPYHVVERRINLLKEEGIEFRTNVEIGKDVSAKQLKDDFDAVVLCTGATKPRDVNVKGRELKGIHFAMDFLTANTKSLLNSNHQDGNYISAKGKHVVVIGGGDTGADCITTSVRHGAKSITQFDINREKSNERPDNNPWPLFPIVHTVEDGHKEAAAVYGKDPRAYQVMTTKFVGDAEGHVKEIHTISVETTVHPDGSKTRVEIPGTEKVWPADLVFLAVGFTGPEEQLVRELELETDTRSNIKAEYGKYETSLEGVFAAGDNRRGQSLVVWAIHEGREAARECDKYLMGASNLP

SEQ ID NO: 49002 - protein, 157 aa, Brassica napus
MVSKEYKRDSSLREKFQLLRSITNSHAESETSIIEDASKYIKKLKHKVEKINNETTSEQYFCDPTDPMVTVETLEKGFMIKVMSSKNEPGMLVYVLEAFEDLGLEVVEARVSCMDSFSLHAIGSSNNDDCESMDGESVKQAAAVAIRTWSDSHDPKG

SEQ ID NO: 49003 - protein, 175 aa, Oryza sativa Japonica Group
MGKFGGAAVLPVYREEEDEDLFETSSSISGDSDDEAQFSDSEEAEAQEDQFAQQPARRMNSDSLYDLSSMKAQLPVKKGLSKYYDGKSQSFACMSEVRCLEDLRKKENPYKKIKSSKSYVALDGNQEACHIPGANSTSIAKKSGSSCANLMARNNTKSMLYRPPPIPVNKSGYHQ

SEQ ID NO: 49004 - protein, 472 aa, Pediococcus pentosaceus ATCC 25745
MDQPQIGVVGMAVMGKNLALNIESRGYTVAIYNRTASKTEKVMQDHSEKKLVPAYSIEEFVNSLEKPRRIMMMVKAGKPTDAVIAELLPLLDKGDVLIDGGNTNFEDTMRRNKELDESGINFIGTGVSGGELGALQGPSMMPGGQKEAYDLVAPIFEQISAKAKDGDPCVTYIGPNGAGHYVKMVHNGIEYGDEQLIDESYDLMRKLLGLPVKEIADIFADWNQGELDSYLIDITADILTRTDDLGSDKPIVDLIMDKGGNKGTGKWSSQNALELGVPQSLITESVYARYISVLKDERVAASKVLAGPEKKIDVDKDEVIEKIRRALYFSKIMSYAQGFEQMRVASENYDWNLNFGEIAKIWRAGCIIRAQFLQNITDAFDKNPELNNLLMDSYFQEIAAKYQEAVRDVVALAVKAGIPVPALSAAVAYYDSYRSAVLPANLLQAQRDYFGAHTYERVDREGIYHFPWYEEQ

SEQ ID NO: 49005 - protein, 226 aa, Nicotiana tabacum
MMEGGNNKEEAGPSRGLNFSEDKRKEELEEGDSEEDEHNQDSATDIITTSYVPGPLLSLKDQIEKDKEDESLRRWKEKLLGCLESDLNGQMEPEVKFHSVGILSSDFEEINTPLPVKEGQSKSVLFTLREGSEYRLKLTFSVLHNIVSGLAYTNTVWKAGLQVDQSKGMLGTFAPQREPYIHMLEEETTPSGALARGTYTAKLKFVDDDKRCHLVLNYSFEISKGR

SEQ ID NO: 49006 - protein, 428 aa, Nostoc punctiforme PCC 73102
MNIAVVGLSHKTAPVEVREKLSIPEPQIESAIAQLASYPHIDEVAILSTCNRLEIYIVTSEADQGIREITQFLAEYSKLPVLSLRQHLFMLLHDDAVMHVMRVAGGLDSLVLGEGQILAQVKTTHKLGQQYNGIKTILNRLFKQALTAGKRVRTETSIGTGAVSISSAAVELAQIKVANLAACRVVILGAGKMSRLLVQHLISKGAVEISIVNRSRDRAQELAKLFPQQPIKIHPLSEMMSVIADSDLVFTSTSATEPILDRVKLEMVLEVQRSLMLFDISVPRNVHADVNELENVQAFNVDDLKAVVAQNYESRRKIAQEAEKLLEEEVEAFDIWWRSLETVTTISCLRNKVETIREQELEKALSRLGSEFAEKHQEVIEALTRGIVNKILHDPMVQLRSQQDVEARRRCMQTLQMLFNLDAEEQFS

SEQ ID NO: 49007 - protein, 613 aa, Debaryomyces hansenii CBS767
MVCSVCLGMDDCPVYILEITKLLYTLPTVTNFPLKFCEDVDLIDSRIQIIMKFSINKNQTTKLTSTIETNSINSDVDLFDEQSQLEHKKTLKRDLSARHISMMAIGGALGPGLLIGTGTALATAGPASVLIAFSVIGLVVYCVMCSLGEMATYIPLPDGLAGYGSRYVDPALGFTMGYSYLLKYFISTANQYVSGALAIQYWIAPETVNPGVWIAVYLILVVGINFAGVRYLGEVEFWLSSLKVCVIIGLIICMIIIMLGGGPNHDRLGFRFWKNPGAFATYKDIPDSKGKFVAFLSVLVNAVFAFLGTELVGVMVGEAQNPRRNIPRAIRLTFYRIVVFYVLSVFVLGCCVAYDDPQLNLTSKTTANASPFVIAIKNASIPVLPHIVNGSILLFTFSSSNSDLYVASRTLYGLSLRGEAPVCFSYTNKRGVPYYSLLLSAVFTMLAFMAVSTNSKLVFDYFVSYVSMFGLLIWISILVSHIYFIKACNKQGVDRNSFVYQAPFAPYSTYLALSICCLVALIKNFTVFIGSFDYKTFVAGYISIPFYFILLFGYKIVTNTKGIKSEEVDLFSYKDVIDKEEHEYLMKKEEDLKMFEHSKGVGWFYRKFIGWIF

SEQ ID NO: 49008 - protein, 231 aa, Brassica napus
  misc_feature (151)..(151): Xaa can be any naturally occurring amino acid
  misc_feature (216)..(216): Xaa can be any naturally occurring amino acid
VYNFGERERGYKGSHVYLKTLLSPSLLSLSLSLSLSLTFKRPEILRNMSNDEDSFNLADLTAGLKDEDRAGLMNALKNELMAGQRSDVLESLTPQVRNRVEALKEIQGKYDELEAKFREERAVLEAKYEMLYQPLYTKRYEIVNGITEVEXTPGGTRMEHRGAETAEEKGVPSFWLTALKNNDVTSEEVTERDEEALKYLKDIKWCKTEEPKGFKXLEFFFDSNPYFKNAV

SEQ ID NO: 49009 - protein, 560 aa, Arabidopsis halleri subsp. gemmifera
MASSTALISDTEAWKDLKGHVEDIKKIHLRDLMTDANRCQSMMMEFDGLLLDYSRQRATLETVDKLLNLAKAAQLTEKISRMFNGEHINSTENRSVLHVALRAPKDAVIKADGKNVVPEVWNVLDKIKEFSEKIRSGSWVGTTGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 49010 - protein, 444 aa, Ostreococcus tauri
MCASKLSARGTRAQARPFSYFDAFANPEGFVNLAVAQNVLCMDEMHERVNRAFVESPSSSTSAMYDDMKGSRELKEAFAGHINSRWATEKLACRAEDLVVSSGAGALIENLCFCLCDEGDAIIIPAPYYPAFPNDLRARMGIDVVPVYAEKLTSLPTPADYEAVVTPRCKAILLCNPGNPTGVIFDKESVMDTIEWATSKGLHVISDEIYAASSFGSCLTDEFLQRHSMRNGRKAGDHRTPGMHSGMWGSMAILDRKICAELEEEERVLAMAERVHVIYGLSKDFCASGYRVGVLWTRNAAVHRALDNVSYFCAIPGPMQHALATVLNDDDFIPNFIVMNSHALAAQFASLDHFLSVPAQFVQPDAGMFVWFSLRNFLPSSPTWEDEKKLWQHVYDVAKVVLTPGADCAMNEPGWFRMCFAAVDRDTLQVAVHRIEAALKASKM

SEQ ID NO: 49011 - protein, 404 aa, Bordetella pertussis Tohama I
MAITDVLVPQLSESVSEATLLTWKKQAGAAVEADEILIEIETDKVVLEVPAPSSGVLSEIVMGDGSTVTSGEVIARIDTAAKAAAAPAAAAEAPAAAAAPAAAAPAAASSAASGVASPAAAKILAEKGVDAASVAGTGRDGRVTKGDALAAGNAPAAKAAAPVAPPTLSLDGRPEQRVPMSRLRARIAERLLQSQAENAILTTFNEVNMQAVMDLRARYKDKFEKEHGVKLGFMSFFVKAAVAALKKYPVLNASVDGKDIIYHGYFDIGIAVGTPRGLVVPILRNADQLTIAEIEKTIADFGKRAADGKLGIEEMTGGTFSISNGGVFGSMLSTPIINPPQAAILGIHATKERPVVENGQIVIRPINYLAMSYDHRIIDGREAVLGLVAMKEALEDPQRLLLDL

SEQ ID NO: 49012 - protein, 471 aa, Escherichia coli
MLLPVIMAGGTGSRLWPMSRELYPKQFLRLFGQNSMLQETITRLSGLEVHEPMVICNEEHRFLVAEQLRQLNKLSSNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAGAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRTEYKRHREIYRPWGRCDVVVQTPRFNVNRITVKPGGAFSMQMHHHRAEHWVILAGTGQVTVNGKQFLLSENQSTFIPIGAEHCLENPGCIPLEVLEIQSGSYLGEDDIIRIKDQYGRC

SEQ ID NO: 49013 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKVAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 49014 - protein, 475 aa, Bordetella pertussis Tohama I
MSKQFDVVVIGAGPGGYIAAIRAAQLGMSVACIDAWQNGQGGPAPGGTCTNVGCIPSKALLQSSEHYEQANHHFAEHGIEVKGVSLKLDTLIGRKNTVVKQNNDGILYLFKKNKVTYFHGKGAFAGQVDGGWSIKVTGTTDADLVAKHVIVATGSSARELPGLPFDEKNILSNDGALNIGAVPKKLGVIGAGVIGLEMGSVWRRLGAEVTILEAMPEFLAAADQQVAKEALKSFAKQGLDIQTGVKIGEIKAAAKSITVPYVDAKGAEQKLVVDKLIVSIGRVPYTGGLNAEAVGLKLDERGFVAVDEDCKTNLPNVWAVGDVVRGPMLAHKAEEEGVAVAERIAGQHGHVNFATVPWVIYTSPEIAWVGKTEQQLKAEGREYKAGSFPFMANGRARALGDTTGFAKVIADAKTDEVLGVHIIGPMASELISEAVTIMEFRGAAEDIARICHAHPTLSEAVKEAALAVDKRTLNF

SEQ ID NO: 49015 - protein, 322 aa, Bacillus thuringiensis serovar konkukian str. 97-27
MKVLEAISNIAVKYFAFWVICIATIAYFIPAPFLGLNSYITILLGVVMFGMGLTLKAVDFKIIATKPLPVIIGVCAQFIIMPLVAYVLAYVMNLPAELAAGLVLLGAVPGGTASNVMVYLAKGNLALSIAMTSLSTLLAPIATPLILLLLAGQWMPVNPMSMFLSIVQVIIIPIILGLVVKKFFPKTVTKGMTVIPFISVLAIIIIVSAVVSANVSSITSSGLLIFIAVMLHNAFGFLLGYITAFILKLDEGTRRAISIEVGMQNSGLGVALATAHFGPAAALPSVLAAVWHNIAGPILATIWSKNAKNTFSDENVSVNIEK

SEQ ID NO: 49016 - protein, 468 aa, Thermotoga maritima MSB8
MKNRKTPMKEQSPESRRRNFEEVALGYTLEEALEEAQRCLQCPTHPCVSGCPVEIDIPGFIRKLRDGKLEESYRILKSYNNLPAVCGRVCPQEVQCESRCVVGKMKDSEPVAIGRLERFVADWAAENLEEDVKPLAGSKKEKVAVVGSGPAGLTAAADLAKMGYHVDIFEAFHKPGGVLVYGIPEFRLPKRIVEREVSYIRKLGVNFHLNTVVGKTVKVKELLSEYDAVFIGTGAGTPKFMGIPGTNLNGVYSANEFLTRVNLMKAYLFPEYDTPIRVGKKVAVIGAGNTAMDAARSALRLGAEKVYIVYRRTEREMPARREEYHHALEEGIEFLWLTLPIRYIGDANGNVEAMECVRMELKEADGSGRPRPVPIEGSNFVLEVDMVIEAIGQGPNRVLLSEFPGLELNERGYIKADEDTGATSVKGVFAGGDIVTGAATVIKAMGAGKKAAQFIHSYLTGEWNPWQK

SEQ ID NO: 49017 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPHSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 49018 - protein, 425 aa, Ostreococcus tauri
MALDGCQPLERFMKKEAGPFCPSSRDDGASRANARHAQPARSYEYSVSGYVNGYNPTLPAYAPTRAQMEQAQREGRDLARAPPGQTFRKPTAVWDGPAPRGDPTKPAPGTPYYQREPEEEKFDATKETKDVPITGGGRLPMVGVDSSAAALGLERGVTHVSCGSSNDAALSEAGKAIAAHGDRQSVFVSAKLRPDEHKSVDAALSAILSALGIEYLDLFSLEWPVVHKPGTTEVDSEGSLEETWAALEKCVADGRVKALGVANFSVPAVERLMKCCKVKPAVNEVELHPLLAQRKLVGVCRRYGVTVLAHTSLANGDEQLLEHAKLVQAEADERNKQSAKALLTRWSIQRGVPLVINASSAIAIDECLAARTFRLTNKQKVLLDDIEPSPKVGGVRFYKPDFEFTFDDPFLGGAWWRPGLELVPN

SEQ ID NO: 49019 - protein, 223 aa, Arabidopsis thaliana
MATSSTQLLLSSSSLFHSQITKKPFLLPATKIGVWRPKKSLSLSCRPSASVSAASSAVDVNESVTSEKPTKTLPFRIGHGFDLHRLEPGYPLIIGGIVIPHDRGCEAHSDVDAILGALGLPDIGQIFPDSDPKWKGAASSVFIKEAVRLMDEAGYEIGNLDATLILQRPKISPHKETIRSNLSKLLGADPSVVNLKAKTHEKVDSLGENRSIAAHTVILLMKK

SEQ ID NO: 49020 - protein, 560 aa, Arabidopsis halleri subsp. gemmifera
MASSTALISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLTLVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 49021 - protein, 143 aa, Triticum aestivum
MAAALSLRAPFSLRAVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQMEAGWVLTCHAYPKSDIVIETHKEEELTA

SEQ ID NO: 49022 - protein, 160 aa, Nanoarchaeum equitans Kin4-M
MEVYAFIEVPKGSNVKYEYEDGKLKVDRILYGAMFYPYNYGFIPETLEEDGDPLDVLVITEEPLVPGSYIKVKPIGVLVTEDEKGVDRKIIAVPVKKVDPIYGEIEDISELKEGIKLKIKHFFERYKELEPGKFVKVKEFLGKEEAEKIIKQAQENYKKQ

SEQ ID NO: 49023 - protein, 704 aa, Saccharophagus degradans 2-40
MTPKKIGVLLVVALCVCAFFYFDLDRYIAVGLMRDWVAQSPVMASTIFALLYFMVAALSLPGTGAMTLLAGAVFGLWWGFLLVSFASTIGATVNMLVSRLLLRDWVTRRFRTSLERVNEGVEREGSFYLFSIRLIPLVPFFVVNPVFGLTNMRATTFYWVSQVGMVPGTLLYVNAGVALGALDSISMGAIFTPQIIGSLVLLALFPWVAKAIVEAVKRKRTLAKYKKPKHFDANLIVIGAGSGGLVAAYIAAAVKAKVILVEKDLMGGDCLNTGCVPSKALIKAAKVAHQTRNAQHLGINAQPEIDFAKVMQHVKGAVKQIEPHDSVERYTSLGVDCVQGEAEIISPYEVRVNGKVLAAKNIIVATGAAPSVRPIEGLDTINYLTTDTVWNLTQLPNRLVIAGGGPIGCEMAQAFARLGSQVTVVQRGDQLLPKEDADVAEFALNTLRNEGVEVLLNAELTAVAAGEGKSVLTISQNENTQHLECDQLLLALGRTPRLQGFGLENIGVAISEQGKLLVDRFLRTSIPTVYACGDVIGPYQFTHAASHQAWYASVNALFGGFKSFSVDYSALPWVTFTDPEIARVGASEMDLKKRGVHYEVTRYSLVELDRAIAEGEAHGFVKVLTEEGKDRILGAVIVGSHGGEMITEFVSAIKHGKGLNAILGTVHSYPTWSEANKAAAGKWKQAHAPQRLLQWVEKFHRWQR

SEQ ID NO: 49024 - protein, 468 aa, Escherichia coli
MSKQQIGVVGMAVMGRNLALNIESRGYTVSVFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRARFLQKITDAYAEDPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 49025 - protein, 397 aa, Nanoarchaeum equitans Kin4-M
MVLVGIVGKPNVGKSTFFKALTLQPVEIDNRPFVTIEPNKGVAYVRVEDVGPEFGVISNPRHGFIKGKYRFVPIEVIDIAGLVPGAHEGKGLGNQFLDDIRKADGIIMVVDAVGATDEEGHFVGPGKYDPLKDIKWLEEELDYWFYNVLKRNIDKILRVAKIEKRPIDREIAKIMSGLNVNIDHVKKAFRDLNLDSEFYDFDDELLFKLAHLLRIYSKPFVIAANRIDIDPDLAEKNIERIKKEYPLTIPTSGYAEYILKELDKQGKISYIPGESDFEILKPLSEKEKKVLDFIKTNILERFGSTGVQNALDTLVFDVLKYIAVFPGGIDKLTDKEGNVLPDCFLLKEGSTVLDFARKIHEDLAKHFVKAIDVRTRKILGKDYKLKHRDVIHIVSSK

SEQ ID NO: 49026 - protein, 457 aa, Streptomyces avermitilis MA-4680
MSVSTAAADQTVCCDISGHLPVLGREVTVPLVTGGEVTYAALDYAASAPALQRVWDDVAAYAPYYGSVHRGAGYLSQLSTDLFENARRTVAEFLDCRDGDQVVFTRSTTDSLNLLAAALPADCQVFVFETEHHASLLPWRDARVTYLNAPRTPQQAVETLERALAGRDPHGPALVCVTGASNVTGELWPVRELAAAAHAHGARIVLDAAQLAPHHPVSVRELDVDWVAFSGHKLYAPFGSGVLAGRADWLRAAEPYLAGGGASRKVTRRTDGGVDVEWHESAARHEAGSPNVIGAYSIASACKALTEAGYDNLVAREQQLIGTVRAGLAEVPEVRVLSLFGDDAPRVGVISFVVEGWNSSHFAAALSAEYGIGVRDGLFCAHPLVRTLLGSDPQVQGECGAPEAAPGEKSLNAIRVSFGAGTPDEHVERFVRAVKELVREGARWQYRTEDGRCVPAV

SEQ ID NO: 49027 - protein, 565 aa, Borrelia burgdorferi B31
MKIKLIFKIILLLEYQFRQGNGLITVSNLEVAFGERVLFKDVNIKFSPGNCYGIIGANGAGKSTFLKVLGGMIEASKGEISIPKNQRVAALEQDQFAYDGYKVIDTVIMGHKRLYSVQKEKDEIYSKLDFTDEDGIRAGELEAEFSELGGYEAESDAAVLLKGLGIDEAIHNNLMGDVEGALKVRVLLAQALFGDPDVLLLDEPTNNLDLQSIKWLEEFLINFENTVIVVSHDRHFLNQVCTHIVDIDYGKIQVYLGNYDFWYETSQILNKQLKDAKKRSEDKIAELKTFIQRFSSNASKSKQATSRKKLIEKIKVEDLKPSSRKFPYVNFKSERELGKNVLTIKNLIKEFEGNLILNKFSIIVEPQQKIVFLGNPMFATFLFDIITNEDRNYKGHYEWGSTVNFSYFNKDNGKYFDLDLNLVDWLRQYSKEQDETYIRGFLGRMLFSQDEALKKVNVLSGGEKVRCMLAKAMLSGANVLILDQPTNHLDLEAITSLNSGLKEFKGVVLFTSHDHQFIDTVANRIIEFTPNGIIDRYMTFSEYVDDAKIRDLRNNLYGNNAGFRL

SEQ ID NO: 49028 - protein, 309 aa, Glycine max
MAATFKHHPTGLHGWGAPRSSRNLPSFFSMRFPCSTRHHHIRASVSHHSSTEAESALILIRHGESLWNEKNLFTGCCDVPLTNRGVEEAIEAGQRISYIPIDMIFTSALIRAQMTAMLAMTQHSQKKVPIIIHDESEQATTWTQVYSEKTTKQSIPVITAWQLNERMYGELQGLNKQETAERYGKEKVHEWRRSFDIPPPKGESLEMCFQRAVPYFKDFIEPQLKSGKHVMVAAHGNSLRSIIMYLDGLTSQEVTSLEISTGIPLLYIYKEGKFNSRGSPVGPTEAGVYAYTQSLAVYRQQLDDMSSCY

SEQ ID NO: 49029 - protein, 632 aa, Cryptococcus neoformans var. neoformans JEC21
MTRISALLATIPLLAQAVSAATIEHWWNISYAVANPDGLFERRVIGVNGSWPPPPLLATQGDTILIHAYNGLNDPNIGTALHTHGISFNGSNYYDGAVGITQCSIPMGETLDYVIDTNLQAGTFWMHGHYLGQYVDGLRSPLVIEPQNATGRSDDLTWDDDYTLVVSDWYHRQHLDLLTNDFLTWENPTGAEPVPDSAVIYLVKDGKYYPSAEDVANGAAVSDNLSIPFEAGKKYKIRVINMSALAMFYIALDQHDINIIEVDGVEVEPYSVDALPLSVAQRYSILVEAKNETDRNYAMTVMQDVEMYDYLPDELVLNNTIQISYSSSNPHADEVVYPEEFTDIDDTLLTPLLRSAMAPADIEYTLHVNFDTYDDGNNRGSFNNVTFQEPPTASIFTALTMGNASFLPSVYGAQTNAFTYPHMANIQLTVYNWDAGSHPFHFHGHEFQVVQKSFDVTDEEDEGNGEIVEGQENPMRRDTITIPATGKVVLRWRADNPGAWFFHCHIDWHLSSGLAAVFIEAPEKFQENTVVPQTIVDHCKYWGLPTSGNVVGLNSTTDFDGQPWGPFPLVIGWTPAALTSIFFCVTTAVIGIATVLWYNQDTLDSRDMEEHIRRKIEAKKRRSGLLRRLRGE

SEQ ID NO: 49030 - protein, 218 aa, Pediococcus pentosaceus ATCC 25745
MSTKNSPIIIGVTGGSGSGKTTVSQKILEELHGHSISIIQQDSYYKDQAEKTMEERRAVNYDHPLAFDADLLYEHLKMLKNNQKIEVPIYDYKISTRSSEVIEQDPTDVIILEGILILADERIRDMLDIKVYVDTDDDIRIIRRIRRDMEQRARTLDSIINQYLTGVKPMYHQFIEPTKRYADVIVPEGGKNSVAIDLLVTKVRDILSEDGRDESFNK

SEQ ID NO: 49031 - protein, 477 aa, Arabidopsis thaliana
MQRFAAKRSVQNISVSLWRRCISSTSQAATASVKDSDEFQARLPPFAYTPPPYTGPSADVILSKRKEFLSPSMFCLYRKPLNIVDGKMQYLFDESGRRYLDAFAGIAVVNCGHCHPDVVEPVINQIKRLQHPTVLYLNHAIADFSEALASKLPGDLKVVFFTNSGTEANELALMMAKLYTGCQDIVAVRNGYHGNAAATMGATGQSMWKFNVVQNSVHHALNPDPYRGVFGSDGEKYAKDLQDLIQYGTTGHIAGFICEAIQGVGGIVELAPGYLSAAYDTVKKAGGLFIADEVQSGFARTGNFWGFEAHNVVPDIVTMAKGIGNGFPLGAVVTTPEIAGVLTRRSYFNTFGGNSVSTTAGLAVLNVIEKEKLQENAAMVGSYLKEKLTQLKEKHEIIGDVRGRGLMLGVELVSDRKLKTPATAETLHIMDQMKELGVLIGKGGYFGNVFRITPPLCFTKGDADFLVEAMDYSMSKM

SEQ ID NO: 49032 - protein, 358 aa, Frankia sp. CcI3
MGLSIGIVGLPNVGKSTLFNALTRNEVLAANYPFATIEPNVGVVGVPDPRLGELAKLYDSARTVPATVSFVDIAGLVRGASEGQGLGNRFLANIRESDAVCQVVRVFSDPDVVHVEGRVDPADDIETINTELILADLQTVDARLPKLEKEARADKAKQPLLAAVKAAREVLDAGRTLSSEPKIDRDALRELFLLTAKPFLYVFNVDEDVLADPGRRKELVGSVAPADAIVLCAKVEAELAELDEADAAELLASLGQEESGLAQLARIGFHTLGLQTFLTAGPKEARAWTIRAGATAPEAAGAIHTDFQRGFIKAEIVSYDALIAAGSMAAARAAGKVRMEGKDYVMADGDVVEFRFNV

SEQ ID NO: 49033 - protein, 150 aa, Triticum aestivum
  misc_feature (90)..(90): Xaa can be any naturally occurring amino acid
MAEQTFIMIKPDGVQRGLIGEVISRFEKKGFYLKGLKLQNVEKSFAEQHYSDLSSKPFFAGLVEYIVSGPVVAMVWEGKSVVATGRKIIXATNPLASEPGTIRGDFAVDIGRNVIHGSDSVESARKEIALWFPEGIAEWRSSQHNWIYEA

SEQ ID NO: 49034 - protein, 210 aa, Arabidopsis thaliana
MAIQKILFASLLICSLIQSIHGAEKLRLFKELDKGALDVTTKPSREGPGVVLDAGKDTLNITWTLSSIGSKREAEFKIIKVKLCYAPPSQVDRPWRKTHDEFFKDKTCPHKIIAKPYDKTLQSTTWTLERDIPTGTYFVRAYAVDAIGHEVAYGQSTDDAKKTNLFSVQAISGRHASLDIASICFSVFSVVALVVFFVNEKRKAKIEQSK

SEQ ID NO: 49035 - protein, 197 aa, Mesorhizobium loti MAFF303099
MLPEKNKEQDMAQERREGGRGREREERDDGMVDKLVHINRVAKVVKGGRRFGFAALVVVGDQKGRVGFGHGKAREVPEAIRKATESAKRDMIFVPLRSGRTLHHDVEGRWGAGRVLLRAAKQGTGIIAGGPMRAVFETLGMHDVVAKSMGSSNPYNMVRATFDALKSQMHPKDVAAARGIKYSTLQARRGTAVAAEE

SEQ ID NO: 49036 - protein, 826 aa, Nanoarchaeum equitans Kin4-M
MLCMSEEGIKLKVAEAYQEDVYLGKVRVDYDVLDRLGLSPGDIIEIEGTRKTYAIADVLYPEDQGLGIIRMDGVIRKNAGVGVGEYVIVRKPPKPQIAKKVVLAPVKKEEQIIIDEYYLRNLLNGFVVTKGDYVVVRFDNLGFFIDFLPLKEMWFKVVSTNPPKGPVIIGRDTIIEIKPGGVQEIPEVTYEDIGGMKDVIQKVRELVELPLRHPEIFERLGIEPPKGVLLYGPPGTGKTLLAKAVANESGAYFISINGPEIVSKYVGESEAKLREIFEEAQKNAPAIIFIDEIDAIAPKRDEAVGEVERRLVAQLLTLMDGLKSRGKVIVIAATNRPNALDPALRRPGRFDREIEVPVPNEEARYEILKVHTRRVPLGKRVVEKVDGKTVEKYVPLTKEEKEQLLRKLAAMTHGFVGADLAALVKEAAMNAIRRVIPDILALKEEKLPKELLEKLMVTEEDFKEALKMVTPSAMREFYIEIPKVKWEDIGGLEEVKQELRETVEWPLKYRIEELGIKPPKGVLLYGPPGTGKTLLAKAAASESGANFIAVKGPEILNKWVGESERAIREIFRKAKQAAPAIIFIDEIDAIAPARGSDVNRVTDRIVNQLLTEMDGITDRGDVIVIGATNRPDILDPALLRPGRFDRVIYVPPPDKKARVEIFKIHARKIPKDPELKERFEEFKKNLEKLKEIKPDIDIEKYKNLSLEEALELYKKSKEFRDIVDTVLFYIPLAEKTEGYTGADIEAVVREAVMLALRELFEQAKKEKWDDKKINEMIGKLKVKMKHFEKALEKVGPSVDKETIRAYEEFAKNFRKRINKKNNPYLG

SEQ ID NO: 49037 - protein, 472 aa, Vibrio campbellii AND4
MGFTSLGLSVPILKAIQEKGYDTPSPIQAQAIPAVLEGKDVMAAAQTGTGKTAGFTLPILELLSNGPRVRANHVRALILTPTRELAAQVQESVFTYSQHLPLNSAVVFGGVKINPQMQRLRKGADVLVATPGRLMDLYSQNAVKFDQLEVLVLDEADRMLDMGFIRDIRKILDLLPKQRQNLLFSATFSDEIRDLAKGLVNNPVEISVNPANSTARTVEQSIYPSDAKKKAPMLVKLIKEGDWRQVLVFTRTKHGANRLAKFLIDEKLPAAAIHGNKSQSARTKALADFKSGAIRVLVATDIAARGIDIPQLPQVVNFELPKVAEDYVHRIGRTGRAGEMGKAISLVSALEAPELFAIERLIQQLLPRKELAGFAPTNVVPESKLDTRPIKPKKPKKPKSPSAGGGSAQANERNAANKPKRRFNSDNKSGRGEAVKSGNGGKPSGNRKPNSGNSGGAKPSGQRRKPRPQAAK

SEQ ID NO: 49038 - protein, 404 aa, Nocardioides sp. JS614
MTEVPTVGLADIEEARRVLAGVAIQTPMEESRWLSAIAGGPVWLKCENLQRTGSFKPRGAYVRISRLTPEERARGVVAASAGNHAQGVALAAQLLGIKATVFMPEGAPIPKEKATRGYGAEVLFHGRYLEDALAEATVFAERTGAVLIHPFDHADVVAGQGTAGLEILEQAPDLQTVLVPTGGGGLLAGVAIAVKARRPDVRVIGVQAAGAAAYPGSLAEGHPVALTSMKTMADGIAVGLPGQVTFAAVRDHVDEIVTVSENSLSRSVLAVLERAKMLVEPAGAAAVAAVLDRPDIFATPAVVVLSGGNIDPLLLGKVIRHGMAAAGRYLNLRVCIPDLPGGLAQLLTDISAVGANVLEVAHERISPTLNLDEVEVHVQLETRGEPHTAQVLARLRERGYRVYE

SEQ ID NO: 49039 - protein, 540 aa, Zea mays
MAAHHNADDAAREPGASASPPASEAEHRALLRPSSFISAISDDNEGCKERAFEPSEKVIVSVSGDPEGDASEERAFYASGGCMPPFSWRKLWAFSGPGFLMSIAFVDPGNIEGDLQAGATAGGTLLWVLVWATAMGLLVQLHAARLGVATGRHLAELCRDEYPDWARRALWLMAEVALVSADIQEVIGSAIAIKILSHGLLPLWGGVVITALDCFMILSLENYGVRKLEALFAVLITTMACSFAWMFVETEPSGKDLFIGILVPKLSSRSIKQAVGLVGCVITPHNVFLHSALVQSRKIDPDKEYEVREALRYYSIESTLALVVPLMINLFVTTVFAKGFYGTKEADSIGLENAGKYLQEKFGGDFFPILYIWGVGLLAAGTSSTITGTYAGQFIMGGFLNWRLKKWIRALITRSFAIVPTIIVALYFNNSGYELDVLNEWLNVLQSVQIPFSLIPLITLVSKEEVMGVYKIGPRMKILTWIVASLPILINSYMLLDFFFLEMGGMLYNTTLCVAVVAYFMFILYFIFRGRKFPSFLTTT

SEQ ID NO: 49040 - protein, 763 aa, Oryza sativa Japonica Group
MTVTPQITVSDGRLAVRGRTVLTGVPENVTAAHASGAGLVDGAFVGADAGEAKSHHVFTFGTLRECRFMCLFRFKLWWMTQRMGSSGRDVPLETQFMLIEVPATAAGDGHDGGGDGEPVFVVMLPLLEGKFRAALQGNDDDELQICIESGDKAVQTEQGVNMVYIHAGTNPFDTITQAIKAVEKRMQTFHHRDKKKMPSFLDWFGWCTWDAFYTDVTADGVKQGLRSLANGGAPPRFLIIDDGWQQIGTEDDDTDEHPAVAVQEGAQFASRLTGIKENVKFQSKNGGAGEDTPGLRMLVEEVKGEHGVRQVYVWHAMAGYWGGVAPAPAMERYEAALAYPVQSPGVTANQPDIVMDSLSVLGLGLVHPRKVLDFYDELHAYLASCGVDGVKVDVQNIIETLGAGHGGRVALTRAYNRALEASVARSFPDNGCISCMCHNTDMLYSARQTAVVRASDDFYPRDPASHTIHVASVAYNTVFLGEFMQPDWDMFHSLHPAAEYHGAARAIGGCPIYVSDKPGNHNFDLLRKLVLPDGSVLRARLPGRPTRDCLFSDPARDGESLLKIWNLNNCGGVVGVFNCQGAGWCRVAKKTRVHDAAPGTLTGAVRADDVDAIAQVAGGDGGGWDGEAVVYAHRARELVRLPRGAALPVTLGALEYEVFHVCPVRAIAAAPGGAAVAFAPVGLLDMFNAGGAVEECAVDAAAAVALRVRGCGRFGAYFSRRPARCALDGADVGFTYDGDTGLVAVDLPVPEQEMYRWNLEIHV

SEQ ID NO: 49041 - protein, 325 aa, Xanthomonas oryzae pv. oryzae KACC10331
MSDTTMTAIAIRDGKGDADALYATEQPRPRPAAGQVLMRVNAAGINRPDLLQRAGHYPPPPGAPETLGLEIAGEIVEPAGRWKVGERVCALLGGGGYAQYAAVDARHVLPIPAGMDLVHAAALPETIFTAYANLFEHGRLAAGEWLLLHGATSGIGVTAIQMAKAAGAHVLATARSASKAAQARALGADVAIDSTSESFVEVAKAHGGIDVALDMVGAAVFADTLEALNQRGRIVYIASQAGATIELPIPVLMRKQAVITGSTLRPRTADEKARLAAEVERVVWPWIAEGKLRVLVDKRFPLAEAAAAHRYLEQGSHLGKIVLEI

SEQ ID NO: 49042 - protein, 267 aa, Chromobacterium violaceum ATCC 12472
MRITFIGGGNMAGAIIGGLARQGGHRIHVVEHQQDKLDQLAAGFGCSGSQALPERFAADEVVVLAVKPQQLRELCLALAPVLNGALVVSIAAGIRLDALARWLGSRRIVRVMPNTPAMVGKGVSGLYADAAVSAADRDAAETVMRAAGLTVWLADEAGIDDITCVSGSGPAYVFYFIESMIEAAAKAGFGEDKARELVLATFDGAVELARQSPLPVAELRRNVMSKGGTTERAIARFEAEGVKAAIVAGAMDCRDRSIEMGRELSQE

SEQ ID NO: 49043 - protein, 231 aa, Chromobacterium violaceum ATCC 12472
MTDSLSSRLQQVRLRLDAACAAAGRAPGAAALLAVSKTFPADALRAAYACGQRAFGENYVQELQQKCEALAGLEIEWHFIGPLQSNKTRIVAERAHWVHSIDRLKIAERLSAQRPDGLPALNVCVQVNVSGEDSKSGCAPEEAAALARAVAALPRLRLRGLMCIPEPTEDTARLAAQFARLRGLQRQLNAEGLALDTLSMGMSADLETAVAEGATLVRVGSAIFGQRDYQH

SEQ ID NO: 49044 - protein, 181 aa, Pfiesteria piscicida
MGLAFTKIWQRMVGKTEMRILMVGLDAAGKTTILYKLKLGEVVTTIPTIGFNVETVEYKNLSFTVWDVGGQDKIRPLWRHYYQGTNGLIYVVDSNDRDRIEDAREELNKMLNEDEMRDAVLLVFANKQDLPNAMTAAEVTEKLGLHNLRHRQWFIQSACATTGDGLYEGLDWLSRTLSSKK

SEQ ID NO: 49045 - protein, 276 aa, Oryza sativa Japonica Group
MSSARRLLLLAGAAAAIALLLSATAPVAGAEDDGYSYIPGSPRGPQNWGSLKPEWATCSSGKMQSPINLGLLDLTLAPGLGNLNYTYKNANASVVNRGHDIMVRFDGDAGSLKINGTAYQLRQMHWHTPSEHTIDGRRYDMELHMVHLNAQNQAAVIGILYTIGTTPDEFLQKMEPYIIAISNQEGKEKMVVGGADPNVAKGKDTVYYRYMGSFTTPPCTEGVIWTVVRKVHTVSLSQITLLKAAVLMGNENNARPLQDVNNREIDLFFPLPLINN

SEQ ID NO: 49046 - protein, 470 aa, Frankia sp. CcI3
MFDYDVLVIGSGPGGQKAAIAAAKLGRRVAIVDKREMIGGVSINTGTIPSKTLREAVLYLTGMSQRELYGSSYRVKDDITVGDLSARTRHVISREIDVIRNQLSRNHVTLLTGLASFVDPHTVNVRAGGEDTEDRRIQAERIIIATGTRPARPDTVDFDGRTVVDSDQILALEKLPRSMVVVGAGVIGIEYASMFAALGTKVTVVERRDRMLDFCDLEIVEALKYQLRDLAVTFRFRESVVSVERHNGGTLTLLESGKKLPADTVMYSAGRQGLTDILNLPAAGLSADNRGRIKVGSDFRTEVDHIYAVGDVIGFPALAATSMEQGRLAAYAACGEDVNAMRAELMPIGIYTIPEISYVGSTEDELTEQAIPFEVGIARYRELARGAILGDSYGMLKLLVSPDDRRLLGVHVFGTGATELVHIGQTVMGCGGTIDYLVDSVFNYPTLAESYKVAALDAMNKMRAVARFSG

SEQ ID NO: 49047 - protein, 455 aa, Oryza sativa
  misc_feature (255)..(255): Xaa can be any naturally occurring amino acid
  misc_feature (358)..(358): Xaa can be any naturally occurring amino acid
MKEKGSRAAVDERYAQWKSLIPVLYDWFANHNLVWPSLSCRWGPQFEKATYKNRQRLYLSEQTDGTVPNTLVIANCEVVKPRVAAAEHISQFNEEARSPFVKKYKTIIHPGEVNRIRELPQNSKIIATHTDSPDVLIWDVEAQPNRQAQLAQMESRPDLILRGHKDIAEFALAMCPAEPYVLSGGKDKSVVWWSIQDHISALGDSSKTESSPGASGSKGKTANDKDSPKVDPRGIFLGHDSTVEDVQFCPSSAQXFCSVGDDSCLILWDARSGTGPAVKVVEKAHGGDVHCVDWNLHDVNYILTGSADNSVRMWDRRNLGSGGAGIPVHKFEGHKAAVLCVQWSPDKASVFGSSAEDXGFLNVWDHEKVGNKKNPNAPAGLFFQHAGHRDKIVDFHWNSSDPWTIVSVSDDGESTGGGGTLQIWRMSDLIYRPEDEVLAELENFKTHLASCAPRS

SEQ ID NO: 49048 - protein, 180 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFIAYKPPSFTG

SEQ ID NO: 49049 - protein, 332 aa, Oryza sativa Japonica Group
MAASNIGMMDGAYFVGRNEILAWINTTLQLGLSKVEEAASGAVACQLMDAAHPGAVPMHKVNFDAKTEYEMIQNYKVLQDVFNKLKITKHIEVNKLTKGRPLDNLEFMQWMKRYCDSVNGGFMNSYNASERRESSKGGKETNRRTSVPSQAPAKSSSATHKAQASSHGAKKANGHAPNAPPSRSAKPSPANSAGPAYDEQITELKLLVDSLEKERDFYFSKLRDVEILCQSPEVEHLPIVNAIHKVLYAAEDDPSMVAEAQAMISQQQQSEQPMLSPILEASEERPAKQEAHKRKSISDLELEEFGMASSSRQRLSDISDVQLCGSPLTSFT

SEQ ID NO: 49050 - protein, 320 aa, Nostoc punctiforme PCC 73102
MRIAKDITELIGRTPLVQLNKIPQASGAVARIVVKLESMNPASSVKDRIGASMVEMAEEAGLIHPGKTVLVEPTSGNTGIALAMVAAAKGYHLILTMPDTMSHERRSMLKAYGAQLELTPGVEGMRGAIGRAEQILAQTPNAYMLQQFRNPANPKVHAETTAEEIWNDTDGEVDILVAGVGTGGTITGVAEVIKGRKPSFQAIAVEPSSSPVLTGGKSGPHKIQGIGAGFVPAIYRPELVDEVIQVADEQAIAYSRRLAKEEGLLSGISTGAALYAAIQVAQRPENAGRLIVMIQPSFGERYLSTSLFKDPEENEWLSKV

SEQ ID NO: 49051 - protein, 561 aa, Bacillus thuringiensis serovar konkukian str. 97-27
MIHLKTHYTVSTYLLDRLSELGIEHIFGIPGDYNLAFLDDVIAHEKLEWIGNCNELNAAYAADGYARIKGIAALITTFGVGELSAINGIAGSYAENVPVIKITGTPTTTVMENGELVHHTLGDGKFNHFSNMYREITVAQTNLTPEHAVEEIDRVLRACWNEKRPVHINLPIDVYNKPINKPAGPILHKPILSNKETLDKMLLHAISKINSAKKPIILADFEVDRFHAKEYLYQFVEKTGFPIATLSMGKGIFPEKHPQFIGIYTGDVSSPYLRKRIDESDCIISIGVKLTDTITGGFTQGFTKEQVIEIHPYTVKITDKKYGPVVMKDVLQQLSDVIEHRNEETLDIKPFISESLSMTEEFNPKAQMVTQKRFWQQIYHFLQENDVLLAEQGTPFFGSAAIPLPNDTTYVAQPLWGSIGYTLPALLGTQLANLSRRNILIIGDGSFQLTVQELSTMLRQNLKPIIFLINNNGYTVERAIHGQIEPYNDIQMWEYTKLANVFGTEEKSQTFKVENETELQEVLTKISIDKDQLTFVEVVMSQGDQPELLAKLGKRFGQQNS

SEQ ID NO: 49052 - protein, 256 aa, Arabidopsis thaliana
MRAIQTHVITFCMLVIIVTSSTRAQKSPHVPNNHELSIAIEEMEKANYFSFVMLINMLPSVNPRFLANVTFLMPKDKTLSTSNIINQQDSVTEFLLRHSIPSSLLFEHLNLIPNGSIVPSSLPHYTLEISNGGRSNYFLNNVKIISRNICSLGSIKCHGIDGILQSPSTVDDDSPRNNHTLPFISCPSSHNNSDQNSHNNSYQNSSRPADHTLTAPPPVSSPISQPKSDSPSIHDVKMLTSIVIPLFGLLASLIGM

SEQ ID NO: 49053 - protein, 55 aa, Glycine max
MPRTTTLECSGCTPLRALTFDALGLIKVVEARDKQRGAPQVVERWGDLESSGSPL

SEQ ID NO: 49054 - protein, 223 aa, Arabidopsis thaliana
MDSDSWSDRLASATRRYQLAFPSRSDTFLGFEEIDGEEEFREEFACPFCSDYFDIVSLCCHIDEDHPMEAKNGVCPVCAVRVGVDMVAHITLQHANIFKMHRKRKPRRGGSYSTLSILRREFPDGNFQSLFGGSSCIVSSSSSSNVAADPLLSSFISPIADGFFTTESCISAETGPVKKTTIQCLPEQNAKKTSLSAEDHKQKLKRSEFVRELLSSTILDDSL

SEQ ID NO: 49055 - protein, 68 aa, Oryza sativa Japonica Group
MKDWAPAIIASALFALLCPGGILQMPGRNRPVDFMNMKTSLASIVVHAVIYGLLLMLFLVILEAHLYI

SEQ ID NO: 49056 - protein, 174 aa, Arabidopsis thaliana
MSLALSTAPMSRTIISATRRSQVSQPKAKKVKPANKRPTMSTSGFSGGTTKELTWKCVEGCGACCKIAKDFSFATPDEIFDNPDDVELYRSMIGDDGWCLNYDKATRKCSIYADRPYFCRVEPEVFKSLYGIEEKKFNKEAVSCCIYTIKTIYGTGSKELDSFNRAIRSSPSSS

SEQ ID NO: 49057 - protein, 90 aa, Triticum aestivum
MKLVFGTLLLCSLLLSFSFLEPVIAYEDSSYCSNKCADRCSSAGVKDRCVKYCGICCVECKCVPSGTYGNKHECPCYRDKLNKKGKPKCP

SEQ ID NO: 49058 - protein, 645 aa, Silicibacter sp. TM1040
MTDRPQTPLLDQIASPADLKRLSDAQLEQVAHELRQETISAVSVTGGHLGAGLGVVELTVALHSVFDTPKDKVIWDVSHQCYPHKILTGRRDRIRTLRMKDGLSGFTKRSESAFDPFGAAHSSTSISAALGFSVARDLGGVTEEGLGDAIAVIGDGAMSAGMAFEAMNNAGHLGKRLIVILNDNEMSIAPPVGALSSYLSRLYTEAPFHDLKAAAKGAVSLLPEPFREGAKRAKDMLKGMAMGGTLFESLGFSYIGPIDGHDMDQLLPVLRTVKARAAGPILIHAVTKKGKGYRPAEVARDKGHATAKFDMVTGEQKKAPSNAPSYTSVFGKTLTDLAAQDSKICAVTAAMPDGTGLNLMAERYPSRTFDVGIAEQHGVTFAAALAAGGMKPFCAMYSTFLQRGYDQVVHDVAIQRLPVRFAIDRAGLVGADGATHAGSFDIAFMANLPGMVVMAAADEAELKHMVATAAAYDAGPIAFRYPRGEGEGVEMPEQPEVLEIGKGRIIEEGSRVALLSFGTRLGEVRKAAEALAARGITPTVADARFAKPLDRDMILSLAEKHEALITIEEGAVGGFGSHVAQLLSEEAVFDTGLKFRSMVLPDTFIDQASPKDMYDSAAMNAEHIEAKVLDVLGVARLDERRLPAS

SEQ ID NO: 49059 - protein, 355 aa, Claviceps purpurea
MSRANPPNAGGSRKISFNVSEHYDIQDVVGEGAYGVVCSAVHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPPRVLFPKTSDLALDLLEKLLAFNPVKRITVEEALKHPYLEPYHDPDDEPTAPPIPEAFFDFDKHKDNLSKEQLKLLIYEEIMR

SEQ ID NO: 49060 - protein, 287 aa, Silicibacter sp. TM1040
MTAGFTAALLQAQTQILNHMDRRLPQADLLHQAMDYALRGGKMLRGFLVLESARLHDVPETAAIEAALAIECIHAYSLVHDDLPAMDDDDLRRGQPTLHRKWDEATAVLAGDSLQTLAFELLARDSVGPNALSLIRTLAQAAGKDGMVSGQMMDIAAETAETPLTLDEITTLQARKTGCLIEWSACAGARLAGADPAPLRHYAQALGLAFQIADDILDVEGDAATVGKAVRKDADAGKATFVSHLGLEGAKHRARELADLACAALAPYGAAGDTLKDAARFVISRDS

SEQ ID NO: 49061 - protein, 767 aa, Oryza sativa Japonica Group
MGIWYHKTREHTKLWVANRQAPLTDPESSQLSISSDGNMVLLDRATRSPVWSTNITGIAAAANSTVGVILNTGNLVLADASNTSAVLWQSFDHLDNTWLPGSKLRRNKLTGEATRLVAWKGSNDPTPGMFSLELDAGGGGASQHLRLAWNGSHQYWRGGGGNWTTAPEESGPEGQSPYTFLYVDAENESYVVFEVKDEALLSRIVVGVAGQIMLWGWVESAATWVLFWSEPTLCDVYSLCGSFSVCTDGSVPECGCLQGFVERQPRQWLYGDQTAGCARITGLQMPCGGGGQASGKTTKRDDTFFTMPKANSLPTGGVAAPSATASAHDDCELACLGNCSCTAYSYNGSCTLWYGDLINLRGANGSGTDGYRISIRLGVASDLSGTGNTKKMTIGLVVAGVVAAAVTLAVLVAVLVMRSRRAKALRRLEDSSSFLTVFTYRDLQLVTNNFSDKIGGGAFGSVFKGALPGDATPVAVKKLEGVGQGEKQFRAEVSTIGMIQHVNLIRLLGFCTDRTRRLLVYEHMPNGSLDRHLFGSGSGHGGGVLSWKTRYQIALGVARGLHYLHDKCRDRIIHCDVKPENILLDGAFAAKVADLGLAKLMGRDDSSRVLTTTRGTVGYLAPEWIAGTAVTAKADVYSYGMMLFEIVSGRRNVEQRRRQAEAADDDEYDSGAGGTVEADFFPLTAVRMLFDGDGDLRDAVDGNLGGEVDMGEVERACKVACWCVQDAESARPTMGMVVKALEGLVDVNFPPMPRLFMVGLSTGSSHT

SEQ ID NO: 49062 - protein, 897 aa, Nocardioides sp. JS614
MTTFVFDFAEGNRELKDLLGGKGANLAEMTNLGLPVPPGFTISTEACRAFLVEGREPDSLAAEVAEHLRALEDRMGRRLGDPADPLLVSVRSGAKFSMPGMMETVLDVGLNDESVVGLAQQSGDERFAADSYRRLLQMFGGTVLGIEHDAFSDRLDALKKRRGVIADTELGVADLHELVDEYKVVIREHTGSDFPQEPAEQLRLCILAVFKSWNTPRAALYRRQERIADDLGTAVNIQAMVFGNRGVDSGSGVAFTRDPASGEPGVYGDYLTNAQGEDVVAGIRNTVPLADLEQIDPASYRELMEIMATLEKHYRDMCDIEFTIEDGKLWMLQTRVGKRTPEAAVRIAVHMAEELLIDRDEAMLRVTGHQLAALMFPRFAPDPARRAVATGMNASPGAAVGRVVLDSATAVEWAGRGEQVILVRKETNPDDLHGMVVSQGILTSRGGKTSHAAVVARGMGRTCVCGAEALDVDPENRRFIVRNGPVVNEGDVISIDGSTGEVFLGEVPVSDSAVVRKLEGEDVDDPVASAVARLLRHADEVRRLDVRANADTPEDAQRARRFGASGIGLCRTEHMFLGDRRELVEHLIVAEDEPGQAAALDKLLPLQRQDFTEIFEAMDGLPVTVRLIDPPLHEFLPDLTELSVRVALEDERQVVDEHDHKLLKAVKRLHEQNPMLGLRGVRLGITIPGLFLMQARAIAEAAATRVLAGGDPRPEIMVPLVSTERELALVRAQLEEVVASVLDEQGVELHIPIGTMIEIPRAAVTADKIAHWADFFSFGTNDLTQMTWGFSRDDVESEFFAAYLEKGVFTASPFESIDTEGVGAMVRTAAELGRRAKPGLHLGVCGEHGGDPESIHFFHEVGLDYVSCSPFRVPVARWEAARAVLAAQATGPRSDVR

SEQ ID NO: 49063 - protein, 527 aa, Glycine max
MQSSPLLLEEPIRMASILEPSKPSFFPAMTKIVGTLGPKSRSVDVISQCLEAGMSVARFDFSWGDPEYHQETLENLRAAIKSTKKLCAVMLDTVGPELQVVNKTEHPISLQADTLVVLTPDQNKEATSNLLPVNFSGLSKAVKNGDTIFIGQYLFTGSETTSVWLEVSEVNGDDVTCVIKNSATLAGSLYTLHVSQIHIDLPTLDNKDKEVISTWGAQNNIDFLSLSYTRHAEDVRHAREFLSKLGNLKQTQIFAKIENIEGLTHFDEILREADGIILSRGNLGIDLPPEKVFLFQKAAIYKCNMAGKPAVVTRVVDTMTDNLRPTRAEATDVANAVLDGSDAIVLGAETLRGLYPVETISTVGKICAEAEKVYNQDLYFKKAVKFVGEPMTHLESIASSAVRAAIKVKASVIICFTSSGRAARLIAKYRPTMPVISVVIPQLKTNQLRWTFTGAFEARQSLIVRGLFPMLADPRHPAESKSATNESILKVALDHGKAFGIIKAHDRVVVCQKVGDSSVVKIIELDE

SEQ ID NO: 49064 - protein, 636 aa, Vitis vinifera
MEEESGGGPRVVAISLIEKATNSTASEVDPRLLKSIKSVVRSSDSELRIAAQTLMDLMKRDHAQVRYLALLIIDELFMRSKLFRTLLVVNLDQLLSLSVGFRRNQPLPAPAAVASILRSKAIEFLEKWNTSFGIHYRQLRLGFDYLKNTLRFQFPNLQANAARIQQERKEREMRSKEILLKKFETLKEKFSSIKEEIQLTMDEIRECLDIVRPKDESVPLDFIEDDEMEEFCSSELRQIRLDSLKEAEKVHENSDNKVVFDALRELYKLLVTRHLVSAQEWISVLIRVEVADNRSRDSMLKEFIDIRNHIQSVKKKCEESGCVLANTMNDEEEDFWEEGKIELSESDSFTAANKQSKDLAKASTSSKAKSEAPECSNKESNGNKRSKLLAEAPLMNWGSFLDNWGSKQDVLANQRGLELEGHWGRVDYDAVIPAEKIAELNIQTTVYKEERVDIQPCRAPLSKGGLCQRQDLRVCPFHGPIIPRDDEGKPIHENSSTEEITLDLGSDLVEQLAKQAVKNVRDRDKEETKKREYDKQALKRAKLAKVREHNEAVLREAAMASTSRSEAFGEDLGATNMDKPLARNKKQTLASMLRKKITTKDRLGQKLLNTRVRDETMRQLTLGEDANYREAFPNQW

SEQ ID NO: 49065 - protein, 281 aa, Triticum aestivum
  misc_feature (144)..(144): Xaa can be any naturally occurring amino acid
MASRRAVLALVVAVAASAASVAADDPDYSYVSGTKLGPENWAKLSPKYSACNGGAAARKQSPIDIVTKSAVPKPDLDPLTRTYVATDATLINNGKEISMTFNGKPGSVSIGGKAFSLKKLRWKTPSEHTINGKRHPVEVQLVHXATPGSGELAIIAILYKLGAPDSFYYQLKRKLAELAADRCSYGEQDARVATGLVHLRSLEKRTGSYFRYMGSLTAPPCAENVYWNVLGKVRQMTKEQIDLVTAPLPAAAKQNARPVQPLNGRVVTFYNPPNSTISFDM

SEQ ID NO: 49066 - protein, 489 aa, Vitis vinifera
MEGKAKAKAEALAILFSFLLLSFFSFTGADKPLEYQSLVVRPLGENPTTKSQLSWTETETQISTLPVSETDPTMTMHLEHRDVLAFNATPEALFNLRLQRDAFRVEALSKMAAAAGGRRAGRNGTHAQGGGFSSSVTSGLAQGSGEYFTRLGVGTPPKYVYMVLDTGSDVVWIQCAPCRKCYSQTDPVFDPKKSGSFSSISCRSPLCLRLDSPGCNSRQSCLYQVAYGDGSFTFGEFSTETLTFRGTRVPKVALGCGHDNEGLFVGAAGLLGLGRGRLSFPTQTGLRFGRKFSYCLVDRSASSKPSSVVFGQSAVSRTAVFTPLITNPKLDTFYYLELTGISVGGARVAGITASLFKLDTAGNGGVIIDSGTSVTRLTRRAYVSLRDAFRAGAADLKRAPDYSLFDTCFDLSGKTEVKVPTVVMHFRGADVSLPATNYLIPVDTNGVFCFAFAGTMSGLSIIGNIQQQGFRVVFDVAASRIGFAARGCA

SEQ ID NO: 49067 - protein, 606 aa, Magnaporthe grisea 70-15
MTSNAAPMTVPPAAPPSGMPIADTTAAQNEAVHSIGKETVNADDIERNAGSLNAEEKNESDASSEFKQDGVARAEAITKVWTTKTLWATFGLLYLVSTVDSMLGNVEGALSPYVTSAFGRHGLISTTSIVSTILGGVITLTIAKMINIWGRMEGLAGMVFLITIGMIMKALCQNVETYAAAQVMYWVGHIGLLLIINVTVADMTTLRNRMIIFGFNTSPLIISFFTGPLIADRFLKEVNFRWAFGAFAIIMIATTTPIIGVFIYNERKAKSVGLVREKPGRTFFESVKYYVVELDVVGLFLITVGASLLLLPFSLVNYVPGGWANGGLISMFVLGPALLAVFYIWEKKYAPVQFFPWVYLTNKTILGACSCYGLMFASIFCWDTYYYSYLQVAHSLSVVDASYTINSLSLSSAILGVFIGILIRYTGKVKWVAMAGVPFMILGTALLVRFRTPETSIAVLVVLQVLVGLASCVFALCSQMAVMATVKHNEVAPGLALHGLFGAVGAAIGQAIAGGIWNNLLPFKLMQYLPDEAKADAWTIFGDITVQQAATGAVRDAIDAAYGDMQHMMVIAGCCFAPFVIVAVWFWDDLDVRKVDEERGRVGNVF

SEQ ID NO: 49068 - protein, 382 aa, Thermosynechococcus elongatus BP-1
MPTPALLVLADGSVFRGFSFGAPGTAIGEVVFNTGMTGYQEVLTDPSYYGQIVTFTYPELGNTGTTPEDDESDRPQVRGAVARNICDIPSNWRSQQSLPDYLKAHRIPAIYGIDTRALTRKIRTVGAMNGGISTEILDPVELLQKVLAAPSMQGQNLAKVVTTRTPYEWTEPTPAAWEFRPQTATEEPPLTVVAIDFGVKRNILRRLASYGCRVIVVPADTPAETILSYDPDGIFLSNGPGDPAAVQEGIETTRKLLGAQRPMFGICLGHQLLGLSLGAETFKLKFGHRGLNQPAGLTQEVEITSQNHGFAITAESLAQTPVEITHFNLNDKTVAGLKHQTLPIFSVQYHPEASPGPHDADYLFGEFVAQMRAYRQQHPRRQ

SEQ ID NO: 49069 - protein, 158 aa, Glycine max
  misc_feature (19)..(19): Xaa can be any naturally occurring amino acid
YGSLLADEVVHTLLKRVPXRAPAILHDYHRFKIKGRVYPAILPVQNNKVYGRVLLGISGVELDILDEFEDVEYTRTDVEVSLKDKSEKLQVCAYVWSNPNDPNLYAEWNFEEWKQVHMNDFVKMTDGFRQELELPESKPRVQTYETFYKQENDKPLEP

SEQ ID NO: 49070 - protein, 534 aa, Cryptococcus neoformans var. neoformans JEC21
MPSGIPTRRVRLVDENAPPPPGAVVTRTRSRALASTTSTATNVKPTTTSIPMMKRQRSTISSENKIVDKSDVRRNALGEVRNGKGGEKEKESGKGKVVAIERKPLATTQAKAQRVTRSASAQPVMGVKDGDKKRKAVITSKIPSRSRSTGAEPAQVEVKPTIKTEEEPVRKRRKTSSPVVEVGEDGPTVDGKELLLSSGSKNATAFRSPKIKAKDDGWTDLDAEDEGDPTMVSEYVVEAFKYMMDIQGQTMPDPEYMDNQAELQWKMRQILMDWIIEVHSKFRLLPETLFIATNLVDRFLSKRVISLVKFQLVGLTALFIASKYEEVCCPGVEHFLHMSDGGYTVEELLKAERYMLSTLQFDMSYPNPLNFIRRISKADGYDIQSRTVAKYLVEISCVDHRLLGYTPSMLAAASMWLARLCLERGEWNANLVHYSTYSEDEIRPCAQVMLDHILDPDFDESTSFYKKYASKKHMKASVYVREWATQLWPASADGSAVERGTELELLKMFLEDEEEENNKGSKRRMKAVDEEEEY

SEQ ID NO: 49071 - protein, 481 aa, Xanthomonas campestris pv. campestris str. ATCC 33913
MFPGEPMSSVSIDGAPDAGENTRFIILISCVATIGGFLFGFDSGVINGTVDGLKQTFQSSAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWGGQAAWRWMFWMQAIPSLLFLLLLLVIPESPRYLVVKGRREQALVVLKRLYGNAAAQTKLGEISASMSADQHKPKFSDLISKTTGKIRPIVWIGVGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 49072 - protein, 201 aa, Carboxydothermus hydrogenoformans Z-2901
MSSFNLMLKNYFNDDLLQKLSRVKVLIIGCGGLGSHIAWMLIRCGFQNLKIVDFDRVELKNLNRQGYFFTQVGLPKVLALKDILTQINPGANIAIAVEKIDGKNVEKIIMSYDVIVEAVDDETTKALIFEAAMKLNKKVVAASGVAGFGDCERIKIKRGRNFVIVGDFATSVKDKKPYAPKVTAVAAIQADEVLRMVVEDE

SEQ ID NO: 49073 - protein, 812 aa, Thermosynechococcus elongatus BP-1
MTQSIPRPTSEITNRETAFVLELNALSCKDLPLVGGKNSSLGEMLQQLTPKGINVPDGFATTAYAYRYFIQAGNLETQLRRLLEGLDVEDVTELHRVGQTIRSLILHTPFPPELTDAIAAAYQKMCDRYGPNTDVAVRSSATAEDLPDASFAGQQETYLNVHGLKGVLDACHRCFASLFTDRAISYRQIKGFDHFNVALSVGVQKMVRSDLACSGVMFSIDTETGFKDTALITAAYGLGENVVQGAVNPDEYLVFKPTLKAGYRPILKKALGTKEIRMVYDLGGTKLTRNEPVPERLRKQFALTDEEILTLGRWACLIEEHYSDLRGAYTPMDIEWAKDGMTGELFIVQARPETVQSQKATNILRTYHLEEKGTLLATGRAVGEMIGQGRARVILNVRNIDQFQAGEVLVTHRTDPDWEPIMKKASAIVTDQGGRTCHAAIIARELGIPAIVGCGDATETIPNGAEVTVSCAEGEEGHVYQGLLPFHVAEVPLEKLPRTRTQILMNVGNPEEAFSLAAIPNDGVGLARMEFIIANHIQAHPLALLHYDELKDEAAKRQIAELTQNYSDKGEYFVDKLAQGIGAIAAAFYPKPVVVRMSDFKSNEYANLIGGRQFEPHEENPMIGWRGASRYYDPNYAEGFALECRAMKKVRDEMGLTNVILMIPFCRTPDEGRRVLAQMAKHGLKQGENGLQVYVMCELPSNVVLADAFAEVFDGFSIGSNDLTQLTLGLDRDSALVAHLFDERNEAVKRMVAQAIQTAKAKGRKIGICGQAPSDYPEFAQFLVAQGIDSISLNPDSVLKTMLQIAEAEKEA

SEQ ID NO: 49074 - protein, 287 aa, Cryptococcus neoformans var. neoformans JEC21
MFANSLRQGLRTASRSSARAFSTIPARAPRTNVVGALALGTAVAGYALYETTRSPVMLEGARTIAGEKGTVTERSFVMIKPDGVSRQLVGKASPTLPVSLVALGRSDETGSSPALRVCAFPLTRYGNLMHFLFGRAWLQARRASFISLSLGPITDIHPPFPAFATPKNSIKSLTPSDALAKEHYADLSARPFYPSLVKYITSGTPVVAMVWEGKDVIRQGRRIVGATNPLDADAGSVRGQYAVSVGRNLIHASDAFESATKEIGLWFAPEELSEYEPIAWPWVMADN

SEQ ID NO: 49075 - protein, 197 aa, Oryza sativa
PGSSNFQQHGVVTDPEAIDTLVRYSMACPALPTCGLAVTESERIMPSVNARLRDLLNSLDLPNESIVTRMTGCPNGCARPYMAEIGFVGSAPNSYQVWLGGSPNQERLAAAYTEKMPLEQLESLFEPLFVYFKQSRKGKESFGDFCHRVGFTALREFSHGYTAPAKGGKNRKNQRRVSLSDEMYAQLKGPSERDYSP

SEQ ID NO: 49076 - protein, 93 aa, Oryza sativa Indica Group
IVVIQGPKPGKPTDMSRMRQILLKLKHTPPPHMKPPPPPAAATGKDGAAGKDGAKVAAAASKDASANGSVPEMEKAAAAAAPAAAATEPIAAA

SEQ ID NO: 49077 - protein, 427 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKVDSLFNIESIMCKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 49078 - protein, 391 aa, Chromobacterium violaceum ATCC 12472
MKFNKLSEQNLSGKRALIRVDMNVPLKNGVIGDDTRIRASLPTIEHCLKAGAAVLLMTHLGRPTEGEPKPEDSLAPVVARLSELLGKPVRLIADFHAGVELAPGEVAMLENVRLNKGEKKNNDELGRAYAALCDVFVHDAFGTAHRAEASTHAVAKFAPVACAGLLLSAELDALGKALQAPARPLVAIVAGSKVSTKLTILEALADKVDQLIVGGGIANTFLLAEGKAIGKSLAEADLVEDARRVIAKIRARGGDVPLPADVVCAKEFAETAAAATKNVAEVVADDMILDIGPDAAKQLAAIIAQAGTVVWNGPVGVFEFDQFGNGTKTLAQAIAQSKAFSIAGGGDTLAAIAKYGITDDISYISTGGGAFLEFLEGKELPAVAILAERAQ

SEQ ID NO: 49079 - protein, 336 aa, Chromobacterium violaceum ATCC 12472
MTIRLAINGYGRIGRQVLRAIYENKLHDDFKVVAVNASGDLNINAHLTQFDTVHGRFPGSVEQDGEHLILNGDKIPFFSTRNPAELPWQALDVDLVLECTGAFTTKEKCQAHLNAGAKKVLISAPGGDDVDATIVYGVNHDTLTPEMTVVSNASCTTNCLAPVAKALNDAIGIKKGLMTTIHAFTNDQVLTDVKHKDLRRARSATDNMIPTKTGAAKAVGLVLPELKGKLDGFAVRVPTINVSLVDLTFTAMRDTCKDEINEILQGAAKGSMKGILGFNTLPLVSGDFNHTEEASTFDATLTKVTGGNLVKVLAWYDNEWGFSCQMLRTARAMFGR

SEQ ID NO: 49080 - protein, 402 aa, Populus trichocarpa
MATISNDGEDAARRRTAEADYRKKLLNHKELESRVRSTRENLKAAKKEFNKTEDDLKSLQSVGQIIGEVLRPLDNERLIVKASSGPRYVVGCRSKVDKEKLTSGTRVVLDMTTLTIMRALPREVDPVVYNMLHEDPGNVSYSAVGGLSDQIRELRESIELPLMNPELFIRVGIKPPKGVLLYGPPGTGKTLLARAIASNIDANFLKVVSSAIIDKYIGESARLIREMFGYARDHQPCIIFMDEIDAIGGRRFSEGTSADREIQRTLMELLNQLDGFDQLGKVKMIMATNRPDVLDPALLRPGRLDRKIEIPLPNEQSRMEILKIHAAGIAKHGDIDYEAVVKLAEGFNGADLRNVCTEAGMSAIRAERDYVIHEDFMKAVRKLNEAKKLESTAHYNADFGKD

SEQ ID NO: 49081 - protein, 393 aa, Oryza sativa Japonica Group
MRSSESSRFVQELVLYAASAALSCLVLFAGLRQLDPNRAASQKALQHKKEIAKRLGRPLVSTTPYEDVIACDVINPDHIDVEFDSIGGLDHVKQALYELVILPLRRPELFTFGKLLSPQKGVLLYGPPGTGKTMLAKAIAKESGAVFINVRISNLMSKWFGDAQKLVSAVFSLAHKLQPAIIFIDEVDSFLGQRRTTDHEAMTNMKTEFMSLWDGFTTDQNARVMVLAATNRPSELDEAILRRFTQIFEIGIPVQSERSKILRVVLKGENVEPNINYDYIAGLCEGFTGSDILELCKQAAFYPIRELLNNEKDGRKADKPRPLRQSDLEKALSTSRKGKRAANGTSTGLQSPVWIRPSDSEDDQVQSAIFEISKLMSRIVQNSQSEPQEPSSP

SEQ ID NO: 49082 - protein, 124 aa, Zea mays
MSKSATTSEMSTVSRASLDQKLALAKRCSREATLAGAKAAAVATIASAIPTLASVRMLPWAKANINPTGQALIVSTVAGMAYFIAADKKILSLARRHSFEEAPEHLKNTSFQGTGRPHPAFFRP

SEQ ID NO: 49083 - protein, 332 aa, Bacillus thuringiensis serovar konkukian str. 97-27
MNPLIFKGNRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETAEELV

SEQ ID NO: 49084 - protein, 360 aa, Glycine max
MGESNVMTKTEDGACLSAMLLSTNLVYPAVLNAAIELNLFEIIAKATPAGSFMSSHEIASKLPTQHPDLPNRLDRMLRLLASYSVLTTSTRTTHHGATETVYGLSQVGQYFVPDGTRGYLASFTAFVCYPPLLQVWLNFKEAMVDADIDLFKKIHGVTMYQYMENDPKMNQIFNKSMANLCATEMSRILEIYTGFEGISTLVDVGGGNGQNLKMIISKYPLIKGINFDLPQVIENAPPLPGIEHVGGDMFARVPQGDAIILKAVYHNWSDEKCIEFLRNCHKALSPNGKVIVVEFILPEEPEPTEESQLVSTLDNLMFITVGGRERTQKQYETLCKLSGFSNFQVACRAFSSLGVMEFYK

SEQ ID NO: 49085 - protein, 161 aa, Chlamydomonas reinhardtii
MPIAVGDKVPAATFHVPDANGMPQPLTTEQLFGGKKVLLFAVPGAYTPTCSKQHLPGFVESADALKAKGVDTIACLSVNDAFVMGAWGQSIGVGDKVTMLADGAAAFTKAVGLDQDLSEAGLGVRSQRYAMLVEDGVVKVLNVEPARGLTCSSAASMLEGL

SEQ ID NO: 49086 - protein, 487 aa, Bacillus thuringiensis serovar konkukian str. 97-27
MTVQTAQIVKNYIGGEWVESISTKMEAVYNPATGEVIAQVPLSTKVDVEQAVLAANEAFKSWSKTAVPKRARILFKYQQLLVDNWEELAKLITIENGKSYNEAYGEVLRGIECVEFAAGAPTLMMGKQLPDIATGIESGMYRYPIGVIGGITPFNFPMMVPCWMFPLAIACGNTFVLKPSERTPLLAARLAELAEEAGLPKGVLNIVNGAHDVVNGLLEHKLVKAISFVGSQPVAEYVYKKGTENLKRVQALAGAKNHSIVLNDANLELATKQIISAAFGSAGERCMAASVVTVEEEIADQLVERLVAEANKIVIGNGLDEDVFLGPVIRDNHKERTIGYIDSGVEQGATLVRDGREDTAVKGAGYFVGPTIFDHVTKEMKIWQDEIFAPVLSIVRVKSLDEAIEIANESRFANGACIYTDSGASVRQFRETIESGMLGVNVGVPAPMAFFPFSGWKDSFYGDLHANGTDGVEFYTRKKMLTSRWEK

SEQ ID NO: 49087 - protein, 137 aa, Triticum aestivum
  misc_feature (104)..(104): Xaa can be any naturally occurring amino acid
MPSTVNSASLDQNLELAKQCSREAALAGFKAAAVATVASAVPTLVSVRMLPWAKANINPAGQALIVSTVAGMAYFIAADKKILSLARQHSYENAPEHLKDTSFXGTAVAPRFFRLERTSNYRLSWTTILGRRSFSSI

SEQ ID NO: 49088 - protein, 444 aa, Bifidobacterium longum NCC2705
MQKFSNMPLSEVASAAVPAARRVAVPTAKPASLSAEALNIPRSGIRDVFDRVERVPDAISLTVGEPSATAAPHIVAAACEAAQAGRTRYTNVLGVPEYRKAVADYSARVKGLTYDPETEIQAVDGATIGLFLALKAVVGTGDEVIIPSPFFTSYDAEVMLCGGRPVTVALRPEHGMRVNAADIEAAITPRTRAVIINSPGNPTGAVTSAAELARIAEVCKQHNIWAISDEVYHPFVFGETFGETLGGEAAVAPSIAAVPGMKDRTIVVESLSKTYAMTGWRIGYLLAPEAVIEQTGKIAELMHSSVNSLAQYAGVAALAGPQDHVAAMREEYRAKRQIVLDGLAGCPVLRLIEPQGAFYAFVDVRLTGLDSGEFADRLLDEEHVAVVPGEAFGEEGRGFVRLSYAGDAGELREGVARLRAFAERVWNPITGHHTATYHPMEVLA

SEQ ID NO: 49089 - protein, 301 aa, Silicibacter sp. TM1040
MFCHMTQDTTRKTLLCFGFGYTARALAKILPRDAWRIIGTTRDRCEDQSESGVELMTWPGQDVPLRDVTHILLSISPSEDGDPVLNALGAEIAALPSLEWIGYLSTTAVYGDHDGGWVDEMTPATPSSQRGNWRVRAEEEWSSLAGLPLHIFRLAGIYGPGRGPFAKLMAGKARRIVKPGQVFSRAHVEDIAQVLKASIQAPNPGAIYNVCDDEPAPPQDVLGYAAELLGLPIPSEVPFDEAGMSPMARSFYGENKRVRNARIKDELGVKLRYPDYRSGLQAVFSAEDMEKFVPPADPPGV

SEQ ID NO: 49090 - protein, 354 aa, Vibrio campbellii AND4
MSKTFLRISAIALGLSMSALSMANTDLPNIKILATGGTIAGAGQSATESKYTAGQVGVDSLINAVPSMTKIADISGEQVVSIGSQDMNDEVWLQLAKRVNELLAQDDVDGIVITHGTDTLEETAYFLDLTVKSDKPVVIVGAMRPSTAMSADGPVNLYNAIVTATDEDSQGRGVLVAMNDTIFDARDVTKTNTTSVSTFQSPNFGPLGYIHNSDAKYQRNPERKHTTSTTFDVSKLDKLPQVGIVYNYANASSLPVKAFIDAKFDGIISAGVGNGNLYHTVFTELAKASKDGIVVVRSARTPSGATTLDAEIDDDKYGFVASGTLNPQKARILLMLSLTQTQNYKDVQKMFQRY

SEQ ID NO: 49091 - protein, 117 aa, Glycine max
DLCLITCSTSCLRLTKLGALLASGQLSDIVGVPTFKRTEEHALSLDIPLSVLYNIPRLDLAIDGTYEVDPDLNLVKGRGGSLLREKMVEASSDKFIVCRHDTMLVHVSCGSWLAMQV

SEQ ID NO: 49092 - protein, 397 aa, Physcomitrella patens subsp. patens
GFNWESWKSPSWYDIIGNRAEELAAAGITDVWFPPPSHSVAPQGYMPGRLYDLSASKYGNEEKLFETINKFHKAGVRCIADIVVNHRCGDAQDERGEWVIFEGGTPDDALDWGPWAVVGDDYPYGNGTGAPDTGADFEAAPDIDHTNERVQSDIINWMNWMKYKIGFDGWRFDFAKGYGGYFVGKYIEKTEPGFAVGELWTNMCYGYGGLDYNQDGHRQQLVDWVHSTHNRSTAFDFTTKGILQEAVKGQLWRLRDRNSKPPGMIGYWPEKAVTFLDNHDTGSTQNHWPFPSEHIMQGYAYILTHSGNPCIFYDHFYDWGLKDEITRLIELRKRNDINARSKVHIVTAENDLYVAKIDDCVILKIGPRYDMGHLTPNSGDYKIGAVGKDYCVWEKKN

SEQ ID NO: 49093 - protein, 571 aa, Lolium temulentum
MRKRGTNSFYRTLGGPPKFPELRPVECQCQRIDDLAGVIKAGNGTWANDMVNKASQVLGDVAVPGQALGGNASLSGNPEKVLPRRRNLSSVEDEAWDLLRESVVNYCGSPVGTIAANDPNDSNPANYDQVFIRDFIPSGIAFLLKGEYEIVRNFILHTLQLQSWEKTMDCHSPGQGLMPASFKVRTIPLDGDENATEEVLDPDFGEAAIGRVAPVDSGLWWIILLRAYGKCSGDLSVQERIDVQTGIKMILKLCLADGFDMFPTLLVTDGSCMIDRRMGIHGHPLEIQALFYSALLSAREMLTPEDGSADLIRALNNRLVALSFHIREYYWVDMQKLNEIYRYKTEEYSYDAVNKFNIYPDQVSPWLVEWIPPKGGYFIGNLQPAHMDFRFFSLGNLWSIVSSLATTQQSHAILDLIESKWSDLVAEMPLKICYPALENLEWKIITGSDPKNTPWSYHNGGSWPTLLWQLTVASLKMNRPEIAAKAVEIAERRIATDKWPEYYDTKRARFIGKQSRLYQTWSIAGYLVAKQLLDKPDAARILWNDEDTEILNAFSTNRKRGKKVLKKTYIV

SEQ ID NO: 49094 - protein, 339 aa, Nocardioides sp. JS614
MTRSSTVSTAEALVAPGKGILAADESTPTIAKRLAAIGVESTEPVRRAYRELLLTAPGLSEHISGVILYDETLRQRTDDGVPFGELVAGAGMIPGIKVDAGTADLAGFPSEVVTEGLDGLRRRCAEYVELGARFAKWRAVIKVGEGRPTRTCIEANAHALGRYAALAQEAGLAPIVEPEVLMDGSHTIDRCAEVTVAVLWAVYDQLAEQRVLLEGTLLKPNMVLPGAECPDQVDDETIATRTVTAMRESVPVAVPGIVFLSGGQTHQQATARLDAINRHGSQPWQLSFSFGRALQAPVLEAWGGDERNRDAAQAALLERAALNGAARYGSYRPEMERPR

SEQ ID NO: 49095 - protein, 294 aa, Zea mays
MEQYEKVEKIGEGTYGVVYKALDKATNETIALKKIRLEQEDEGVPSTAIREISLLKEMNHGNIVRLHDVVHSEKRIYLVFEYLDLDLKKFMDSCPEFAKNPTLIKSYLYQILRGVAYCHSHRVLHRDLKPQNLLIDRRNNALKLADFGLARAFGIPVRTFTHEVVTLWYRAPEILLGARQYSTPVDVWSVGCIFAEMVNQKPLFPGDSEIDELFKIFRVLGTPNEQSWPGVSCLPDFKTAFPRWQAQDLATIVPNLEPAGLDLLSKMLRYEPSKRITARQALEHEYFKDLEMVQ

SEQ ID NO: 49096 - protein, 237 aa, Brassica napus
MATAASSLTIASSFSEPRTQIRSSKRSNLPVLQFSIPYKANSRSRRLVVRSVSAPNVELRTGPDDLISSLLSKVANSDGGVTLTPEQHKEVAQVAGELQKYCVSEPVKCPLIFGDWDVVYCSRPTSPGGGYRSVIGRLFFRTKEMIQGIDSPDTVRNRVSFTALGFLDGDVSLTGKLNVLDSEWVQVIFEPPELKVGSLEFKYGFESEVKLRITYVDEKLRLGLGSRGSLFVFRRRQ

SEQ ID NO: 49097 - protein, 427 aa, Burkholderia vietnamiensis G4
MKNADLHARKNAATPRGVGVMCDFYAARAENAELWDVEGRRFIDFAAGIAVLNTGHRHPKIVKAIADQLNCFTHTAYQIVPYASYVELAEKINARAPGDYPKKTAFFTTGAEAVENAIKIARAATGRPGVIAFAGGFHGRTMMGMALTGKVAPYKLNFGPFPGDVFHAPYPNPLHGVTTADSIKAIEMLFKADIDPKRVAAIIFEPVQGEGGFNPAPADFVRALRKICNEHGIMLIADEVQTGFARTGKLFAMQQYDVLADLITMAKSLAGGMPLSGVVGRADVMDAAAPGGLGGTYAGNPLAVASAHAVLDIIDEEKLCERATQLGDALKAKLNALRADIAPIADVRGPGAMVAVEFVNPATGEPDADFTKRVQARALERGLLLLVCGVYSNVVRFLFPLTIPQAVFDEALTILEEVLKETVGVPA

SEQ ID NO: 49098 - protein, 487 aa, Burkholderia vietnamiensis G4
MSTENLALKDPSLLRQQAYINGEWQSAANGESFEVRNPATGGLLGTVPAMGAAETRQAIDAANAAWPAWRKKTAKERAAILRKWHDLMMENADDLALILTTEQGKSLAEAKGEIGYAASFLEWFAEEGKRVYGDTIPTPASDKRIVVTKEAIGVCAAITPWNFPAAMITRKVGPALAAGCPIVVKPAEATPFSALAMAVLAERAGVPAGVFSVVTGDPKAIGGELTSNPIVRKLSFTGSTPVGRLLMSQCAATVKKVSLELGGNAPFIVFDDADLDAAVQGAIASKYRNSGQTCVCTNRFYVHEAVYDAFAQKLAAAVGQLKVGRGTEPGVTQGPLINEAAVLKVEAHIEDALAKGATVVTGGKRHALGHGFFEPTVLTGVTPAMKVAKEETFGPLAPLFKFGSDDEVIRLANDTEFGLAAYFYSRDIGRVWKVAEALEYGMVGVNTGLISNEVAPFGGVKQSGLGREGSHYGIDDYVVIKYLCLAV

SEQ ID NO: 49099 - protein, 987 aa, Physcomitrella patens subsp. patens
MVRMAQQEWQQQGASNARRRSLETAMKEQQARTKVAVRHLPPSLSEAVFQDQIAGKYAGAYTWWSYHPGKNRSSRKRRQYVAHNPRNQFDAVGAIACSHKRQVYSRAYINFKKPEDVIDFYEDFNGHVFVNERVMDFCKHWNEGIFHFFCVGHHKLEVESGCDYTLVSRFLMLGDSSRTERLEECGAQYKALVEYAPYQRVPKPRSKKDVREGTIFKGATMIVITTVLINAPTIPTEPFDFSVPQEAFRLENLNHYSEVGNRSCSSILIGLCPGCADPEYLAFVEQLAKPAEYLPSAEIQLERREAEKAASLVSGTSKDAVVVTPLMEFVRSRRAAKSIPQVILPSSVSLFGMAMGDLEGVSASAYSLASQKRSSEKGRSGSSSYASDNASTSKESASHGPAPRDELQRKERETLIERKRKEAGEGKEKKSVREAVAAAIRANSGSHRGEASKEKSILLNKDLSEASSEGRPLRILSGSGESGSRTHTAGKVSAVNGSGENTTVADSREGHKREYKRKQLLIAREKDKEPAVESGQAAPAANGVSGNNQRHRSSGSTKVAAGAVQQAQSVTAYRATSPGKSGSSGKQNHRQESGGRISPRGSLPQGSSSPGAGSDHQAQSHASGTQVERVGKRPPRPQAIRLAGKDQAVSLLSSAEAEGQGGNGEEWSVKHVGSDGVAVTPSSSEKQDARRLRNKDRPDRPVWTPRRREGVTGKADGAASTNGVTSASGGSSTDGAPPTAQSGTDVGFKNDRTERSSGRQNGKSGSEVRSSVSHQTSGGSGNGTSGKLRYVETGGGIVRSGRGSSALGSQDGQSGSQGDAKSDGASGDGKNQDGKEARENGEPLMQSQEGRQQVVADDRKKQDGALWSESGKSCCLACGNHRQGGRRDRNGQQGAKEGDGGAPGADVISKLVKRGRGPPALGSNEVCEAKEAWSALQDLTTSECCGGMPKEMEEVGFFEHITASGLAAWMRNKLDIMDGTVMLAQKE

SEQ ID NO: 49100 - protein, 769 aa, Acidovorax sp. JS42
MTQPLSAAEAALREAALEYHRNMTRGKIAVTPTKPLSNQRDLSLAYSPGVAYPCLDIQADPTKAFDYTSRGNLVGVITNGTAVLGLGDIGPLAGKPVMEGKGCLFKKFAGVDVFDIELDARDPDKIIEIVAALEPTLGGINLEDIKAPECFYIERELSKRMNIPVFHDDQHGTAIISSAALLNGLELVGKQIDQVKVAVSGAGAAAIACVGVMVGLGVKVENIFMCDSKGVIYEGRPGGFDESKARYAQKTDARTLADAVNGADVFLGCSAPGVLTAEMVKTMADKPIILALANPEPEIRPELAKAVRPDCIIATGRSDYPNQVNNVLCFPYIFRGALDCGATKITEAMKLACVRQIAALAKENISEEVAAAYAGQELTFGPDYLIPTPFDSRLILKIAPAVAQAALESGVASRPIEDMEAYKESLSRFVYQTGILMRPVINAAKTLPDAQKRVAYADGEDERALRAAQFAIDDRIAHPILIGRPAVIAARIAKAGLRMQPGKDVEICDPSDDPRFRQYWEAYHQLMKRDGATPEVAKAAVRRSNTIIAALMVKLGDADAMICGLVGTYETHLERIHSILGHAPGVQQYAALNALMTTNNGTLFIADTYVNEDPTAEQLADIAWSSVQEVQRFGIPPKVAFLSHSSFGSSKRASARKMRAARDLFVARHPEIECDGELHGDAALEPKIRNNYLPDSTLTGSANLLICPNIDSANILYNVLKTTTSGGVTVGPILMGTSATAYILTPAATVRRVLNMTALAVASSAARRK

SEQ ID NO: 49101 - protein, 272 aa, Zea mays
MHALVRPWDTLPVLLLSRLCMVLLDALRAGWLGSVDEDEEDFSYRRNAGNGPARWGLIRREWATCNVGLLQSPIGLSDTLAGLADRSGRLGRSYRPAAASLVNRGHSIMVRFNSNPGGVVIDGVAYRLRQMHWHAPSEHAINGRRYALELQMVHQSDTNRYAVVSQLYRISRRRPDRTIHRLERYIRRIIARRKNHEELIDEEVDPRRPVSRSTAYYKYTGSFTTPPCTEGVTWVVAHQGTRSNRRPLQEANGRAITFYYTSPAHGRGANGD

SEQ ID NO: 49102 - protein, 306 aa, Lactobacillus johnsonii NCC 533
MIQLEKLVKKNLPKEKEGKVASYIPALAEVNPKQLGIALYDLEDGEVGEAGQSEVRFAIESISKVITLMLAIKKMGIQEVFKHVGSRQTGFAFNSILNMEIERAKYPLNPFINAGAIATTSMVVSKTGDDAFEEILDFARDICNDPDLYLDQIIYHSERRTGNLDRSLAYYMESKNMMLGDVVTSLDTYFKQCSMMVTARSLANLGAVLANGGVKPWDNKRIIPDEEARCIKSLMMTTGLYNQSGTYSRLIGVPTKSGVGGGLMSAAPHKYGIGIFSPALDKDGNSIAGLDLLRDIVDGLELDIFD

SEQ ID NO: 49103 - protein, 275 aa, Zea mays
MASSAVIVPASPRKLEGKVAVITGGASGIGERTARLFVEHGAHVVVADIQDEAGARVCADLGAGAASYVHCDVTSEDDVAAAVDHAVATFGALDIMFNNAGVSGPACYSVRESGKADFERVLAVNLVGPFLGTKHAARVMVPSRRGGCIIGTSSVAAAVTGVSSYAYACAKRAMVTLTENAAAELGQHGIRVNCVSPAGVATPLTMRYMGLEAEALEQAMEGMANLKGVGALRVHDVAAAVLFLASDDARYISGHNLFVDGGISVANPSTGTSKD

SEQ ID NO: 49104 - protein, 134 aa, Populus trichocarpa
MAASTLQYHFAFFIFFLVIASFSPRIQAQVDETSLKAMRDALEWPMSMYYDESSGLNDGLVGFDDGVVDDEESSRRSLFWRRTHYYISYGALSANRIPCPARSGRSYYSHNCFASRAPVNPYSRGCSRIARCRR

SEQ ID NO: 49105 - protein, 474 aa, Rhodopseudomonas palustris CGA009
MMERTNLLTSFQEFGLADPIARALQEENYHTPTPIQAQTIPLALAGRDVVGIAQTGTGKTASFALPILHRLLQNRIKPASKTCRVLVLSPTRELSGQILDSFNAYGRHVHLSAALAIGGVPMGRQVRSLMGGVDVLVATPGRLLDLVQGNALKLTQVEFLVLDEADRMLDMGFINDIRKIVAKLPIKRQTLFFSATMPKDIADLAEQMLRDPARVAVTPVSSTVERINQRVIQLDHSAKPAALAQILKDDKVNQALVFTRTKHGADKVVKGLARAGITADAIHGNKSQNYRERVLAAFRTGELRTLVATDIAARGIDVDGVSHVVNFDLPNIPETYVHRIGRTARAGADGTAISLCAGEEMAYLRDIEKLIKVSLPKEDRRTPGAHAAPTPPPHRGPRQAPHGHSPRNGDAPTRGKNHRRRGPAAGPARQSDASRHEAAPRPQHGGNGEGLQGVAFLQRKNRPAQPTAQHRPHR

SEQ ID NO: 49106 - protein, 206 aa, Prunus persica
YFALPPSVYPSVCRMIRHCCMNKTDLGGWTRIVVEKPFGKDLESAEQLSTQIGELFEESQIYRIDHYLGKELVQNLLVLRFANRFFLPLWNRDNIENVQIVFREDFGTEGRGGYFDEYGIIRDIIQNHLLQVLCLVAMEKPISLKPEHIRDEKVKVLQSVLPIEDDEVVLGQYDGYRDDPTVPDHSNTPTFSTVVLRIHNERWESL

SEQ ID NO: 49107 - protein, 348 aa, Glycine max
MDALRKQASKLREQVAKQQQAVIKQFSSSGYESSDVVVIDEVEMQRHHQLEKLYRATRSGKDFQKEIVKAAETFTAIGYKHIETGTKLSEDCCKYGAENNSDNILAKAASVYGDARKHVEKEHEELNRLLSTQVLDPLRQMINGVPLEDARHLAQRYSRMRQEAEAQREEIVRRQARVREAPTAEQVAKLHAAEAKMQELKANMAVLGKEAAAALAAVEAQQQRLTFQRLVAMVEGEKTFHLRVAAILGEIEAEMVSDRQKKESAPPVGISENGSEKTMYFLAEATHPFSAESEKELSFSKGDFVVVRKVSPSGWSEGECNGKAGWFPSAYVEKRQRIPSSNMAGEVY

SEQ ID NO: 49108 - protein, 441 aa, Pseudomonas syringae pv. tomato str. DC3000
METSNPASNGPAASIAGQKTTSSRLKSIFSGSVGNMVEWYDWYVYAAFSLYFAKAFFPKGDTTAQLLNTAAIFAVGFLMRPIGGWLMGLYADYKGRKAALMASVLLMCFGSLIIALTPGYESIGVGAPILLVFARLLQGLSVGGEYGTSATYLSEMATKERRGFFSSFQYVTLISGQLIALAVLIVLQQTLTTEQLYAWGWRIPFVIGALCAVVALFLRRGMEETESFTRKKKEKRKESLMRTLIRHPKELMTVVGLTMGGTLAFYTYTTYMQKYLVNTVGMSITDSTSISAATLFLFMLLQPVVGALSDKIGRRPILIAFGVLGTLCTVPILTTLHTIQTWWGAFFLIMAALIIVSGYTSINAVVKAELFPTEIRALGVGLPYALTVSIFGGTAEYIALWFKSIGMETGYYWYVTACIACSLLVYVFMKDTRKHSRIETD

SEQ ID NO: 49109 - protein, 339 aa, Physcomitrella patens subsp. patens
MDHAADAMRTDLMTITRHVLNEQSKFPEARGDLTILLNNIVLGCKFVCSSVSKAGLAKLIGLAGETNVQGEEQKKLDVLSNDVFINALVSSGRTNVLVSEENEDAIFVEPSKRGRYCVVFDPLDGSSNIDCGVSIGTIFGIYMLKEGASGTVEDVLQPGTAMLAAGYCMYGSSCTLVLSTGAGVNGFTLDPSLGEFILTHPDIKIPKKGKIYSVNEGNAKHWDGPTTKYVENAKFPKDGSSPKSLRYIGSMVADVHRTLLYGGIFMYPGDKKSPKGKLRVLYEVFPMSFLVEQAGGQSFTGKQRSLDLVPAHIHDRSPIFLGSYDDVEEIKALYAAESA

SEQ ID NO: 49110 - protein, 540 aa, Mesorhizobium loti MAFF303099
MQQKPTRKPTLALPDGHHYHKSSFYFGDRAMKDVLKELERRREIARMGGGQARIDAQHKKGKLTARERIEVFLDEGSFEEFDMYVEHRSTDFGMEKTKIAGDGVVTGWGTVNGRPVYLFAKDFTVFGGSLSEAHAEKVIKVQEMALRNRAPIIGLYDAGGARIQEGVAALGGYAEIFQRNVLASGVIPQISVIMGPCAGGDVYSPAMTDFIFMVRDTSYMFVTGPDVVKTVTNETVTAESLGGASVHTTKSSIADGAYDNDVEALLQMRRLVDLLPASNTSDIPEIECYQSVTDHDLSLDRLIPDNANKPYDVKELILKVADEGDFFEIQQSFAKNIVTGFGRVEGRTVGFVANQPMVLAGVLDSDASRKAARFVRFCDCFSIPIVTFVDVPGFLPGTAQEYGGLIKHGAKLLFAYAEATVPKITVITRKAYGGAYDVMASKHLRGDMNYAWPTAQIAVMGARGAVEIIYRKDIGDAEKIASHTKTYEDRFLSPFVAAERGYVDEVIMPHSTRRRIARALRMLRNKDMQNPWKKHDNIPL

SEQ ID NO: 49111 - protein, 467 aa, Mesorhizobium loti MAFF303099
MPSNVTAELSGFAALGITGALLKATHNAGFTEPKPIQMQAIPPQLEGRDIFGIAQTGSGKTAAFALPILSKIIALGTKRRAKTTRALILAPTRELAVQIEDTIKILAKGAHVSTALVLGGVSRFSQVKKVAPGVDILIATPGRLTDLVREGDLILSDTKWLVLDEGDRMLDMGFINDVKRIAKATAPDRQTALFSATMPDEIAELAKGLLKNPVRIEVSPQSTAAAEIVQGVVFARTKQKRQVLSTMLADEAMKSVIIFSRTKHGADRVTKDLERDGFKAAVIHGNKSQNARQKALNDFREGSVRILVATDIAARGIDVPGISHVVNFDLPDEAESYVHRIGRTGRNGMDGIAITLCDPSENSKLRQVERIIRTKLPIVADHLGSPDPQRNPAEKNERFEPANDRNDRNGRRDGRRPGGENKGNGFGKKRFGDKPAFAGERKPEGAKPFKGNNKRRFGGKRPAARAA

SEQ ID NO: 49112 - protein, 340 aa, Triticum aestivum
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPGVVVDLPTLTEKDREDILQWGVPNKIDMIALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLFKHNKVGTGGGKG

SEQ ID NO: 49113 - protein, 504 aa, Xanthomonas campestris pv. campestris str. ATCC 33913
MTHTNGFDALHAHAQRLRGAAIPALLAAEPQRPTQYARQVGPLYFNFARQKYDRAALDALFAIARERDLAGAFQRLFRGEQVNVTEQRAALHTALRGDLTDAPVASDAYATAAEVRQRVGALIQQLEGTDVTDIVSVGIGGSDLGPRLVADALRAPSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLDGAAQFDAHVLNTPLEENVAVLHGLTAVWNRNLLGSATHAVMTYDQRLALLPAYLQQLVMESLGKRVKLDGAAVDSDTVAVWWGGAGTDVQHSFFQALHQGTSVVPADFIGTVHNDDPYAENHVALMANVLAQTEALANGQDSSDPHRSYPGGRPSTVILLDALTPQALGALISMYEHSVYVQSVMWGINAFDQFGVELGKQLASQLLPALKGEAADVADPVTRELLAKLRG

SEQ ID NO: 49114 - protein, 220 aa, Brassica napus
MPVKWVLYWQPNQGSTVSTQILNESAQCVESINGVKEGRWKAALNYYKPMLRDQSTHPDLPRDFLGISLADQPTKYYFVIRSQRLVVEADASIQLIMEKLQSYKSKVSIYFDGFQYLLGDFRLRVGRVVPVHSETIRGIVMEVEYLPISSMEKARKVMEEFVEIWHEALSKRSLSGKFVNSELNFGEFGLADTYTPQHTGVQYAIVMAHMIATVQPVVRG

SEQ ID NO: 49115 - protein, 386 aa, Aspergillus flavus
MTGLDMETIFAKIKEEYARTDDVGKRKIQGHIRELQVGFYSDWDVVMRLSSGPLQVALAKVGIDLGIFRSLKESDTPITLAEFVKKTGASPRLLGRILRTQAAFGLIKETGPQEYTSSAFTDVFANPAAAGAVVQLFDISGPCTQILPDFLAERHYQDITSNKDCVFQKAFDSELTMFEWMPQHPKHMESLGHLMALERPVSWVDHFPVLEELGDFPAPDKVLMVDIGGGFGQQSKALRAKFPNLPGRVIVQDIPQTLTNAQPAAGVEFMEHNFFEPQPIRNAKFYYLRHVFHDWPDEQCVLILKQIIPAMGPESQILIDEMVIPSTGVPWQAAFTDLLMMNSLGGVERTRAEWDDLMEQAGLQIIQSKVYDSKEQAILVAVPKRT

SEQ ID NO: 49116 - protein, 344 aa, Mesorhizobium loti MAFF303099
MPRSVIDAIGNTPLIRLNKASEETGCEILGKAEFMNPGQSVKDRAGLFIIRDAERRGLLKPGGVIVEGTAGNTGIGLTLVAKALGYRTVIVIPDTQSQEKKDTIRLLGAELIEVPAVPYKNPNNYVKLSGRLAEQMARTESNGAIWANQFDNVANRDGHIRTTAEEIWAQTGGKVDGFVSAVGSGGTLAGVAFGLKAKSKDVKIALADPLGAALYSFYTSGELKSEGSSITEGIGQGRITANLEGFTPDFSFQIKDEDALPIVFDLIQEEGLCVGGSTGINIAGAIRLARELGPGHTIVTILCDYGTRYQSKLFNPEFLREKNLPVPGWMELQSKISVPFEKVE

SEQ ID NO: 49117 - protein, 269 aa, Thermomyces lanuginosus
EVSQDLFNQFNLFAQYSAAAYCGKNNDAPAGTNITCTGNACPEVEKADATFLYSFEDSGVGDVTGFLALDNTNKLIVLSFRGSRSIENWIGNLNFDLKEINDICSGCRGHDGFTSSWRSVADTLRQKVEDAVREHPDYRVVFTGHALGGALATVAGADLRGNGYDIDVFSYGAPRVGNRAFAEFLTVQTGGTLYRITHTNDIVPRLPPREFGYSHSSPEYWIKSGTLVPVTRNDIVKIEGIDATGGNNQPNIPDIPAHLWYFGLIGTCL

SEQ ID NO: 49118 - protein, 589 aa, Physcomitrella patens subsp. patens
MEAADWKAPHRSVQEASLRGCTAANPLDILVIGGGATGCGVALDAVTRGLRVGLVERDDFAAGTSSRSTKLVHGGVRYLEKAFWKLDYGQLKLVFHALEERAQILQNAPHLCKPLPTMTPCYEWWELPYYWVGLKAYDLVAGRRMLHLSRYFSKQESMEAFPTLALQNSHNKTLKGTVVYYDGQMNDSRLNVAIACTAALAGAAMMNHAEAVSLKKDPKSGKIIGARIRNNLTNKEFDVYANVVVNAAGPFCDEVRGLADGKASHIISPSSGVHIVLPDYYSPDNMGLIVPKTKDGRVVFMLPWLGRTVAGTTDSAATLTMSPEPHEEEIQFILDAISDYLTVKVRRSDVMSAWSGIRPLATDPNVKDTDTASISRDHVVCVDPDGLVTVTGGKWTTYRSMAEDAVNAAIKSGSLRPGQDCLTHQLPLMGAYGWDPASFTVLSQTYLRMKRSYGGKIVPGAMDSAAAKHLVDSYGGLAARVAHIAQAEGLGKRLAHGYPYLEAEVAYCARHEYCESVVDFISRRARLAFLDTNAATRALPRVIEILAAEHGWDRHKKKMELEAAKAFLETFKAAKNAQFDDGKHSKMHA

SEQ ID NO: 49119 - protein, 398 aa, Thermotoga maritima
EKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELVEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPGIASMRIKKA

SEQ ID NO: 49120 - protein, 284 aa, Oryza sativa Japonica Group
MRSLRLRSGRRRGESGGDQAGALILSWVDANYRFVGSDTWSNVLRESWFFNNWKELLVPVSLSTFLLLGLKTPFSLPSTDSIQPSRPCGWLGVSTILGLMLEVSTSDPIFSILLLFHGYLDEQFCQVEDLQDEASPNFVEEVVTLFFKDSGRLMSNIEQALEKYPRDFNRWDTYMQQLKGSCSSIGASRMKNECMSFRDSCGQGNVEGCMRSFQKVKREHAVLRQKLESYFQLLRQAGPAGAATRPVICVRVHGRKNRKASLPTTASQRSRHVIQTPPNLRSNW

SEQ ID NO: 49121 - protein, 365 aa, Acidovorax sp. JS42
MSKTYRIACIPGDGIGKEVIPAGQAVLEALAASQPGLGFAFTSYGWGGDWYRAHGEMMPADGLQALRDKDAILFGSAGDPHIPDHITLWGLRLKICQGFDQYANVRPTRILPGIDAPLKRCAPQDLDWVIVRENSEGEYAGVGGRVHQGHPLEAATDVSMMTRAGVERIMRFAFKLAQSRPRKLLTVVTKSNAQRHAMVMWDEIAVQISREFPDVRWDKELVDAATARMVNRPASLDTIVATNLHADILSDLAAALAGSLGIAPTGNIDPERRYPSMFEPIHGSAFDIMGKGLANPVGTFWSCVMLLEHLGEHAAAQRLMRAVEHVTANPALHTGDLGGQATTQQVTDAVCAQLAQPVGQQAALA

SEQ ID NO: 49122 - protein, 379 aa, Rhodococcus sp. RHA1
MEQTRCCAVSPAPGDTARQSVTGPRQQPNRTEETTPMTDSPLDLTYAAAEDRYEKVPYHRTGNSGLDLPAFSFGLWQKFGSDYAFATQREIILHAFDLGITHFDNADRYGPPHRAAQKNFGAVLAKDLAPYRDELILSTKAGNPIGPSPYLKGGSRKSILTSLDHSLRDLGTDYVDIFYHHSPDLSTPLEESVGALVSAVEQGKALYVGISNYLPDRTHEAAELLRQAGVPLLIHQARYSIYDRRPEQNGLLDTARQDGFGLIVYSPLAQGLLTDKYLETIPERARAQNSAFLTPDVIDETYRQRTAELNKIAEARGQSLAQLALQWVLRRQEVTSALIGASSTEQLDHNIAALNFPPLTDEELALIEEHGVHGTGLRL

SEQ ID NO: 49123 - protein, 491 aa, Burkholderia vietnamiensis G4
MTNKPNQTEAEQPVDMIIFGGGGDLAARKLLPALYMAHLHCNLPPDTRIIAVGRRDWGIDGYRQFMDEQSRPFIDAKAFDADAWARFLDLFKYVLIDVNAPQDYARLGEAARSDAIRVFYLSTSPELFTTICDNLSAAHLVDARSRVVLEKPLGHDLASAQAINDAVGKHFAESQIYRIDHYLGKETVQNLMVLRFGNPIFGPLWQAPSIRSVQITVAETVGVGSRAGFYDHTGALRDMVQNHLLQLLCIVAMEPPVSLDPDAVRDEKLKVLRSLRPMALSDVARDTVRGQYTAGAVDGQPVKGYLEEDNVPADSHAETFVALRAYVNNWRWANVPFFLRTGKRLQRRQSEIVIEFADMPFSIIPSGPRHYSNRLVIQLQPEESIQLQMLAKEPGSGMKMVPVSLNLDLQQAIPERRAEAYERLLIDVIRGRLTHFMRRDELEAAWSWVEPILDGWKQLGDRPRLYTAGTFGPAASSALLARDNMSWSEEA

SEQ ID NO: 49124 - protein, 470 aa, Rhodococcus sp. RHA1
MTILDPPTVDAASLGVYDSITDAIGNTPLVRLNRVTGSISATVYAKLEFLNPGGSVKDRAALAMIHAAEESGELLPGGTVVEGTSGNTGVGLTLVAAARGYRSVVVVPDKTSVEKIALLRAHGAQVHVTPGGRPSHHPEFVRNVATRLAAEIPGGWLAGQYDNPANPDAHRTTTGPEIWRQTRGRVTHFVAGVGTGGTITGTGEFLTKISGGAVKIIGADPETSVYGGGDGRAWYIESVGHFLHPQTEHDEWPDSYHPDVVDRLERIPDIEALTVLHRLAREEGLLVGGSAGTAVAAALRVARTLGPDDVVVVIVPDSGRAYLSKYFDNEWLGRLGFPLYHAATGPVVRDALGGRGIAPRAVPSTATVAEARELLADTPALPVVLARPVTGPVVVAEIQGTVSAAALSDAPDDDPIGVHVDQPLPVVGVTEELSVAVRRIAGHRGPVVVSENGRAVVLVDADVVRTSPVA

SEQ ID NO: 49125 - protein, 324 aa, Chromobacterium violaceum ATCC 12472
MSQAIVFAETGGPEVLRLQSAEVGQPGPGQARVRHTAIGVNFIDTYQRSGLYPTPLPSGLGSEAAGVVEAVGEGVAGLRPGDRVAYAGGPLGAYSTERLIAAEHLVKLPDGIADETAACAMLQGMTVEYLVQRTFPVQPGQTVLWHAAAGGVGQIALQWLSAMGVQVIATVGSQAKAEIARSLGAAHVILYREEDVAARVREITGGRGVPVVFDSVGKDTFESSLDSLAPRGMMITFGNASGPVPALSPLELTKRGSLFLTRPKLGDYIASRTDLEASSAALFSRLRDGTIKLSPSHRYPLAEAAQAHRDLEARRTTGSIILQP

SEQ ID NO: 49126 - protein, 485 aa, Acidovorax sp. JS42
MSASSPHGLLINGEWVSTSQAAPNTNPSNLADVVGEYAQGDASHVDAAVAAATAAFPAWSTSGIQARHDALDKIGNEILARREELGALLAREEGKTRAEGIGEVARAGQIFKFFAGECLRLAGETVPSVRPGIGVEVTREPIGVVGLITPWNFPMAIPAWKIAPALAFGNCVVLKPADLVPGSAWALAEIIHRSGIPAGVFNLVMGRGRVIGEALVQHPGVAAISFTGSVGVGRGIAQACVQNGKKVQLEMGGKNPQVVLDDADLAQAVELSAQSAFYSTGQRCTASSRLIVTQGIYPKFIEALQARMAKIKVGDALATGTDVGPVVSQAQLEQDLSYVEIAKAEGGVLAAGGLRAACHTGSGNEGFFMAPALFVDTAPAMRINREEVFGPVASVIRVRDYDEALAVANDTEFGLSAGIATTSLKYATHFKRHAQAGMVMVNLPTAGVDYHVPFGGRKGSSYGPREQGRYAQEFFTTVKTAYTLA

SEQ ID NO: 49127 - protein, 277 aa, Zea mays
MERPPSFPPVVPLTTLPRRRPRQPAHRRLRPAWSTPKRPRPASSMFLAGCSVEYKMSISDFVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFDVCFRQMKAFADSISNWADVVIAYEPVWAIGTGKVATPEQAQEVHAAVRNWLKTNISPDVASSTRIIYGGSVNAANCAELAKKEDIDGFLVGGASLKGPDFATIINSVTAKKVAA

SEQ ID NO: 49128 - protein, 453 aa, Geobacter sulfurreducens PCA
MKICVIGTGYVGLVAGTCFAESGNTVVCVDVNEEKIAGLREGVIPIYEPGLKEMVIRNSAEGRLTFTTDLAAAVKTSLVNFIAVGTPPGEDGSADLKYVLDVARAIGSHMEGFKIIVDKSTVPVGTADQVRRAVQEELDRRGVSYEFDVVSNPEFLKEGAAIDDFMKPDRVVIGVDNVRTAELMKELYSPFMRKTNRMILMDVRSAEMTKYAANAMLATRISFMNQIANLCERMGADVSAVREGIGSDSRIGYDFLFPGVGYGGSCFPKDVKALVRTAEECGYDFMLLKAVEEVNERQKMLIPEKILRHFSGDRAGESRPLAGKTIAVWGLSFKPRTDDMREAPSIVVIERLLAEGASVRAHDPEAVKEAQKIFGDRIAYSCSSPYDILAGADALAIVTEWNEYRNPDFERIAEQLRTPVIFDGRNLYNPRRLKEMGFIYHGIGRNGSGFVEK

SEQ ID NO: 49129 - protein, 318 aa, Oryza sativa
  misc_feature (242)..(242): Xaa can be any naturally occurring amino acid
MAALHHQAAAAPVTTTTDGGELRAMDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFAELATNQPLFAGDSEXLLGTPNEQVWPGVSKLPNWHEYPQWNPSKVSDLVHGLDADALDLLEKMLQYEPSKRISAKKPMEHPYFNDVNKELY

SEQ ID NO: 49130 - protein, 299 aa, Oryza sativa
MGKIPGSAVAMATPPEPSSWLSLKVFFLRVSRCEVNESMLDSVTVTHAPLTPDTVLEVSGGSVASNGHVSLRLDRAGGVGAAATEGGDSCTFVSTADVRVSGSARFDVQCGGERLVVGILDTRDAGAGGGGWVMKCQVAAQRGSGLVRRGSKEAKPPVVEVYVAGLARGAPVVFTRAMQLRFRRRRHVKAFMEPIPEHGEPAEDSKETLHPKHETEVSEYRCYKPEQDAGDADYDGFYVKPAGEEDDDGDFSWFTAGVRVGVGISVGICLGIGIGAGLLARSYHSTSRSLRSRLISSLF

SEQ ID NO: 49131 - protein, 638 aa, Azotobacter vinelandii
MSEIIRVPDIGGDGEVIELLVKTGDLIEVEQGLVVLESAKASMEVPSPKAGVVKSVSVKLGDKLKEGDAIIELEPAAGAAAAPAEAAAVPAAPTQAVDEAEAPSPGASATPAPAAASQEVRVPDIGSAGKARVIEVLVKAGDQVQAEQSLIVLESDKASMEIPSPASGVVESVAIQLNAEVGTGDLILTLRTTGAQAQPTAPAAAAAASPAPAPLAPAAAGPQEVKVPDIGSAGKARVIEVLVKAGDQVQAEQSLIVLESDKASMEIPSPAAGVVESVAVQLNAEVGTGDQILTLRVAGAAPSGPRARGSPGQAAAAAAAAPAPAPVGAPSRNGAKVHAGPAVRQLAREFGVELAAINSTGPRGRILKEDVQAYVKAMMQKAKEAPAAGAASGAGIPPIPPVDFAKYGEIEEVPMTRLMQIGATNLHRSWLNVPHVTQFESADITELEAFRVAQKAVAEKAGVKLTVLPLLLKACAYLLKELPDFNSSLAPSGQALIRKKYVHIGFAVDTPDGLLVPVIRNVDQKSLLQLAAEAAELAEKARSKKLGADAMQGACFTISSLGHIGGTAFTPIVNAPEVAILGVSKASMQPVWDGKAFQPRLMLPLSLSYDHRVINGAAAARFTKRLGDLLADIRAILL

SEQ ID NO: 49132 - protein, 424 aa, Triticum aestivum
  misc_feature (243)..(243): Xaa can be any naturally occurring amino acid
  misc_feature (250)..(250): Xaa can be any naturally occurring amino acid
  misc_feature (259)..(259): Xaa can be any naturally occurring amino acid
  misc_feature (265)..(265): Xaa can be any naturally occurring amino acid
  misc_feature (318)..(318): Xaa can be any naturally occurring amino acid
  misc_feature (346)..(346): Xaa can be any naturally occurring amino acid
VTFRTSLYKKAGCYRSGIPGISSTHASGLGRNRRRIIIGSAVGASVALFGLLSLFFLLMTRRMCARRMKNLQGDGGIIMFRYADLQRATKNFSEKLGTGGFGSVFKGVLNDSSAIAVKRLDGARQGEKQFRAEVRSIGTIQHINLVKLIGFCTEGDRRLIIYEHMQNRSLDAHLFHSNATGLKWSIRYQIAIGVARGLAYLHDSCRDCIIHCDIKPENILLDASFAPKIADFGMAKFLGRDFXEVLTTMXRGTIGYLAXPEWLSXGTLITAKVDVYSYGMVLLEIVSGKRDSGRQCTAGDHDVYSPVASRQLTTAGGXAGSLVDSNLHGDAHLDQVERALKVACWXCIQDPEFDRPTMGVVVQCLEGLLEVNIPPWPGLLHALAGNHPPTPVGHLDQLHKKQANCNILGAHEDSCCNDGANFPQ

SEQ ID NO: 49133 - protein, 403 aa, Methanopyrus kandleri AV19
MHYVLECVECGSEFDDDSLVRCPECGGLLEVALRYDEIEVSRSTFEGRRLGVWAFRELLPVNTDDPVTMSEGGTGLHPCPRLGEELGVRELFVKNEGENPTGSFKDRGMTVGVTKAVELGAEVVACASTGNTSASLAAYAARAGLTCAVLLPAGKVALGKLAQALFHGARVIPVNGNFDDALDVVKKLADEGIVYILNSVNPFRLSGQRTIAYEICLQLDWEVPDAVVVPVGNAGNISAIWQGFLDLYRLGIIDELPRMYGVQAEGARPIVEAIRRGKEDIEPDPEPETVATAIRIGNPVNAIKALRAIRCSGGWAVEVSDEEILSAQRELATREGIFVEPASAASIAGLRKFVEEGEIDADERVVCVTTGHGLKDPETVMEVCELPEPVEPDPETIQRLIAE

SEQ ID NO: 49134 - protein, 514 aa, Frankia sp. EAN1pec
MQNLTHAQCDNPHGRFISIGEPMPQLMSVAPCEIVVFGGTGDLAMRKLMPALYHRDRDGQLTPDSRVIAVSRAGLDDAGYRDKVDSELRRFVPELIHEPDVLARFIQRLHHITVDVAEHSTWDELRTLLADGKDHVRVFYLACAPQLFGPTCVGLQTNGLVTDNSRVVLEKPLGHDLVSARRINDEVGAVFAEEQIFRIDHYLGKETVQNLLVLRFANSLLEPLWNSGAIDHVQITVAETIGIGGRGDYYDGSGAIRDMVQNHLLQLLCLVAMEPPSRLDREAVRDEKLKILQALSPLTLGDVERCVVRGQYTAGLVEGAPVPSYQDEVDGSTSTTETFVALKVEVQNWRWSGVPFYLRTGKRLDRHASEIVVQFRPVPHSIFPGIKDAISPNALVLRLQPDEGVRLHLMAKEPGPGGVRLRPVHLNLSFAETFKSRLPDAYERLLMDVVRGNPTLFMRRDEVEAAWAWVEPILAALAASIDSPRRYAAGTGGPAAAIALIERDGRTWHEEVAE

SEQ ID NO: 49135 - protein, 517 aa, Oncidium Goldiana
MELCMKSQIALSAAVLQPHAGSGRFSDGETMGQRLDFSSFRRANEQICRRRRASLLRMSFATTELVAEGKLRDLELEGRDPRTVVAVILGGGAGTRLFPLTRQRAKPAVPIGGAYRLIDVPMSNCINSGINKVYILTQFNSASLNRHLLRAYNFSNGIGFGDGFVEVLAATQTPGEAGKKWFQGTADAVRQFHWLFEDAKGKEIEDVLILSGDHLYRMDYMDFVQSHRQSGADITISCVPMDVSRASDFGLMKIDNNGRVLSFSEKPKGQELKAMEVDTSVLGLSREQAKKTPFIASMGVYVFKKEILLNLLRWRFPTANDFGSEIIPASAKELFVKAYLFNDYWEDIGTIKSFCEANLSLTRHPPNFSFYDATKPIYTSRRNLPPTAINNSKIVDSIISHGSLLSNCLIEHSVVGIRSRINDNVHLKDTVMLGADLYETDAEIAALLAEGRVPVGIGENTKIKDCIIDKNARIGKNATISNVDGVQEADRSAEGFYTRSGITVILKNSTIPDGFAI

SEQ ID NO: 49136 - protein, 319 aa, Frankia sp. EAN1pec
MTGYVAVVGENVADAVVQPTETPNGAMRWQVFPGGSPANTAVALGRLGTPTRFLSRLPCGVLGGLFKRRLDDSSVDLSLSTWSDEPATLAITSVENSAAHYEFYATGTVDWQWRPDELNPARLRGASCIHAGSLGLVMEPGGRIVEELLDSIREHATVSIDPNVRTTLVSSEHYQSRLKEWYRLADIFRISEDDLTHLAPGFTPERIIGELNETGVQLAIVTRGEAGVLASFRGTLIDVPAVPTEIVDTIGAGDAFSAGLLHWLHQNGHLGGRLERLDQQGARSALIFASHVAALTCAAPGADPPWNRHLTPAVRNLLR

SEQ ID NO: 49137 - protein, 387 aa, Aquifex aeolicus VF5
MFEFSDRLKVLPPYLFAELDRKKQEKIEQGVDVIDLGVGDPDMPTPKPIVEAAKKALENPENHKYPSYVGKYEFRKAVADWYKRRFDVDLDPNTEVITLIGSKEGIAHFPLAFVNPGDIVLCPDPAYPVYRIGAIFAGGTPYTVPLKEENNFLPDLDSIPEDVAKKAKIIWINYPNNPTSAPPTLEFYKKLVDWAKEYNVIIASDNAYSEIYTGQEKPPSILQVPGAKDVAIEFHSLSKTYNMTGWRIGMAVGNKELVAGLGKVKTNVDSGQFGAVQDAGIVALNLPEEEVEKIRDVYRERKKIMTEALEKIGLEIYRSDYTFYLWIKVPEGYTSAEFVGRLIDEAGIVCTPGNGFGEYGEGYFRISLTVPTERLLEAAERIKNLKL

SEQ ID NO: 49138 - protein, 164 aa, Brassica napus
  misc_feature (27)..(27): Xaa can be any naturally occurring amino acid
  misc_feature (38)..(38): Xaa can be any naturally occurring amino acid
  misc_feature (51)..(51): Xaa can be any naturally occurring amino acid
  misc_feature (82)..(82): Xaa can be any naturally occurring amino acid
  misc_feature (97)..(97): Xaa can be any naturally occurring amino acid
  misc_feature (105)..(105): Xaa can be any naturally occurring amino acid
  misc_feature (138)..(138): Xaa can be any naturally occurring amino acid
  misc_feature (145)..(145): Xaa can be any naturally occurring amino acid
MASSMLSSAAEATSPAQATMVAPFTGXKTSAAFPVTRXKSNTVITYIASNXDELCCMKVWQPYRKKKFETLYYISDLTDVEXAKEVDYLLHNKWIPXVEFEMKHXFEYREHGITPGYYKGRYWTMRNLSLIRCTDFAXQLNEVQXCNTEYPNAFIRIIEYDNNQ

SEQ ID NO: 49139 - protein, 228 aa, Aquifex aeolicus VF5
MNACERLSRVLERIQKACERAGRGENCAKLLGASKTVPPEVIREFYNCGLKVYGENRVQEFLKKYEALKDLDLEWHFIGRLQTNKVKYLMGKVVLIHSLDRKNLADEIQKRAFKNNIVQDVLIEVNVGGEETKGGVEPENLKELFEYTLELPNVKVLGLMTIPPYLENPEDVRPYFRKLRELRDELQREYNVALPHLSMGMSHDFEVAIEEGATIVRIGTLLFGERKY

SEQ ID NO: 49140 - protein, 587 aa, Debaryomyces hansenii CBS767
MKESLVTDFIKFNSRRSTVYSTKGMVVSSQALANHAGIKILSKGGNCVDAAIAVSAALCVVEPGSTGIGGDCFSLYYKRETKEVHGMNGTGRSAKNLTIQNICDRYNNGQPMKRIPPESVLTVNVPGAVAGWVDSYEKWGSKNVTLEEILEPAISLAEDGFPVCEIACLLWKSAEDKLKKQNPDPKLIENMFLFGNAAPNEGDFVTNKPLAKAFRAIAKGGKEGFYQGPVAEAIIRETSSRDHKLDLKDLATHTSTVVDPINTKFEDYKVWEIPPNGQGLVALLSLGIIQQLHKSGKIDLYKLKHNSAEYLHVLIEASKIAFYDSDEYVTDPEFSKIPLDDLLSESYLKKRAELFSMDKILDSSVIEHGVPNPRYKSDTVYLAVTDSNGDACSFINSVYDDFGSGIAVPDYGFCLHNRGANFNLTPDLKNCFEGGKRPYHTIIPSLITNSKDDSLFAAFGNMGGYMQPVGQVQHVLNLCVFGFTPQQLIDLPRFCLNATKDRMDSDRGKGSDGPVSTAVTEVALEDGIDPNVVEELSKLGHTTKVVTGHDRKMFGRAQIIKDISKDGQLIYAAGSDLRGDGAAAPFF

SEQ ID NO: 49141 - protein, 309 aa, Glycine max
MPLSRFAAGAFSVVTICLVAILLLLGFVCIAYSYYFRSRIHHDQFSYFSGPWIIRIAFILIAIWWGLGEIIRLSLLRRGLHLQWQWQEESICKWYIVSNLGFAEPCLFLTIVFLLRAPLHLQTGGIINTKWNVKTAGYILLYCFPLFVLQLFVIFVGGEFKSSSSSSCTYPLLSTLLLGLFALILTSYLFWLGSRILKLVINKGLQKRVYTLVLSVSGFLPLRVVFLGLSVLSGPEDFMFEAFAFLAFLALASCAGVCMCMLVYRPLADCLALDINDTTSLIKGDRDATFLQLSLFSPTPNRFLSFLVK

SEQ ID NO: 49142 - protein, 170 aa, Carboxydothermus hydrogenoformans Z-2901
MRHTLAVLVENNPGVLARVAGLFSRRGYNIDSLAVGRTENPDISRMTIVVEGDDRVLEQVVKQLRKLVDVIKVQDITSEQYVSRELLLLKVHADSNTRGEIMQIVEIFRARIVDIGPKTLTIEATGDEDKIEAIENALRPFGIKELVRTGKIALLRGSRTSNINGVKEEE

SEQ ID NO: 49143 - protein, 268 aa, Burkholderia vietnamiensis G4
MSKIPAFGLGTFRLQGQVVIDSVRNGLELGYRAIDTAQIYGNEAEVGAAIAASGVRREDLFVTTKIWVDNYAPDKLAASLEDSLRKLRTDYVDLTLIHWPAPDNGVSVDAFMTALADAKSKGLTREIGVSNFNIALTKEAIAAVGSDAIATNQIELSPYLQNRKLVEFLQSERIHVTSYMTLAYGKVLGDPVLDAIARRHRATPAQVALAWALQLGYSVIPSSTKREHLASNLLAQTLRLTDEDLAQIATLERNGREVDPAGLAPQWD

SEQ ID NO: 49144 - protein, 415 aa, Vitis vinifera
MPRTSTLECPGCPPIRALTFDVLGLVKVTEARSKEGGIPKVVDRWGEPDSSKCILAASIDDRKSGPLLAIAREGGLIEILNPLNGHPCLSISNIIDNGPEPGDDAIVGLHLFKKQNLDLSSRSHTLLTCTTKGNASMRSVELTSSHADSTSSVSSRTWNVCASGNILCSQVDGNENYALFGGKGVEVNVWDLEQGTKIWTAKSPPKNSLGLFTPTWFTSATFLSKDDHRKFVAGTNSHQVRLYDISAQRRPVISFDFRETPIKAVAEDQDGYTIYIGNGSGDLASVDMRTGKLLGCFLGKCSGSIRSIARHPELPVIASCGLDSYLRFWDIKTRKVLSAVFLKQPLTNVVFDSNFAEEVDPPTEAQNTNETQESDEEEVQPLKRKKKSSKHSGSKKPKPKKRSKKAQDETVDDSS

SEQ ID NO: 49145 - protein, 514 aa, Oryza sativa Japonica Group
MNGGDAAAAAATPSHRRLPDFLQSVNLKYVKLGYHYLITHLLTLLLLPLMAVIVLEAGRTDPDDLRQLWLHLQYNLVSVLVLSAVLVFGATVYVLTRPRPVYLVDFACYKPPDKLKVRFDEFLHHSKLCGFSDDCLEFQRKILERSGLSEETYVPEAMHLIPPEPTMANARAEAESVMFGALDKLFKFTGVKPKDVGVLVVNCSLFNPTPSLSAMIVNKYKLRGNIKSFNLGGMGCSAGVIAVDLARDMLQVHRNTYAVVVSTENITQNWYFGNRKSMLIPNCLFRVGGAAVLLSNRGADRRRAKYALKHVVRTHKGADNKAFNCVYQEQDDEGKTGVSLSKDLMAIAGGALKTNITTLGPLVLPFSEQLLFFATLVAKKLFNAKIKPYIPDFKLAFEHFCIHAGGRAVIDELEKNLQLQPVHVEASRMTLHRFGNTSSSSIWYELAYMEAKGRVRRGHRIWQIAFGSGFKCNSAVWHALRNVNPSPESPWEDCIDRYPVELVDGFATHNNTQQ

SEQ ID NO: 49146 - protein, 187 aa, Zea mays
  misc_feature (20)..(20): Xaa can be any naturally occurring amino acid
  misc_feature (34)..(34): Xaa can be any naturally occurring amino acid
  misc_feature (65)..(65): Xaa can be any naturally occurring amino acid
  misc_feature (144)..(144): Xaa can be any naturally occurring amino acid
MAGDWQELGQWAGIGLLFAXLVAKLISTEITFKXDNLRITRSPPTSPTGDADRSSRLPPPPTTDXTDGSSGSNSDWEGVERTEFDNEYSAASAFIAATAASVTSVPEETLLRLYVLYKIATEGSCIASKPFAVKLNGRAKWNAXHKMGDMPTEEGMQEYIIDVQELFSNWHEGASAITTDDDSIASA

SEQ ID NO: 49147 - protein, 484 aa, Acidovorax sp. JS42
MTQPYSTLALAEPLKRAVAEMGYENMTPIQAQAIPVVLTGKDVMGAAQTGTGKTAAFSLPLLQRLLKHENSSASPARHPVRALVLLPTRELADQVAQQIALYAKYTKLRSTVVFGGMDMKPQTIELKKGVEVLVATPGRLLDHIEAKNAVLNQVEYVVLDEADRMLDIGFLPDLQRILSYLPKQRTTLLFSATFSPEIKRLAGSYLQDPITIEVARPNETASTVEQRFFAVDGDDKRRAIRHVLNERGLKQAFIFVNSKLGCARLARSLERDGLKTAALHGDKSQDERLKALEAFKSGEVDLLVCTDVAARGLDIKDVPAVFNYDVPFNAEDYVHRIGRTGRAGASGLAVTLAASSDTRLVADIEKLIKKKIELEPLELQEDRPRGRYNDGRRASGGDDSGEGAPAAPRSRERSAYRSAPAASRDPFFDKPYEASTSAGASASWEVAPKASPARGGISANIKPKRKLPALFKAPQASTAEPSTH

SEQ ID NO: 49148 - protein, 158 aa, Xanthomonas oryzae pv. oryzae KACC10331
MPTRMTHYEGDLRPPTARFAIIASRWNARITDVLVAGARQSLAGNGIGEDAIDVIRVPGAWEIPVAANRVAQSGQHGAIIALGCVIRGDTRHYEHVADLCAEGLMSVQLQTGVPVLNGVLAVERVEDAEARAGGSHGNKGEECALAALELVNLMELLP

SEQ ID NO: 49149 - protein, 356 aa, Arabidopsis thaliana
MEAEGEKQWSSLIVPFVLEIVKEKNFTTIPPRYVRVDQEKTEILNDSSLSSEIPVIDMTRLCSVSAMDSELKKLDFACQDWGFFQLVNHGIDSSFLEKLETEVQEFFNLPMKEKQKLWQRSGEFEGFGQVNIVSENQKLDWGDMFILTTEPIRSRKSHLFSKLPPPFRETLETYSSEVKSIAKILFAKMASVLEIKHEEMEDLFDDVWQSIKINYYPPCPQPDQVMGLTQHSDAAGLTILLQVNQVEGLQIKKDGKWVVVKPLRDALVVNVGEILEIITNGRYRSIEHRAVVNSEKERLSVAMFHSPGKETIIRPAKSLVDRQKQCLFKSMSTQEYFDAFFTQKLNGKSHLDLMRI

SEQ ID NO: 49150 - protein, 164 aa, Nostoc punctiforme PCC 73102
MDKRYFLQASAVIVGTALLSRYINWGAKAVTTSNSGFEITKPEEEWRTILTPEQFNVLRKHGTERPHTSALDKEYDKGTYYCAACELPLFTSDTKFNSGTGWPSFFNPIEGAIATTVDKSLFMTRVEVHCSRCGGHLGHVFDDGPAPTGKRYCMNGVSLKFTPA

SEQ ID NO: 49151 - protein, 563 aa, Vibrio angustum S14
MLLFHALSQAWKDGYSFSKLRADIVSGITVGIVAIPLGMALAIAVGVPPQHGLYTVIVAGFLAALLGGSRFNITGPTAAFVVILLPITQKYGLSGLMLATMMSGIILLLMGVFRLGQLVAYVPYPVTTGFTAGIGFVIAFLQLKDLLGLHIQGSPIHFPEKVMSYAHALPTANYADAIVGVVTIFVFIGWAKLKTRVPPHLVSLLVGTVLASALNKFGPEHVTLLGEKFSYTIGSLVGHGIPQEAPQFIALWKSDTFNWATVIELMPSALTIAMLGCIESLLCAVVADGMTSKKHNPNAELVGQGIANIVVPFFGGIPATAAIARTATNIRSGAFSPISGMTHALFVLAAMIVLAPVLSFVPMSALAGLLIMVAWNMSEAPHFVHTLKVAPRRDVAVLMTCFILTVAFDMVVAVIVGLLLAGVLFIQRIATLTTVTISHDEHPHLNLGHDVVVYDINGPLFFAASEKAFSVIEHATTETRAVVLDFSDVSTIDITAINAFDMALDRLSELPVYLLGTQPHVERKLYHAGIFEAENVHLAHSISQLQQVLLINSHNDSDQESTL

SEQ ID NO: 49152 - protein, 379 aa, Xanthomonas oryzae pv. oryzae KACC10331
MNFAPVPALLEELRAGRMVVIVDDEDRENEGDLIMAAELVTPSDINFMVTHARGLVCLSLTGERCAQLGLAPMVRNNTAQFQTNFTVSIEAAEGVTTGISAYDRAHTVRTAVRPDAKPQDLSQPGHIFPLISQPGGVLTRAGHTEAASDLSMLAGLEPAGVLVEVLNPDGSMARRPQLEVFAREHGLKMGSIADLIAYRLANEHTVERVDERDITTEFGPFKLVTYRDRIAHDLHFALVRGSADPHTPTLVRVQVENPLADLLHWQRDDFGVAATDALRAIAAEGQGVMVVLSAPRDSESLLARLRQQPEAAANAKDVSQWRRHGAGAQILAELGLGKLRVLGTSRRQVGVAGFGLEVVEYLECHAGEGVRSVPPSAVS

SEQ ID NO: 49153 - protein, 620 aa, Salmonella enterica subsp. enterica serovar Paratyphi A str.
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKDRHTVCVIGDGAITAGMAFEAMNHAGDIRPDMLVILNDNEMSISENVGALNNHLAQLLSGKLYSSLREGGKKVFSGVPPIKELLKRTEEHIKGMVVPGTLFEELGFNYIGPVDGHDVMGLISTLKNMRDLKGPQFLHIMTKKGRGYEPAEKDPITFHAVPKFDPSSGCLPKSSGGLPGYSKIFGDWLCETAAKDSKLMAITPAMREGSGMVEFSRKFPDRYFDVAIAEQHAVTFAAGLAIGGYKPVVAIYSTFLQRAYDQVIHDVAIQKLPVMFAIDRAGIVGADGQTHQGAFDLSYLRCIPDMVIMTPSDENECRQMLFTGYHYNDGPTAVRYPRGNAQGVALTPLEKLPIGKGLVKRHGEKLAILNFGTLMPEAAKVAEALNATLVDMRFVKPLDDTLILEMAAQHDALVTLEENAIMGGAGSGVNEVLMAHRKPVPVLNIGLPDLFIPQGTQEEARAELGLDAAGIEAKIKAWQA

SEQ ID NO: 49154 - protein, 197 aa, Geobacter sulfurreducens PCA
MAPESASTIWNVPNILTLVRIALIPVMAVLLLSPSKEAGFWAAAVFAIASVTDWLDGYLARKMEIVTVFGKFLDPIADKLMVMAALIMVLPFNRIPAWMVLVILGREIIITGLRGIASTEGIVIPASDLGKFKTIFQIVAILGILLHFDYHWFFGIDHPYLYVNMHNVGMFYLWIATIITIWSGVDYLVKFTKVIAR

SEQ ID NO: 49155 - protein, 647 aa, Chlamydomonas reinhardtii
MAKTRRRKKRTHVETDAAEAKKPDPKTFVFKRGKHGAILADLEQDMRRMLLPNTALNLRESRKNSLRDFVSVAGPLGVTHFVMLSATDNSSYIKFAKTPRGPTMTMRVRNYSLIRDVQSAAVRPRVPANAFKTPPLVVMNGFSGNDTLRLVTTLFQGVFPPINVQRTKLSACQRVVLLSRDKESGLIRLRHYGISVAPSGLRKSVKGLLSRREVPDLSAFRDVSEFVTKSGYGSVQCVMVWWSGGLVEEGLCEGAVLFHAHDANVRRKAAEAARKAAAQADEMRQQGKLPAGQKQCTPPATVSVTPAGGEDFYLCVNVKEALDLEPGVSLMGATCDPFVRVVLARPGSLPLAEAETRVILRNSHPLWEEWLPFSLDNVTEDMLVALRVMDKDIGHFISFCGMVSLPIKEVLSTITDMGEEVVYRMPLMDKSGTTRRPGVLVFGISILAKDQYDEMRKVITAIQDPDQIHAQLHEYQLHIKVHGVKGLAALGSGSAAASAGLALQFSTVRSFLGAFACNVASAMAAVAGGSGTQVLDKGAAGVSGPQKPELEVSMQLVRVAVLVKGDGGWVVENRITPNVPPVVGQHVGAGKTRLTVSLRTEWFKSGMMVNVVKGKVESATPPDAVKFFNTLKTELAAKYAGAQREGV

SEQ ID NO: 49156 - protein, 471 aa, Triticum aestivum
  misc_feature (41)..(41): Xaa can be any naturally occurring amino acid
  misc_feature (141)..(141): Xaa can be any naturally occurring amino acid
  misc_feature (156)..(156): Xaa can be any naturally occurring amino acid
MEPRVGNKYRLGRKLGSGSFGEIYLGTNVQTNEEVAIKLAXENVKTKHPQLLYESKLYRVLQGGTGISNVKWFGVEGDYNVLVMDVLGPSLEDLFSFCNRKLSLKTVLMLADQMINRVEFIHSKSFLHRDIKPDNFLMGLXGKRANQVYMIDFGLXAKKYRDTSTHQHIPYRENKNLTGTARYASVSTHLGIEQSRRDDMESLGYVLMYFLRGSLPWQGLKAGTKKQKYEKISERKIATSIEALCRGYPSEFQSFFHYCRSLRFEDSPDYQYLKRLFRDLFIREGFQFDYVFDWTILKYQQSQMTSVPPRAIAAAAGQSSGMAPIACNNRLSATEEGRRSGWSDDPTRRQVPPTGINAGSLSKQKSPVRPDVSAPKEAVLSSSTFLGRSGVSSRRPAVSSSRDLPSSGAEPSRSRAPDASPGTSQRNSAPRRTSQTPDYSDPRHKSNSNNYESTIRGIRGLNFDGNDRIHY

SEQ ID NO: 49157 - protein, 280 aa, Rhodopseudomonas palustris CGA009
MKIAFQGEPGANSHIAISDAYPTAEAMPCATFEDALSAISSGEADLGMIPIENSVAGRVADIHHLLPTSKLFIVGEWFLPIRHQLVAVPGAKLEDIKTVESHVHALGQCRRIIRKFGLKPIVAGDTAGSARIIAERGDKTCAAISSRLAAKIYGLDILAEDIEDEAHNTTRFVVLAREPRWAVQGSGKLVTTFVFRVRNLPAALYKALGGFATNGVNMTKLESYMVDGNFFATQFYADVEGHPEDRNLAFALDELKFFSREFRIVGVYPGHPFRATFSER

SEQ ID NO: 49158 - protein, 339 aa, Hordeum vulgare subsp. vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIQADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 49159 - protein, 534 aa, Glycine max
MADSTPLLSQPDSSSSPDTQKPQPPPPPRNQQHPSLGSTVELCIGEFNWSQFLQSILVSLAWIFDAQQTFISVFTDAPPAWRCTEQAGNACKTANTNTVCNLPEGSWAWDGPTQASMVSDWGLECANSSITGLPASMFFAGCLLGGFLLASLADSSLGRKNMLFFSCLVMAITSFLVTFSPNVSIYSALKFLCGFARATIGTSALVLASELVGRLSYVGPPPIGFFCFTIGFLSLPAMAYINRSSSWRNLYLWTSISTMLYCILVKLFVTESPRWLLVRGKTEEAVETLKCITSITQSNLNLAINNMSHEEETCDVDIFSALKILLQNKWSSRRLSSIMAMGIGIGLVYYGMPLGLQNLSFNLYLSVIFNALSELPSALIVLFFIDKFNRRITLLLFTILSGLFSVMSTVQVSKSSSSWNNNVQIVFELVSFFSACTSFNVYLIYTTELFPTCVRNSALSMARLAVVLGGMFSPLLVSAGRGNKFLCYGVFGLVIGFSGVFGIFLPETKGRAFCDSMDEEENKEKNMACGMLLA

SEQ ID NO: 49160 - protein, 106 aa, Oryza sativa
  misc_feature (49)..(49): Xaa can be any naturally occurring amino acid
  misc_feature (89)..(89): Xaa can be any naturally occurring amino acid
  misc_feature (99)..(99): Xaa can be any naturally occurring amino acid
MAALNGKVVVAVMVVAMVVETHAFMVARDDLAMEITAENIFFDQKHMIXYKSILAGKPVATATQMLESTIKSPRSTRAEASDLAIAVYXGTDCVMLSGXSAAGPYP

SEQ ID NO: 49161 - protein, 423 aa, Leifsonia xyli subsp. xyli str. CTCB07
MSTGGDVAITAGERATESGAGRLGAGRLLLLGPAFVAAIAYVDPGNVAANLTAGASYGYLLVWVLVAANAIAVFVQYQSAKLGILTGRSLPELLGERLGAGARRGYWAQAEVVAAATDIAEVIGGAIALSLLFGLPLSLGGLIVGVVSIGILALQTCHGQRTFELVIVGFLAVISVGFLAGLVVSPVEWGAAAGGLLPRFDGTPTVLLAASMLGATVMPHAIYLHSALARDRHGVTGDPGRIRTLLSATRLDVVLALIVAGAVNIAMLLLAAASLPGVPGTDTIEGAHAAITAALGPAIGVIFGIGLLASGLASTSVGSYAGAAIMSGLLTVRVPLLARRVVTLVPAVVILSLGVDPTWALVLSQVVLSLGIPFAMIPLLRLTGSRALMGDRADALWVRAAGGAVAALVVLLNLALVVLTLLG

SEQ ID NO: 49162 - protein, 251 aa, Frankia sp. EAN1pec
MIDQRDTARVIVVGEALIDIVHRADGTVTETPGGSPANVALTLGRLGVPVRLVTQLADNAGGRAVRAWLVESGAQVSAQIPDGGRTSTAIARLDATGAATYEFDVTWSITVPELGAVGALQVGSLGGLLVPDANAVASLVAAVGDALVSNDPGIRPSLIGDPVAARSRVERLVAAAAVVKASEGDLRWLYPLASPVHVARRWRAAGPALAQVLRRCAHNAAITVSRAGADPPWASEIETTCIDSLPATTNG

SEQ ID NO: 49163 - protein, 405 aa, Leptospira interrogans serovar Lai str. 56601
MTNIIVQKYGGTSVGTPERIQNVAKRIKSYHDKGQQVAVIVSAMGHTTDELVDLAAKISSNPPKREMDMLLSTGEQISTALLAMALWEIGVPATSFTGSQIKLLTDGNFSNAKIKMIDRSRIDSALNEGKVVIIAGFQGIDAEENITTLGRGGSDTSAVAVAAILGAKECEIYTDVDGVYTADPRVVPSAKKHKQITYEEMLELASLGAGVLHSRSVELGMNYDVVIHVRSSFNDNIGTLVVSEDKIMEKLKVSGVTAKNDQARITIAGVPDKPGLAAGLFGELSSKHILVDMIVQSSPHNGINTISFTIPKKDVHEAKPILEGFSKSHNAKEPEINENIAIVSAVGVGMKSHVGVAAGMFKALADNGINIEMISTSEIKISCVIAESQAKIAVNKIHDVFGLSS

SEQ ID NO: 49164 - protein, 396 aa, Glycine max
MPLSRFSAEAFGVVTICLVAILILLGLMCIAYSFYFRSRIHSQGLVQLNYFSGPWIIRITFILFSIWWGIGEILRLSLLRSTFHLKWPDTVCKCYIVSNMGFAEPCLFLTLVFLLRAPLLNLETGIMSRKWNVKTSGYILLYCLPMFVLQLFVILVGPQLDKNKGSGKMLPHYFSSAVVAPGENDTILCTYPLLSTILLGLFAIILTSYLFWLGSRILKLVINKGLQKRVYTLLFSVSCFLPLRVLFLGLSVLSGPGHFMFEAFVFLAFLALVCCAGLCMCTLVYRPVADCLALGNLQDLEAWRLNDDHNDTVSLIANQSLLEDNVEDNARSSPGRYSDASTKRGSISFRTLEKGVSSTGTFVELSLFSPSRSATPPGSPPLLGWPMRSPTQVIGP

SEQ ID NO: 49165 - protein, 219 aa, Glycine max
  misc_feature (211)..(211): Xaa can be any naturally occurring amino acid
MAQIPNLDNAPVNLTSIREHSQKELLNILKNVRGKKCLVIDPKLGDSLSLIIQTSILKEHGVELRHLSGDPIQTDCSKVVYIVHAQPKLMRFICSNIHNDVSKGLQREYHVYFVPRRTVVCEKVLEEEKLHNMVTIGEYPLYSVPMDEDVLSFELDLSYKECQVDGDTSSLWHIAKAIHKLEFSFGVIPNVRAKGKASVRVADILNRMQAXEPVNSSDM

SEQ ID NO: 49166 - protein, 571 aa, Cucurbita maxima
MGNTCRGSFKGNIFQGYSQPEDSSTLYSKRNNSSSSARSNSDISPTSINTHNLIAQEFSKENKTKSKDNDYNQAFLSPTKKDFTMRKSAENQAYYVLGHKTANIRDLYTLGRKLGQGQFGTTYLCTEITTGIEYACKSISKRKLIAKEDVEDVRREIQIMHHLAGHKNIVTIKGAYEDSLYVHIVMELCSGGELFDRIIHRGHYSERKAAELTRIIVGVVETCHSLGVMHRDLKPENFLLVNKDDDFSLKAIDFGLSVFFKPGQIFTDVVGRPYYVAPEVLLKHYGPAADVWTAGVILYILLSGVPPFWAETQQGIFDAVLKGHIDFDSDPWPLISDSAKDIIRKMLCSRPSDRLTAHEVLCHPWICENGVAPDRALDPAVLSRLKQFSAMNKLKKMALRVIAESLSEEEIAGLREMFTAMDTDNSGAITFDELKAGLRRYGSTLKDIEIRDLMDAADIDNSGTIDYGEFIAATIHLNKLEREEHLVAAFRYFDKDGSGYITVDELQQACAEHNMTDAYLEDVIREVDQDNDGRIDYGEFVAMMQKGNAGVGRRTMRNSLNLSMRDGPGAL

SEQ ID NO: 49167 - protein, 364 aa, Nostoc sp. PCC 7120
MNSFPKTLSSENFSSSQYNNRKRYNLFVSANVTQALGNVPIVQLGNISRVCIESECLLKLESCNPGGSIKEKNAVYLVKRAEEEGLLVPGGTIIESSSGNFGVGLAMVGAVRGYRVIIVVDAKTAPPFRRMLKAYGAELVDVPLHEADESGSMQKARMKRAHELTATIPNAWYPCQHLNPWNTEAHSYYTAREIEAHFAGELDAVVVGVSTAGQIMGIARYLLPRFPKIRIVGVDVVGSVIMGTPAKPYKMTGIGLSFFPPNLDISMLDRAYVIPEDMAYSVCHALASREGLLLGASTGAIVAGGLHLARSLGAGARILMINPDRGDRYLETVYDSDWLDHHGFTLKQGEHLDDAIASLTPLYF

SEQ ID NO: 49168 - protein, 389 aa, Haloferax volcanii DS2
MPTRSARFPVDERDGRPAAVKWTIHIASHLCPQGPYLTAYVKSAVYRGPGDVRIEEKPEPELQQPTDAVIRVTHTAICGSDLWFYRGHEEHEEGSGVGHEPMGIVEEVGEDVTSVQPGDRVLVPFAYSCGECEFCRKGIHTACVDGGFFGPHGDETGGAQAEKVRVLHADGTVVRVPERYADDEETLKSLLPLTDVMSTGHHAAVLADLEAGDTAVVIGDGAVGLCGVLAAKRIGAERIIAVGHHEDRLEVARELGATDTVSSRGQEAVEEVLELTHGGANHVLECVGAASALETAAQVARPGGSIGAVGVPHVESADFLQPIFYKNLSFSAGGAPVRNYIEELMDDVLQGTLDPSPILTKTVDLDGVPEGYQAMDDREAIKVMVKVDE

SEQ ID NO: 49169 - protein, 558 aa, Cucurbita maxima
MGNTCRGSFKGNIFQGYSQPEESSTPNFKRNINGSSDHSPSSINTNNLISQAFAEENKTKSKDNDCKKDYTMRKSAENQAYYVLGHKTANIRDLYTLGRKLGQGQFGTTYLCTEIMTGIEYACKSISKRKLIAKEDVEDVRREIQIMHHLAGHKNIVTIKGAYEDSLYVHIVMELCSGGELFDRIIQRGHYSERKAAELTRIIVGVVETCHSLGVMHRDLKPENFLLVNKDDDFSLKAIDFGLSVFFKPGQIFTDVVGSPYYVAPEVLLKHYGPAADVWTAGVILYILLSGVPPFWAETQQGIFDAVLKGHIDFDSDPWPLISDSAKDLIRKMLCSRPSDRLTAHEVLCHPWICENGVAPDRALDPAVLSRLKQFSAMNKLKKMALRVIAESLSEEEIAGLREMFTAMDTDNSGAITFDELKAGLRRYGSTLKDTEIRDLMEAADIDNSGTIDYGEFIAATIHLNKLEREEHLVAAFRYFDKDGSGYITVDELQQACAEHNMTDAYLEDIIREVDQDNDGRIDYSEFVAMMQKGNAGIGRRTMRNSLNLSMRDGPGAL

SEQ ID NO: 49170 - protein, 310 aa, Mycobacterium sp. JLS
MTGALDPQIADLIERLDRGFPPVQTMTGAQARATIRSRFIAPAEPEPVAAVEDRSVGEIPIRIYHPAGAGPLPVLVYAHGGGFVFCDLDSHDGLCRDIANQTAAIVVSVDYRLAPEHPWPAAAEDVYAVTRWVADNCTALGADPGRIAVGGDSAGGNLAAVTALIARDRGGPSLVAQLLVYPMVTPDFTTESYRLFGSGYYNPAEALRWYWDQYVPNDFDRTHPYVSPLHADLSGLPPAVVVIAGHDPLRDEGVRFGEALSAAGVPTVVRCFDGGIHGFMTMPSLELAQTARAQLCQDAVALLTGVPAGG

SEQ ID NO: 49171 - protein, 498 aa, Chlamydomonas reinhardtii
MQVQQKLGASRAMKASRNVQRVFAAHSDIRKEAALRVPLDKAHTFNAKFVPFADVQSNKMSPETYSLDDIVYRSRDGGLLDVHHDMKALAQYGPDYWRALFDARVGTTAWPFGSGVWSKKEWVLPGLSDDDIVSMFEGNSNLFWAERFGREALGMTDLWVKQCGNSHTGSFKDLGMTVLVSQVNRIRKLKPGSITAVGCASTGDTSAALSAYCAAAGIPSIVFLPADKISLAQLVQPIANGALVLSIDTDFDGCMRLIKQVTAETPIYLANSMNSLRLEGQKTAAIEILQQFDWQVPDWVIIPGGNLGNIYAFYKGFKMCKELGLVDKMPRLVCAQAQNANPLYQAFSKAQGSNAAIKESYEPMKAKMTFASAIQIGDPVSIDRAIMALKDTNGIVEEASEEELMDAAARADRTGMFNCPHTGVALAALTKLRERQVIGPNDRTVVVSTAHGLKFTQSKVAYHSKQVPGMTCQFANPPVQVREDLGAVMDAIKTKFKL

SEQ ID NO: 49172 - protein, 494 aa, Melanophylla alnifolia
PTTSGSGVSTLEKKNLGRIAQIIGPVLDVAFPPGKMPNIYNALVVKGRDNVGQQINVTCEVQQLLGNNRVRAVAMSATDGLMRGMEVIDTGAPLSVPVGGATLGRIFNVLGEPVDNLGPVNTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKAGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 49173 - protein, 175 aa, Triticum aestivum
MAPPVMASSATSVAPVQGVKSTAGLPVSRRSNGDGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 49174 - protein, 365 aa, Acacia auriculiformis x Acacia mangium
MGSAGETQITPTHVNDEEANLFAMQLASASVLPMILKSALELDLLEIIAKAGPNAQLSPSDIASQLPTKNPDAAVMLDRMMRLLACYNVLSSSLRTLPDGKIERLYGLAPVAKYLVKNEDGVSIAPLNLMNQDKVLMESWYYLTETVLEGGIPFNKAHGMTSFEYHGKDARFNKVFNKGMADHSTITMKKILETYTGFEGLKSLVDVGGGTGAVINTIVSKYPSIKGINFDLPHVIEEAPSFPGVEHVGGDMFVSVPKADAVFMKWICHDWSDEHCVKFLKNCYDALPENGKVIVAECILPVAPDSSLATKGVVHIDVIMLAHNPGGKERTEKEFEALAKGAGFQGFRVCCSAFNSYIMEFLKKP

SEQ ID NO: 49175 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 49176 - protein, 519 aa, Oryza sativa Japonica Group
MGDMVLLATRQGVVCHRHRLPVISCATNTKPSRLKLPPGPSTLPLIGSIHHFVSSSESVHSVMRRLAREHGPVMQLWFGEVPTVVASSPEAAQEILRSKDLAFADRHLTSGTDAFSFGGRDVALAPYGERWRHLRRLLTQELLTAARVRSFQRIREEEVARLVRDVSAAAAAAPGTAVNLTEMITRLINDIVLRCSVGSRSKYSDEYLAALNDMVGQTFSLSVADLFPSSKLASMVATAPRRALETRNKMERVIQQIIQERRDQIEADMASGDQVTAAAGSKSCSLDVLLRLQKEGGAPMPITNDVIVVLLMDIFAGGTDTSSTTLTWTMAELIRSPRVMAKAQAEVRQAFEGKNTITEDDLAQLSYLKMVIKESLRLHCPAPLLAPRKCRETCTIMGYDVPKGTSVFVNAWAICRDSKYWEDAEEFKPERFENNNIEYKGSNFEFLPFGSGHRICPGINLGLANMEFALANLLYHFDWKLPNGMLHKDLDMREAPGLIAAKHTSLNVCPVTHIAPSCS

SEQ ID NO: 49177 - protein, 458 aa, Listeria monocytogenes EGD-e
MEEQKEELQRGLKNRHIQLIAIGGAIGTGLFLGAGKSIHLAGPSIMLVYLIIGAILFFVMRALGELLIHNPTTGSFTEFAEQFIGPWAGFITGWTYWFCWIVTGIAEITAVGMYVKFWVPDLPQWIPALACVLILLLFNLATVKAFGEIEFWFAIIKVVVIIALIVIGFVLVFIGYKHGTSTASFSNLVDYGGFFPNGIAGFLLAFQMATFSFVGIELVGVTAGEADDPERTLPKAINNIPIRILIFYIGALLVLMSIYPWSNIDPNTSPFVSVFTMIGIPAAAGIINFVVLTAAMSSCNSGIFSTSRMLYTLSAEGKAPKKMHHLSSNGVPATALITSTACLLIGVFLNYFLPEQVFILVTSIATICFIWVWGVILVAHLRFRHKHPEISEKSKFKMPLSPLMNWVSLIFFGGLLVILGFAADTRIALFVTPVWFLILGIAYQILKASNRKTKIRHN

SEQ ID NO: 49178 - protein, 410 aa, Hordeum vulgare subsp. vulgare
MAAMWSPIIGLLLLLLPLGPSSAINFPLEGNVYPVGHFYATLNIGEPAKPYFLDVDTGSNLTWLECHPPVHGCKGCHPRPPHPYYTPADGKLKVVCGSPLCVAVRRDVPGIPECSRNDPHRCHYEIQYVTGKSEGDLATDIISVNGRDKKRIAFGCGYKQEEPPDSPPSPVNGILGLGMGKAGFAAQLKGLKMIKENVIGHCLSSKGKGVLYVGDFNPPTRGVTWAPMRESLFYYSPGLAEVFIDKQPIRGNPTFEAVFDSGSTYTHVPAQIYNEIVSKVRGTFSESSLEEVKGRALPLCWKGKKPFGSVNDVKNQFKALSLKITHARGTNNLDIPPQNYLFVKEDGETCLAILDASLDPVLKELNFILIGAVTMQDLFVIYDNEKKQLGWVRAQCDRVQELESVIDSRL

SEQ ID NO: 49179 - protein, 385 aa, Xanthomonas oryzae pv. oryzae KACC10331
MLAVPVLEPHRQERHPMKSRAAVAFGPGKPLEMVEIDVAPPKAGEVLVRITHTGVCHTDAFTLSGDDPEGIFPSVLGHEGGGIVEQVGEGVTSVKVGDHVIPLYTAECRKCKFCLSGKTNLCQAVRATQGKGLMPDGTTRFSYNGEPIYHYMGCSTFSEYTVVPEISLAVVNPEAPLEKVCLLGCGVTTGIGAVHNTAKVKPGESVAVFGLGGIGLAVIQGAVQAKAGRILAIDTNPGKFDLARSMGATDCINPKDYDKPIQEVIVELTDGGVDFSFECIGNVNVMRSALECCHKGWGESVIIGVAGAGQEISTRPFQLVTGRVWRGSAFGGVKGRTQLPGMVEQSMKGEIDLDPFITHTMPLEEINEAFHLMHEGKSIRTVIHF

SEQ ID NO: 49180 - protein, 339 aa, Mycobacterium sp. JLS
MIADVDSVQLIVTDVIEESHDARSLVFAEAAGLDYRPGQFLTLRVPGTDGGAVARCYSLASSPHTDAAPKVTIKRVDGGYGSNWLCDNVVAGHVIESLPPSGTFTPADLDRDLVLWAGGSGITPVMSILKSALAVGRGRVTLVYANRDERSVIFAAELRGLVTRHPDRFTVAHWLESVQGLPGREQLAALARRFAGGEAYLCGPAPFMAAVQGALADAGVARDAVHTEVFRSLTGDPFAEVAPVDTATEDGADLRVDLDGRQHGLRWPRQSTLVDTMIAAGLDVPYSCREGQCGSCAATLRSGRVDMPDTDILEPEDIEAGTILGCQATPASDDVHIEF

SEQ ID NO: 49181 - protein, 496 aa, Haloferax volcanii DS2
MVDDIATDADWNALYIDGEWTESESGESIAVEDPSTRETVAHVPRGTEADVDAAYEAAAEAQESWAEAPPARRQEVVEQFLQALNEYEDEIIDLLAHEVGGSRIMGETSIQIASDHASEAATLPRRMRGEHVASNIPGKENIVQKNPKGVVTVISPWNFPLNLSMRAVAPAVAAGNAVVLKPSTNSPITGGLLFAKLFEETDLPEGVVNVVTGRGSEIGDRVAGHPESDVVAFTGSTEVGKRVSGIAGENLAVPAMELGGNNAHVVTEGADVDRAADAAVFGSFVHQGQVCISINRHIVHESVYDEYVEKLTERAAELPVGSAHEDDTVVGPIIDESQRDEMLGYVEETVAAGATLETGGSTADLDGVDDSLVVQPTVLSGVTNDMAAARNEHFGPIAPVIPFSDVDEAVELANATEYGLSGSVHAGDLATGKEIALRMETGNVHVNDQPINDEAHVPFSGTGASGVGTYNSDAFLDEITEDKWISLQHEPRDYPL

SEQ ID NO: 49182 - protein, 240 aa, Ralstonia solanacearum GMI1000
MSVIAANLQAVRQRITTACTLASRDPASVTLLAVSKTFDADAVRAAHAAGQRLFGENYVQEGTAKTSALTDLRNGPEAIAWHFIGPLQSNKTRAVAEHFDWVHSIDRLKIAERLSAQRPATLPPLQVCLEINISRQASKHGVPPDLDEVLPLARAVAALPRLRLRGLMAVPEPADDPAARRAPFAALRDLADRLCAAGLPVDTLSMGMSADLEDAIAEGATIVRVGSAIFGARQYAHAPA

SEQ ID NO: 49183 - protein, 274 aa, Ralstonia solanacearum GMI1000
MLDTLKFGFIGGGNMASALIGGLVSRGAPGANIVVVDPTEPARAHAAQTWGATTIAAPGAELADRDVIVLAVKPQQMREVCAQLAPHLRDSLVLSVAAGIRIQDLSRWLGGHARVVRAMPNTPALSGMGMTGLAARAGLGGTDRDIASAIANAVGKSVWVPDEAQIDAVTAISGSGPAYVFYFIEAMQQVALELGLSPEAGRLLAAETFIGAATLAEQSSEPVEVLRERVTSKGGTTYAALTAMDAAGIKPAFVRAMHAAAARGKAMGEEFGRD

SEQ ID NO: 49184 - protein, 456 aa, Salmonella enterica subsp. enterica serovar Paratyphi A str.
MESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRILVFYVGTLFVIMSIYPWNQVGTNGSPFVLTFQHMGITFAASILNFVVLTASLSAINSDVFGVGRMLHGMAEQGSAPKIFAKTSRRGIPWVTVLVMTIALLFAVYLNYIMPENVFLVIASLATFATVWVWIMILLSQIAFRRRLPPEEVKALKFKVPGGVVTTIAGLIFLVFIIALIGYHPDTRISLYVGFAWIVLLLIGWIFKRRRDRQLAQA

SEQ ID NO: 49185 - protein, 332 aa, Staphylococcus xylosus
MSKVTVFGTGSFGTALANVLAENGHQVLMWGKNEQTINEINSQHINSKYLKNAQLNDSIVATLDINSAVSFSEVYLMALPTKAMREVAKSIDSLLTSKKTFIHVAKGIENETYKRVSEMLEDSISHEHNAGIGVLSGPSHAEEVVIKQPTTVAASSKTPEVSKLTQDLFMNDYLRVYTNDDLVGVELGGALKNIIAVASGVISGMGFGDNAKAALMTRGLAEISRLGEKLGADPITFLGLGGIGDLIVTCTSTHSRNYTLGYKLGEGKSLDKALDEMNMVVEGIYTTKSVYHLAKEVDVDMPITAALYSVLFENRPVDESVKDLMGRGKKAE

SEQ ID NO: 49186 - protein, 468 aa, Pseudoalteromonas tunicata D2
MSQSVLQFIKDNDVKFIDLRFTDTKGKEQHVSIPHHQVDEDFFEDGKMFDGSSIAGWKGINESDMVLMPDASSVKLDPFTEEVTLIVRCDVVEPGTLIGYTRDPRSVAKRAEEYMRSTGIADTVLFGPEPEFFVFDDVKYKTDMSGSMFKIDSKQAAWNSDKEYEGGNTGHRPGVKGGYFPVAPVDDFQDWRSATCLVLEEMGHVVEAHHHEVATAGQNEIATRFNTMVTKADEIQEMKYVIHNMAHLYGKTATFMPKPIVGDNGSGMHCHQSLAKDGVNLFAGDKYAGLSEEAIYYIGGIIKHAKAINAFANPATNSYKRLVPHFEAPVMLAYSARNRSASIRIPVVPSAKGRRIEVRFPDPAANPYLAFSAMLMAGLDGIKNKIHPGDAMDKDLYDLPAEEAAEIPQVAGSLQEALDCLSADREFLTQGGVFTDDLIDAYIDLKTKEVQKLNTSTHPVEFEMYYSC

SEQ ID NO: 49187 - protein, 590 aa, Rhodopseudomonas palustris CGA009
MGSEFSIDQKRYLEGFATGVTAARAARGSLPAGSAASPSGPDAIHHQAQDRVTASGKKLNDQEKWKREQHPFDAYARLKQQAKDNAAPKPADNFRWRYYGLFYVAPAQTSYMCRLRIPNGILTSWQMAGLAYLADTLADGYAHVTTRANLQMREIAPKDAVQLLQGIESLGLWARGSGADNIRNVTGSATAGIDPQELIDTRAYARDWHFYILNERALFGLPRKFNVAFDGGGLIPTLEDTNDIAFQAVTIGDGHGVAPGVYFRLALGGITGHKDFARDTGVIVAPDEATEVADAIVRVFIEHGDRTDRNKARLKYVLDAFGFDKYLELVEDKLGRKLIRVPAEAAAPRPAQDRAAHLGVHPQQQAGMNWIGVRLATGHLTSVQMRGLAEIARSFGDGDLRLTVWQNLLISGVPDARVTDATAAIEALGLAITASPLRAGLIACTGASGCRFAAAHTKETAEAIAQYCEPRVPLDTPINIHLTGCHNSCAQHFISDIGLIGAKVAVSDEDSVEGFHIHVGGGFGVDAAIGTEVLRDVKQDDAPRVIERMLQTYLARRASPAETFLAFVRRQDAAALQQLFAYEQSPETVA

SEQ ID NO: 49188 - protein, 420 aa, Staphylococcus xylosus
MPEVKVPELAESITEGTIAEWLKQVGDSVDKGEAIVELETDKVNVEVVSEEAGVLQELLADEGDTVEVGQAIAVVGEGSGNNTSESPAKQEDTKATDNSNNEQQSSESTESKPEASSQDNGQRVNATPSARKYAREKGIDLSEVSPSSNDVVRKSHVDQSQKQSNTQQSQPAAKEETKKPAQQNPSKPVIREKMSRRKKTAAKKLLEVSNNTAMLTTFNEIDMTNVMDLRKRKKEQFIKDHDGTKLGFMSFFTKAAVAALKKYPEVNAEIDGDDMITKQYYDIGVAVSTEDGLLVPFVRDCDKKNFAEIEDEIGNLAKKARDKKLGLDDMVNGSFTITNGGIFGSMMSTPIINGSQAAILGMHSIITRPIAIDADTIENRPMMYIALSYDHRIIDGKEAVGFLKTIKELIENPEDLLLES

SEQ ID NO: 49189 - protein, 442 aa, Nostoc sp. PCC 7120
MTPPENRPSLPEVHRSIRVPNSNSFWRKMLAYAGPGYLVSVGYIDPGNWATDIAGGSKFGYTLLTVILLSNLMAILLQSLCVRLGVATGRDLAQACRDYFSPKVSFCLWVLCEIAIAACDLAELLGSAIALQLLFVIPLIWGVCITALDVLVLLFLQHKGFRYTEALVIMLVATVGICFTAEILFSRPDMGGILLGYLPKKEILQNPEMLYIAIGILGATVMPHNLYLHSSIVQTRDWQPTTEKRWEAIKFGTIDSTFALSLALFINSAILIVSAATFHFSGNQNVAEIQDAYKLLSPLLGVSAASAIFGIALLASGQSSTLTATLAGQIVMEGFLQFRLPSWLRRLITRLLAIIPALITIILFGENSTSSLIVLSQVILSLQLPFAVIPLVMFTSNRRLMGEFVNPLWLKSLAWLVAIVIVGLNAWLLLQSLWGWLLQVPS

SEQ ID NO: 49190 - protein, 339 aa, Oryza sativa Japonica Group
MAAALMRRAARAPPAACGLRRFMQEQTAFRPAAGPRWCPPERRRGSSPLARPDPRPRAPAFPRINLDGLVPPAPPQTHPTVAREERASASAVAGLTVEEARKVLRATQMEAARARLRASGAGTVPYAEFLRLCCDAAGAESGASVARALDESGSVIVLGKTVFLRPEMVVKAIEKAIPIPRAQPIALDGPAREELKAMEAQKVEIDRTAALQVRRELWLGLAYLVVQTAGFMRLTFWELSWDVMEPICFYVTSMYFMAGYTFFLRTKKEPSFEGFFESRFAAKQKRLMHARDFDLRRYDELRRACGLPVVRTPTSPCRPSSSSSSSTQESHCHSYCHCQ

SEQ ID NO: 49191 - protein, 483 aa, Pseudomonas syringae pv. tomato str. DC3000; identical to SEQ ID NO: 1282

SEQ ID NO: 49192 - protein, 699 aa, Rhodopseudomonas palustris CGA009
MSEVVTRATQDQVAIVTVDSPPVNALSAAVRRGILENVNAAVADPAVQAIVLVCAGRTFIAGADITEFGKPPQPPALNDVIAALENSPKPTIAAIHGTALGGGLEVALGCHFRVAVKEAKLGLPEVKLGLLPGAGGTQRLPRAVGPELAVQMIVGGSPIGAAEALKHGLVEEVVENLVAGAVAFAKKVLAEKRPLRRLRDDDSKLAAAKADRSIFTNAVAAMTKKARGLEAPFACADAIGAAIDLPFEEGLKKEREGFMKLVVSDQSKAQRYAFFAEREAAKVDGVPDGTKPRPVSRVAIIGAGTMGGGIAMSFANAGIPVTLIETGEEQLKRGLGIMQKNWEATAARGGLPPDAPAKRMALITGLVGLENVKDADLIIEAVFETMAVKKEVFTAVDAHAKPGAVLASNTSYLSIDEIAATTKRPQDVLGMHFFSPANVMKLCEIVRGAKTAPDALLTAVSIAKKIAKVPVVVGVCDGFVGNRMLAARSKQSEKLLFEGALPQQVDAVVTKFGMPMGPFAMGDLAGLDIGWRSRKDRGIKSEIADALCEAGRFGQKTGKGYYKYEQGSRAPMPDPEVETLINDTLAKLGLKRRDITDEEILERMVYPMINEGARILEEKIAARPSDIDVVWLYGYGWPIYRGGPMHYADSVGLKHIAERLSAYAKATNDPSLEPAPLLARLAAEGKTFASLTQPSKAAA

SEQ ID NO: 49193 - protein, 420 aa, Corynebacterium glutamicum ATCC 13032
MHVTDDFLSFIALSPSSYHAAAAVERRLLHEGFIRQEDTDEWDARPGGHVTVRGGAVVAWWVPEDASPDSGFRIIGSHTDSPGFKLKPRGDLSSHGWQQAGVEVYGGPILPSWLDRELALAGRIVLADGSVKLVNTGPILRIPHVAIHLDRTVNSQLTLNPQRHLQPVFAVGEPDVSILDVIAGAAVVDPADIVSHDLITVATQDAEVFGAHGDFLASGRLDNLSSVHPSMTALIAASQSDDTGSDILVLAAFDHEEVGSNSTSGAGGPLLEDVLNRTARALGADEDERRRMFNRSTMVSADAAHSIHPNFPEKHDQANYPIIGKGPVLKVNANQRYTSDAVTSGMWIRACQIAGVPHQVFAGNNDVPCGSTIGPISATRLGIDSVDVGIPLLSMHSAREMAGVKDLMWFEQALEAYLVN

SEQ ID NO: 49194 - protein, 339 aa, Triticum aestivum
MAANVALLSASSPSTSASSILRRRPPPRRSACPRRAASRLSVVAAMSDDPIKEWILTEGKATQITGTSSIGGGCINAAQRYDTDAGSFFVKTNRRIGPAMFEGEALGLKAMYDTKSIRVPLPYKVGSLPTGGSFIIMEYIQFGRSRGDQSALGRKLAEMHKAAKSDKGYGFYVENTIGSTPQINTWTADWIEFYSKHRLGYQLKLISQRFGDSAIYEKGQRLIDNMHPLFDGAVIEPCLLHGDLWSGNISADTNGDPVILDPACYYGHNEAEFGMSWCAGFGGDFYSSYFEVMPKQPGFEKRRDLYLLYHYLNHYNLFGSGYRSSAMSIIEDYLRMLKA

SEQ ID NO: 49195 - protein, 184 aa, Arabidopsis thaliana
MTALEKHVSFFDRNKDGTVYPWETYQGFRALGTGRLLAAFVAIFINMGLSKKTRPGKGFSPLFPIDVKNSHLCMHGSDTDVYDDDGRFVESKFEEIFNKHARTHKDALTAEEIQKMLKTNRDPFDITGWLSDYGEWKILHTLAQDKNGLLSEKSVRAIYDGSLFHQLEKKRSSSSSRGKKQKLP

SEQ ID NO: 49196 - protein, 537 aa, Glycine max
  misc_feature (414)..(414): Xaa can be any naturally occurring amino acid
MAHSPFLLLPNLQGFWPSLLAMITCFIIMIKALRNNFIENYSNKQKPKLPPGPKPWPIVGNLPEMLANKPAHKWIHNLMKEMNTEIACIRLGNAYVIPVTCPTIAREFLRKQDATFASRSQSVSTDLISNGYSTTIFGPFGAQWKKMKKILTNDLLSPHKHLWLHGQRTEEADNLMFHVYNKCKNVNDGVGGLVNIRSVARHYCGNLTRKIIFNTRYFGKGREDGGPGFEEVEHVDSIFDLLKYVYAFSVSDYMPCLRGLDLDGHEKNVKEALKIIKKYHDPIVQERIKLWNDGLKVDEEDWLDVLVSLKDSNNNPLLTLEEINAQIIELMLATIDNPSNAFEWALAEMINQPELLHRAVEELDSVVGKERLVQESDIPKLNYVKACAREALRLHPIAPFIPPHVSMSDTMVGXYFIPKGSHVMLSRQQLGRNPKVWNETYKFKPERHLKSDGSDVDLTEPNLKFISFSTGRRGCPGVMLGTTMTVMLFARLLHGFTWTAPPNVSSINLAESNDDILLAEPLVAVAKPRLASELYQL

SEQ ID NO: 49197 - protein, 413 aa, Bacillus thuringiensis serovar konkukian str. 97-27
MGKLFLKICFFVLVAVCSLVAKITYAEERQQNNYPIILVNGFAGWGREEMLGVKYWGGVHDIQEDLKRNGYTVHTAAVGPVSSNWDRACELYAQINGGTVDYGAAHAEKHGHKRFGRTYSGFTPNWSETNKIHLVGHSMGGQTIRTLVQLLKEGSYEEKNYVKNHPNTKISPLFEGEKSYVHSVTTLATPHNGTTLADGSLLLPFVKDLLITAASFGGNDNLSLYDFKLDQWGLKKNTGESFFQYSNRILNSSIWKNTKDISQWDLSTDGAKELNNWVKTQPNVYYLSYSGHASQAAPITGLHLPHITMNKVLMGNAFFLGSYARYEENRPLIDTTWWQNDGVVNTSSMIAPSSNATVNNNESLQIGKWNHIETKANWDHLDMVGLSVSDTLGFSSIQEFYRAIAEKLSRLPK

SEQ ID NO: 49198 - protein, 370 aa, Triticum aestivum
  misc_feature (334)..(334): Xaa can be any naturally occurring amino acid
MDDAGPRNLGGSLPPPNGQDLAARPDDLTLTPTLLRRYVRPQPNTGDLRPDAPAGEEQEHVPVVDLGRLLGPNGLAGGRGEEAARLRSACEDWGFFQLVNHGIPEETLEEMKRNVMGFFALPLAEKAALAQQPGEIEGYGQAFVVSEEQTLDWADMFFLLTQPPTYRDLRLWPSNPSTFKNCLENYSEEVQRVAGELLGAMAEILGVRDHSDMTRLAASQSVRMNYYPPCPEAHVDSVLGLSPHSDAVGLTLLLQVSKVPGLQIRRKGGWVPVTPLPGALVVNVGDVIEVFTNGKYRSVEHRAVVNARHERMSIATFHSGRFGTMYGPLEEVVXGDGEPRYRSVSVQEYVKLVVSSKLDGKNIMDAMKID

SEQ ID NO: 49199 - protein, 344 aa, Picea sitchensis
MDVSSIGRQNVVEFLKEKGLDDAAISKMITRCRRLEMANVEERAKPNWNYLQKIGIPSRKLPSMVCRCPKLLVLGLYEKLQPMVECLGALGTKPKDVALAVMRFPHILSHSVEEKLCPLLAFLQTVGVAEKQLGKLILVNPRLISYSIEGKLQPMVEFFLSFGLRDGDLGKLLVRSPHVVGYSVEGRLKPTLEFLRKVGLGDKDLQRIAVHFPHILCRDVEKVLRPNVDFLRRSGLSAGQVSRIISGFPPVLTKSIKNSLQPKINFLVEIMGRRIEELAEFPDFFYHGLKKRIEFRYKQLEQMNIQCSLAEMLSYSQNKFVIKFGLQEREINSKCTMGQARLLN

SEQ ID NO: 49200 - protein, 248 aa, Yersinia pestis CO92
MKKTILITGALSGIGNTATKLFSEMGYNVVFSGRRPEEGRVILDDLKRINKDVLYVNADMNSESDIKHLIEMTLERFGSLDVAVNCAGTVGETAEIQAVTQDNFHLVFNTNVLGTLLAMKYQIPVMVERGKGSIINISSIAGLVGLPSTGIYVASKHAIEGLTKTAALEVATTGVRINSISPGPVEGKMFDRFLGHDENNKKAFIEMMPNKRFTTQEEVAHTIVFLAEDNVTAITGQTITIDGGYTAQ

SEQ ID NO: 49201 - protein, 282 aa, Listeria monocytogenes EGD-e
MDISVYVASAFSKNNIGGNKAGVVLNEPTLTNTQKMAIAKQLGFAETAFLTESNCADYKLEYFTPKEEIDLCGHATIGTFAILMHLNKIHKSQYTIETNSGVLTITIKDGTIFMEQNQPTFYETIPANNLTGCFDLNLLNTHYPIQIVSTGLKDILVPLKSEADLYTLEPNFEEVKKVSKHYEVVGMHLYTFSDDRIICRNFAPLFDINEEAATGTSNGALACYLYQNQYLQKELYVFEQGHSLHSPSEILVKLDVNVHSEIARVYVGGNGYYCETKYLSIE

SEQ ID NO: 49202 - protein, 367 aa, Oryza sativa
MDGVVAASADATRDEIKIMNVYIWDMDETLILLKSLLDGSYAGAFDGLKDHDKSVDIGKRWENLILELCDEHFFYEEIENYNEPFLSAVKEYDDGKDLTTYDFEADCFSSPYDDLNKRKLAYRHRAIGEKYTKGLEKILDHHMIKVWNDLYSATDKYTDGWLSSALMWHNQMLMWYNRVLMRLKLYKVGASVPCMRPSHKLLEEAMGKSTAESTAKHSSINCIVTSGSLIPSLAKCLLYRLDDVVAFENVYSSWEVGKLQCFKWIKERYDGPNVRFCAIGDGHEECTAAQIMKWPFVKIEFHPDAPHRFPGLNLPTIHRIMDTVYDSSSNDVLRCRHLPIAVETLLKEIVSREMRWEGILLTLCLEN

SEQ ID NO: 49203 - protein, 234 aa, Cryptococcus neoformans var. neoformans JEC21
MKLLMSDYDVTLVNNKMSEFFVKFKGPTETPFANGVWKIHVELPEQFPYKSPSIGFMNKIFHPNIDETSGSVCLDVINQTWSPMFELINIFEIFLPQLLRYPNPADPLNGEAASLLMRDPKAYAKKVESYVERFASAEDADQAGGDDESDEEYEPVPPKVKAKTNGVNGNVNGNGNGQPNGHANGNGNDNASGVNGVNGHGEEHEEDDEEDEDEKMSDMGEFSEDEEDIMGTMD

SEQ ID NO: 49204 - protein, 211 aa, Lactobacillus johnsonii NCC 533
MQSKRPIIIGIAGGSGSGKTTIAHEIYDQLQQDDHILIMTQDSYYKNNDNLSMADRKKINYDHPDAFDMPLLVEQLRQLMDYKAVEMPVYDFTAHTRSEKTIHTEPADIIILEGILVLGEENLRDLMSIKVFVDTDDDIRFIRRLERDTQERGRSVESVINQYLATVKPMYNQFIEPTKRYADIIVPEGGENDVAIDMLTTKIRSVLSTVK

SEQ ID NO: 49205 - protein, 473 aa, Oryza sativa Japonica Group
MAFFIMAKSFSYYWPRYMKERSSIAVIGLSVHTAPVEMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRSGQNSGGLGKNIDRMFKDAITAGKRVRCETNISSGAVSVSSAAVELALMKLPKSECLSARMLLIGAGKMGKLVVKHLIAKGCKKVVVVNRSVERVDAIREEMKDIEIVYRPLTEMYEAAAEADVVFTSTASETPLFTKEHAEALPAISDAMGGVRLFVDISVPRNVSACVSEVGHARVYNVDDLKEVVEANKEDRLRKAMEAQTIITQELKRFEAWRDSLETVPTIKKLRSYADRIRASELEKCLQKIGEDALTKKMRRSIEELSTGIVNKLLHGPLQHLRCDGSDSRTLDETLENMHALNRMFSLDTEKAIIEQKIKAKVEKSQN

SEQ ID NO: 49206 - protein, 141 aa, Acidovorax sp. JS42
MAIERTLSIIKPDAVAKNVIGQIYARFEAAGLKIAAARMIHLSRAEAEQFYAVHKERPFFKDLVDFMISGPVMVQALEGENAVLKNRELMGATDPKKAAPGTIRADFADSIDANAVHGSDAAETAQVEVAFFFPGLNIYSR

SEQ ID NO: 49207 - protein, 2233 aa, Streptomyces violaceusniger
MANEEKLVEYLKRVSADLHDTRLRLREMEERSQEPVAVVGMACRFPGGVTSPEELWELLVSGVDAIGDFPTDRGWDLENLYHPDPEHYGTSCVRQGGFVEADRFDAAFFGISPREALAMDPQQRLVLELAWESLERAGIDPVSLKGTRTGVYAGVSSQDYLSRAPRIPEGFEGYATTGGLTSVISGRVAYTFGLEGPAVTVDTACSASLVAMHLAVQALRQGECALALAGGVTSLATPIMFTEFSRQRALAPDGRCKSFAADADGTGFSEGVGLVVLERLSEARRNGHRVLAVIRGSAINQDGASNGLTAPNDVAQERVIGQALANAQLAPGDVDAVEAHGTGTKLGDPIEAEALIATYGQNRPADRPLLLGSLKSNIGHTHAAAGVAGVIKMVMALRHPQLPANLHLDEPTPHVDWDGSGLRLLTEPVEWPRLERPRRAAVSSFGISGTNAHLILEQAPEVDVESVSSEVGGVVPWVVSGRSVEALRGQAAGLVERVGGGSGLSVVDVGWSLVSTRSVFEHRAVVVGEGRGELLAGLEALAGGVSHVGVVRSGGVGLVGGVGPVLVFPGQGSQWVGMGAGLLEVSSVFAARVGECERALAPFVDWSLRDVLRGVEGAGDLGRVDVVQPVLWAVMVSLAAVWAGYGVRPVAVVGHSQGEIAAAVVAGALSLEDGAKVVALRSKALRRLAGGGAMASLGVGQERAGQLLSGLGDQAAGVGVAAVNGPSSTVVSGPPEQVAAVVAACAEAGERARLIEVDYASHGPQVDEIRDELNEVLAGVRPLSDGADEVAFYSTVTGGRPDASALDTGYWVRNLRERVRFADAVEALLADGHRVFIEASTHPVLTLGMEETFEQMGVDAVAVPTLRRDHGGQAQLLRSLAEAFTAGVDVDWSAAFPADPTPRTVDLPTYAFQHQRYWLDGLSGRGADPTDLGLVAAGHPLLSAAVELADGQGHLLTGRLSARSHGWLADHVVAGAVLVPGTALVEWALRAADEVGCGGVEELALQVPLVLPSNGGVRLQVAVGGPGADGRRDVRMYSRPDEDGGDAAAGWVCHAEGVLSPPPDGSGPVEELGGAWPPAGAKPVEPGDFYEHIAASGYAYGPAFQGLRAMWRDGTDLLAEVALPEAAGERTGFGIHPALLDAALHPVLLTDGSPSGAESAGGRVWLPFTWSGVSLWATEATTVRVRISPYEPSAEGERKLRVTVADALGTPVLSADAVVLRSADPDQLRTAQQLGADGLLVMDWVPLPVPAPSNGAGRSADHTADDADWAILGPEDRAPAGSAAVCHPDPQALISALDAGAPTPTIVLALEPAKAVDAGIAGMGADGLASAERVLALLQSWLSEPRLADTRLAVVTRGAIATDDPGGFDPVAEGVDTASAAVWGLVRSAQAENPGRFLLLDLDPHAEVSSARLVADAVARAVEMDESQLALRAGRALMPRLVRAARSGGLVAPAGEPAWRLGLEGAGTVDSVRPVACPEVLEPLREGHIRIDVHAAGVNFRDALIVLGMYPGDAAFGGSEGAGVVREVGPGVTGLAVGDRVMGLFEGAFGPRAVADARTVVPIPDGWTFRQAAAAPVVFLTAWYGLVELGGLQAGERVLIHAATGGVGTAAVRIARHLGAEVYATASPGKHGVLEAMGVDAAHRASSRDLAFEEVFREATGGRGVDVVLNSLAGPFVDASLRLLREGGRLLEMGKTDIRDPELVAAEHPGVIYRVYDLIADAGSDRIGEMLRGLGELFASGVLEPPSVRAWPLSRAREALRYLSQAKHTGKLVLDVPAPVDPDGTVLITGGTGTLGGHVADHLVRAWNIRHLLLVSRGGTDAPGAPELLARLADLGADVRIAACDIGDAAQLAEVLAGIDPAHPLTGVVHAAGALDDAMLPSQDPKRLARAWAAKAAAAAHLHTATERLRLGMFIMFSSFASDLGTPGQANYAAANAFCDALAARRQAAGLPGLSVAWGLWAATSGLTARLADADLARIGRLGIKANSAEEGLALLDAARHHGHPHLLALRLDTGSLAAQPSGTLPAPLRALATAGGGRARPTAAAGGQTTDWAGRLRGLPATEQHRLLLNLVRTQAATVLGHADPGVVRPDASFKDLGFDSLTAVELRNRLAAATGLRLPAALVFDHPEAAVLAERLRRELSPDGEPGAPDADVPRPHPVLNELIRLENSLSAVAVEDVDSGAVTARLETLLSRWKALCSSARADDGNAVGRLRVATADQVLEFIDNELGLS

SEQ ID NO: 49208 - protein, 408 aa, Geobacter sulfurreducens PCA
MESKKVSVIGLGYIGLPTAALFASRKIRVVGVDINMEVVDTINRGEIHIVEPDLDMLVNAAVVGGYLRATTSPEASDAFIIAVPTPFRDGKKPDLSYVETATRMIADVLKKGDLVILESTSPVGTTEQVAEWLAAARQDLTFPHQVGESSDIRLAHCPERVLPGQILRELVQNDRVIGGITQKCSAEAVKLYKAVVNGECIVSDARTAEMCKLTENSYRDVNIAFANELSLICDQLGINVWELIRLANRHPRVDILQPGPGVGGHCIAVDPWFIVSKTPDKARLIRMAREVNDDKPYWVVEKIKTKATRFKHPVIGCLGITFKANIDDLRESPALEIVRDLMASDVGHILVCDPHCTNMELEFPIVELNEVVVSADILVVLVDHQEFKNIRPDTLKEKIIIDTRGIWS

SEQ ID NO: 49209 - protein, 4083 aa, Streptomyces violaceusniger
MTHANEEKLVDYLRRVAGDLHETRQRLRELEDRSQEPVAVVGMACRYPGQADSPEELWRLLASGDHAMGEFPADRGWDLDGLFHPDPDHPGTSHAREGGFLYDADQFDPEFFGISPREALAIDPQQRLLLEVSWELLERAGIDPAALKGSSTGVYAGTALPGFGTPHIEKSAEGYLVTGNAPSVLSGRVAYTLGLEGPAVTVDTACSSSLVSMHLACQALRQGECTLALAGGVTVMAIPNVFTEFSRQRGLAPDGRCKAFSADADGTAFSEGVGLVLLERLSDARRHGRRVLAVIRGSAINQDGASNGLTAPNGPSQQRVILQALANARLSPVEVDVVEAHGTGTRLGDPIEAHALLATYGRDRPDDRPLWLGSVKSNIGHTQGAAGVAGVIKMIMAMRYETLPATLNVDEPTPHAAWDTGAVRLLTEAVDWPRGERPRRAAVSSFGISGTNAHLLLEQPPADESSADEPPAGVSPADESSADESSAPDRISGAISVDTEPSGQRVVPWVVSARTGRALRDQADALATYLTDHPDLPVADVGWSLARTRSAFEHRAVAIGEDREELLTAVRALAEGRGHPGLTLATAPTRSGGTAFMFTGQGSQRPGMGRELYRAFDVFATALDDACAQLDPLLGHPLRDILFAAEDTDKARALHGTGVTQAALFALETALFRLVESFGLTPSFLTGHSVGELVAAHVAGVLSLPDACALVAARGRLMQALPSGGAMAAVEATEEQILPLLAGRADRVALAAVNGPTSVVVSGAAETVDEIARTLKERGHRTKRLRVSHAFHSPLLDPMLDDFREVARRLTYHAPRIPVISNVTGRPSDPEQLRDPEYWVRHISEPVRFHDGLRTLHGEGVTRYLELGPDAVLTTMARDALAAETTAPDTSDGEPVFATVLRPGRDEPRTLLTALALMHIDGGAVDFAAALPEDAVHVDLPTYRFQRQRYWRPVPNATADVRAVGLGATGHPLLQAVVETPDGGLLLTGRLSPHTHAWLADHTIADSVPLPGTALLELALLAAARTGSELIDDLTLETPLILPASGAVRIQLAVTPPDETGRRTVTIASRPADEGGGALDAPAAWRHHATGVLSDAITPPPDDGPRTAAWPPAGVVPVDVADLYERLAAQGYAYGPAFRGLHTVWRLGEEMFAEVRLAPEQHAEADGYGLHPALLDSALHPVEELMGGGHAPDGAEATVRLPFTFGGVRLFATGATRLRVRITPTAADTLTLRLTDDHGAPVATIDALGLREVRADRWRSARAATADAPLYRLDWQPYPISVDSPPRTASWALIGPRDQAPAAPDLPAHPDLDALRAALDGGQPAPDVAVLECPGAPDTSAPDTSAHPDETPARVRAVVHHILGALRTWLTDERFSGTRLVIATRGAVATGPGDGPADLATAPVWGLVRAAQAEHPERILLLDLDDDPASRDALRTALPAAVAGAESEVAVRAGTALVPRLVKVRPERDTPPRALDPDGTALITGGTGALGRLVARHLVAAHGARHLLLVSRSGGITEDIDAFADELTALGAADVRIAACDAADPEALAALLATLPEAHPLTAVIHAAGVLDDGVVTAMTPEQLDTVLAPKLDAAWHLHRLTRDMDPAAFVMFSSAASIMGSGGQANYAAANMFLNALAEHRRAEGRTAHALAWGLPASAGGMTRHLEDADLARMGRPGVGPVSNEQALTLLDTALTTDHPTLVPARFDLAALRTRASAGPLPPVLRRLVHTPTRAARNTVTSSLAGRLADLPPEEQDRLIGELVRDQVATVLAHPAPEAIELGRAFQDLGFDSLTALDLRNRLNAATGTRIPATVIFDYPTPDALVRFLRERLVGAPARTLLPPTATPVATDDDPIAIVGMACHYPGGVGSPDELWRMVADGVDAIGEFPADRGWDLGGLFDPDPDHIGTSYAREGGFLHEAPRFDAEFFGISPREALATDPQQRLLLETAWQAFESAGIDPVSLRGSRGAVFTGVMYDDYGSRFLGRTPEGVEGRLMTGSTPSIASGRVAFTFGLEGPAVTVDTACSSSLVAMHLAAQALRQGECTLALAGGVTVMATPNTFVEFSRQRGLAPDGRCKPFAAAADGTGWGEGIGLLVLERLSDARRNGRDVLAVIRGSAINQDGASNGLTAPNGPSQQRVIRQALATARLSPADVDAVEAHGTGTTLGDPIEAQALLATYGEDRPEGSPLWLGSIKSNIGHTQAAAGVAGVIKMVMAMRYGLLPVSLHIDEPSPHVEWNDGGVRLLTEAVEWPRAERPRRAGVSSFGISGTNAHVILEQAPDQAHSTEPDPDPGPEPGPDGLRVVPLVLSARGAEALRDQARALAARLTTGPTASAAEVGWSLIRSRTLFDHRAVVVGESRAELMAAVEALAADETHPGVVHTGAAVSTGGAGPVLVFPGQGSQWIGMGAGLLDVSPVFAARVAECERALAPYVDWSLTEVLRGVAGAGDLSRVDVVQPVLWAVMVSLAAVWAGHGVRPAAVVGHSQGEIAAACVAGALTLEDGARIVALRSRALRQLAGGGAMASLGVGQERATDLLSGLGDRAAAVVVAAVNGPASTVVSGPPEQVAAAVAACRDTGERARTIEVDYASHSPQVDEIADELTELLKGVEPLEPPGSGVGFYSTVTGGRADASILDTGYWVQNLRERVRFAEAIQALLADGHRVFIEASTHPVLTVGMQESFEEAGVPAATVPTLRRDHGDLAQLVRSLAQAFTAGAEVDWTTLFPTDPAPRTVPLPTYAFQRERYWLEGTAGRGGDPADLGLVSAEHPLLGAAVELADGSTHLLTGRLTAGGGESWLGEHVVAGARLVPGAAQVEWALRAADEAGCGTVEELALQFPLVLPDTGGLRVQVVVGEAAEDGRRDVRVYSRPDRDAETTADPVWVCHAVGVLGPHGEPAPQPSGVWPPAGAEPVDTDGFYERATAAGYGYGPAFQGVRRLWRDGADVLAEVALPEPAGGQAGFGIHPVLLDAALHPASLLDRPMEEHGEDPAEEHGEKHGEAQREGHDDGRVWLPFAWHGVSLWAAGATTVRVRLTPHEQAAEGERALRLTVADAVGDPVLTVDSLVLRPARTDQLRTAGRGAVDGLFTLDWTPLPEMAPGADTGLPEPVAGDGGWVALGAEGVEWAPPGVVRHPHLESLVAAIDAGTPVPSVALTAVPASKTAMDIEAAETDALAAVRRTLDLLRGWLAEPRLAESRLVVVTHGAVAPGGPVAEDHGSGAVDTAGAAVWGLLRSAQAENPERFLLLDRDPHGAPDPDEIGAAVLDGVLKAVALDEPQVAVGSGRVWAPRLTRADGPGSGGLVGPVGEPAWRLAVRGASTVDNVTPVPCPEVLEPLGPGEVRIAVHAAGMNFRDALIAVGMYPGGGVFRGSEGAGVVVDIGPEVAGLAVGDRVMGLFEGAFGPWAVADARMVVPIPDGWSFRQAAAVPVVFLTAWYGLVDLAGLRDGESVLIHAATGGVGMAAVQIARHLGAEVYATASPGKHTVLEEMGIGQAHRASSRDLDFEEAFREATGGRGVDVVLNSLAGPFVDASLRLLADGGRLSEMGKTDIRDPERLAAAHPGIRYRAFDLVPDAGPDRIGEMLCELGELFGAGVLRPAPVRPWPLDRARDALRRLSQAKHTGKLVLDVPAAVDPDGTVLITGGTGTLGAYIAEHLVRTWGMGHLLLVSRRGPDAPGARDLAARLEELGARVRVAATDVTDASAVADLVAGIDPEHPLTGVIHATGVLDDAVVTAQTPERLARVWTAKATAAAHLHTATSHLRLGMFVLFSSAAGTLGSPGQANYAAANAFCDALAAHRRAAGLPGVSIAWGLWADASGMTGHLAEADLARMSRTGVAALSTRHGLALLDAAVQHGGDHLVAAHVDPRTLAGLPAESLPATLRALAATGGAGTGRRTAAAAGEGRQVDWGARLAGLSTAEQHRLVLNLVRGHAATVLGHADVDAVQAEASFKELGFDSLTAVELRNRLAAATGLRLPAGLVFDYPEATALADHLLERLAPGDGPAPGRDAVDPVLGELARLDTTLATLATDDEGRERIAKRLGALLAKWNTGGSGDPAGTTGFDALEAASDDEMFELIDRELP

SEQ ID NO: 49210 - protein, 4055 aa, Streptomyces violaceusniger
MSGTEEKLRQYLKKVTADLGQTRRRLREMEERSQEPVAIVSMACRYPGGITSPEELWELVASRGDAIGEFPTDRGWQLDGLFHPDPDHFGTSYVRHGGFLDRADGFDATFFGISPREALAADPQQRQLLEVAWELIERAGIDPTSLKGTATGVYAGAGILGFGTPQIEKSTEGFLLTGNTLSVVSGRVAFTLGLEGPAVTVDTACSSSLVAMHLACQALRQGECTLALAGGVTVMTTPNTFVEFSRQRGLAPDGRCKPFAAAADGTGFSEGVGLLLLERLSDAQRNGHQVLAVIRGSAINQDGASNGLTAPNGPSQQRVIRQALINAQLSSAEVDAVEAHGTGTTLGDPIEAEALLAAYGQDRTAEQPLWLGSLKSNIGHAQGAAGVAGVIKMVMALRHELLPATLYVDEPTPHADWSSGAVRLLTDSVEWPRNERPRRAGVSAFGISGTNAHLIVEQAPEEGEPTEPVSSDLGTVSWVLSGRSVEALRGQAAGLVERVGGVSELSPVDVGWSLVSTRSVFEYRAVVVGVDRAELVAGLEALAGGVSHAGVVRSGALVGGVGPVLVFPGQGSQWVGMGAGLLEVSPVFAARVGECERALSSYVDWSLMDVLRGVGDLGRVDVVQPVLWAVMVSLAAVWAGYGVRPAAVVGHSQGEIAAAVVAGALSLEDGAKVVALRSKALRRLAGGGAMASLGVGQERVGQLFSGLGDQAAGVGVAAVNGPSSTVVSGPPEQVAAVVAACQESGERARLIEVDYASHGPQVDEIRDELNEVLAGVRPLSGGADEVAFYSTVTGGRTDASALDSGYWVRNLRERVRFADAVEALLADGHRVFIEASTHPVLTLGMEETFEQVDVDAVAVPTLRRDHGGQAQLLHSLGQAFIAGVEVDWKAAFPVDPTPRTVDLPTYAFQHQRYWMNASGAASDPSGLGLVAADHPCWAPPWSWPMAAPICSPGVSRPLAVAVAVASGGWLGEHIVANAVLAPGAALVEWALRAADEVGCGGVEELTLQVPLVLPESGGLRVQVVVGAAAEDGRRDVRIYSRPGGEADSGVADVGWVCHAEGVLSPASEGVGQSAEGLGGTWPPASAQPVDLEGFYERSAAAGYAYGPSFQGVRAVWRDGADLLAEVALPEAAGDADGFGIHPALLDAALHPALLLDTGSDEDRDGGQVRLPFAWNGVSLWAAGASTVRVRLSPHRDGAEGERGLRLMVADTVGDPVLTVDSLVTRPAAVEQLRAAAARGADGLFVLDWTPLARPMGTDGPVADRDGWTVLAAEGSYPDLDAFLAGLDDGEGGPAVVLAEFPRPDTDAVADMAAAGLAMAQRALELVQKWLAEPRLADARLVVVTRGAVAVTDTEGAMDVAAAALWGLLRSAQAENPGRFLLLDLDLDFGSDVDLDVDRALDLHLRDAITQAVDLDEPQLAVRDGQAWVPRLIRASVGSGPEGREGTPAALDPDGTVLVTGGTGTLGGLVAEHLVRTWQVGHLLLVSRRGPDAPGARDLAARLEGLGARVRIAAVDVTDASAVADLVAGVDAEHPLTGVIHATGLLDDAVLTSQTPERLARVWAAKATGAAHLHTATADLPLALFAMFSSAAGVLGSPGQANYAAANAFCDALAAHRQAHGLPGLSVAWGLWAQSSEMTGKLATTDRARMSRSGIAAMSSEKALGLLDAACAQGEPLCVAATIDPAGVAGVGLPVVLRGLVGGRVRRRVAEGGLLGSGLVGRLVGLDAAGRLGVVVDVVRGGVAVVLGFGSLGEVRVDVAFKELGFDSLTAVELRNRLSVVTGLRLPATLVFDYPTPRVLAEYLCTRLTGETSGVDTHAPVVAAADADEPIAIVAMTCRFPGGVSSPEELWDLVASGRDAIGEFPTGRGWDLDGLFHPDPDHPGTSYARKGGFLYDADAFDAAFFGINPREALATDPQQRLLLEASWEVLERAGIDPVSLKGSSTGVYAGVMYHDYAAGLSGGDARLEGYAMLASSGSVVSGRVAYTLGFEGPAVTVDTACSSSLVAMHLAAQALRQGECTLALAGGVTVMATPDVFTGFSRQRGLAPDGRCKPFAAAADGTGWSEGVGVLLLERLSDAQRNGHDVLAVIRGSAVNQDGASNGLTAPNGPSQQRVIRQALVSAGLSASDVDAVEAHGTGTTLGDPIEAQALLATYGQERPAEQPLLLGSIKSNIGHAQAAAGVAGVIKMVQAIRHGRLPASLHIDEPSPHVDWASGAVRLLTEAVEWPEGGRPRRAGVSSFGASGTNAHLLLEQAPEPSKHITAAEPVSLPDMRAVPWTLSARSAQALRGQAAALAERMARCPELSAVDVGWSLATTRSLFEHRVVALGDDRAELLAAVEALATGEPHPGVVLPGGGAAAGRTVWLFSGQGSQRQGMGAGLYDRFPVFAAAFDEVCELLDPHLEHPLRDVVFHGVAERPGLLDHTTYAQAGLFALHIALARLLMSLGAHPDALIGHSIGEVAAAHIAGVFDLPDACRLVAARATLMGGLPEGGGMATVAATPDELADDLAAHDGQVGIAALNTPGNTVISGPTGLVADISATWAAKGRKTRTLTVSHAFHSPLMDPILGPFARAIDDLTFHRPTFSVLSNLTGEPADEEMATPGYWVRHIRQPVHFHPAVAHIAPETGVFLELGPDPVLATATQHTLQHLTAEEATADADERADGRPTPLVTATLSRKRPDAHALGHALAQLHTHGTDIDWVRWFPADPAPRTVDLPTYAFQRERYWLAAGGGVGDVGAAGLQRVEHAHLPAAVGLADGALVLTGRTPGGGDGGWLAEHVMAGAVLAPGAALVEWALRAADEAGCGGVEELALQVPLVLPASGGLRVQVVAGAATGDGRRDVRVYSRPDRDVEPGADPGWVCHAEGVLGPPSLRSPGLVDEPVTAWPPAGAEPVRLDGFYEHAAASGYAYGPSFRGLRAVWRDGADLLAEVALPEAAGDPEGFGIHPALLDAALHPAFLLDRPEAEHDEGRVWLPFAWNGVSLWAGGATTVRVRLSPRNQDGVEGERGLRVEVADAVGGPVLTVDSLVMRPAAVDQLRTTGGPEVDGLFTLEWTPLPVPAQDHTDAGNHEPDPADGGGWAVLDGQGCGPIPPGAVHHPRLEELVSALDDDGPAPSVAIAYLPAFGDPSDGSDPSDSCAGDTDTDLAAAGLAASEWVLELVRGWLAEPRLADTRLVVVTRGAVAIDASEAEGAGDGGVDVAGAAVCGLVRSAQAENPGRFTLLDLDPDSEPLAEGVRGAVTWAAHMDEPQIALRAGRLRVPRLMRAGGASSGGVAALVGQPAWRLELTGAATVENVKPVPCPEVLEPLGTRQVRVAVHAAGINFRDALISLGMVPGQTGLGGEGAGVVLDIGPEVTGLAVGDRVMGVFDRAFGPIAVTDARMVAPIPAGWTDAQAASVPVAFLTAWYGLVELGGLQAGESLLIHAATGGVGMAAVSIARHLGAEVYATASPGKHTVLEEMGIDEAHRASSRDLDFEEVFRGATGGRGVDVVLNSLAGPFVDASLRLLAESGRLMEMGKTDLRDPERVAEAHPGVTYQVYDLITDAGPERIGRMLGELGELFTAGALRPRPVRTWPLSRTHEALRHLSQAKHTGKLVLDVPAPVDPDGTVLITGGTGTLGALVAEHLVRVWRIGHLLLVSRRGPEAPGAQDLTARLTALGARVRIVAADVTDAAAVADLVAGVDPEHPLTGVIHAAGVLDDAVVTAQTPERLARVWAAKATAAAHLHNATAHLRLGAFVLFSSAAGVMGSPGQANYAAANAFCDALAAHHRARGLPTVSVAWGLWAEASEMTGGLAEADLARMSRSGVTAMAADHALRLLDAAAEHGGHQLIAADMNPRVLAAQPADSLPATLRALAASGAGGTAARRTAAAADARPDDWADRLVGLSATEQRRAVLQLVRGHVATVLGHADAEAVQADTSFKELGFDSLTAVELRNRLAAATGLRLPAALVFDYPEAAVLADYLLERIAPAVGAASEVGRDGADPVLNELARLEATLIGLEMEAGDSGAVTARLESLLAKWKATRKPAEEEMTAAERLESASAAQVLDFIDNELGVS

SEQ ID NO: 49211 - protein, 140 aa, Zea mays
MTSPWCLSAPPAAPPVAAAPGALGFSASASTLARVPVPGSRRRRWNALVVCAAPDEEKITKRSPLDFPIEWERPKPGRRPDIFPKFSPMKTPLPHPLPADDPLDDDEEEEEEQAPPQEEPQEDDPDKEEPEEDDPDKPTE

SEQ ID NO: 49212 - protein, 4045 aa, Streptomyces violaceusniger
MVNVNEEKLVEYLKRVSADLHDTRLRLRAAEERHQEPIAVVSIACRFPGGVNTPEDLWRLVADGVDAIGDFPTNRGWDLDNLYHPDPDHAGTTYVRRGGFLYDADRFDPQFFGISPREALATSPQQRLLLETAWEACERAGIDPVSLKGSRTGVYAGTATTGGTTSADLPQKGSEGYAGNAPSLLSGRVSYTLGLEGPAVTVETACSSSLVAIHLAGQALRQGECTLALAGGVTVMATPFTGFSRQRGLSPDGRCKAFSASADGTGWGEGVGLMLLERLSDARRNGHRVLAVIRGSAINQDGASNGFAAPNGPSQQRVIRQALASARLAPSEVDAVEAHGTGTKLGDPIEADALIATYGRNRPQDRPLWLGSLKSNIGHTQGAAGVAGVIKMVMALRHGVLPATLHAEELTPHVEWDGGGVRLLTEPVEWPEGERPRRAGVSSFGISGTNAHVIVEQAPEGDVESVSSEVGGVVPWVVSGRSVEGVRGQAAGLVERVGGGSGLSVVDVGWSLVSARSVFEHRAVVVGVDRAELVAGLEALAGGVSCSGVVRSGTAVVVGGVGPVLVFPGQGSQWVGMGAGLLEVSSVFAARVGECERALAPFVDWSLTDVLRGVGDLGRVDVVQPVLWAVMVSLAAVWAGYGVRPVAVVGHSQGEIAAAVVAGALSLEDGAKVVALRSKALRRLAGGGAMASLGVGQERAGQLLSGLGDQAAGVGVAAVNGPSSTVVSGPPEQVAAVVAACAEAGERARLIEVDYASHGPQVEEIRDELMRVLEGIRPLDTSGSDTAFYSTVTGGRAVTTDLDTGYWVTNLRERVRFTDAVEALLADGHRVFIEASTHPVLTLGLQETFDKADIAAVTVPTLRRDHGGQDQLLHSLAQAFTAGVDVDWSAAFPADPTPRTVDLPTYAFQRQRYWATATGGVGDVGAAGLQRVEHPLLRAAVGLAGGGLVLTGRVSATGGDGWLGDHVVAGASLVPGAALVEWALRAADEAGCGGVEELALQVPLVLPESGGLRVQIVVGEAAEDGRRDVRVYSRSDRDAEPGADPDWVSHAEGVLCPSSPSSPSTAPSAAEGLVGVWPPEGAKPMDVEGFYERAVAAGYAYGPSFQGVRAVWRDGADLLAEVALPEAAGDADGFGIHPALLDAALHPMLLAADTESADGEGMRLPFAWNGVSLWATEATTVRVRLSPRHPSPDQDGAVGEHGLRVVVTDAMGAPVLTVDSLTMRPADPGQLRAGNGRGADGLFTLDWIPMPGLLDVDASDSMGWVVLGEDSLHLAEEPGLGGGGVVCHPDLEALVAALDDGAPPPAFAVTYLPADGDPAEAGAVARAADGLAAVGEALELVRGWLAEPRLADARLVVVTRGAVSIDGPHGEDSGDGEVNVAAAGLWGLLRSAQAEHPDRFVLLDLHQATDSAAGEVADAVVRAVRADEPQVALRTGRPMVPRLMRARDTGGADEAESEGLTPAGLDPDGTVLITGGTGLLGGLVAEYLVRTWQVKHLVLVSRRGPDAPGAPELAERLSDFGARVRIAAVDVTDAEAVADVVAGIDSAHPLTGVIHAAGLLDDAMVTSQTREQVARVWAAKATAAAHLHTATADLPLRMFVMFSSAAGVVGNAGQAGYAAANAFVDALVAHRRELGLPGLSLAWGLWAQASEMTGHMGRADLTRLRGMKPLSSERGLALLDAACRFAHPLMVAVDLDPAGVAGVGLPVVLRGLVGGRVRRRVAEGGLLGSGLVGRLVGLDAAARLGVVVDVVRGGVAVVLGFGSLGEVRVDVAFKELGFDSLTAVELRNRLSVVTGLRLPATLVFDYPTPRALAEYLCTRLTGETAVSRAPLAVRADADDPVAIVGMTCRFPGGANSPEALWDLVASEKDVMGAFPTGRGWDLDGLFHPDPDHPGTSYANEGAFLYDADAFDAAFFGINPREALATDPQQRLLLEASWEVLERAGIDPVSLKGSSTGVYAGVMYHDYAAGLNSGDARLEGYAMLAGSGSVVSGRVAYTLGFEGPAVTVDTACSSSLVAMHLAAQALRQGECTLALAGGVTVMATPDVFTGFSRQRGLAPDGRCKPFAAAADGTGWGEGVGVLLLERLSDAQRNGHEVLAVIRGSAVNQDGASNGLTAPNGPSQQRVIRQALASAGLSPFDVDAVEAHGTGTTLGDPIEAQALLATYGQERPAEQPLLLGSIKSNIGHTQAAAGVAGVIKMVQAMRHGLLPASLHIDEPSPHVDWESGAVRLLTEAVEWPEGERPRRAGVSSFGASGTNAHVVLEQAPSSPAEDAPTVASDVGTVSWVLSGRSAEALRGQAAALAERVGDASELLPVDVGWSLVSTRSVFEHRAVALGDDPAELLAAVEALAEGVSHPGVVRSGMAALTGVPGPVLVFPGQGSQWAGMGVELLEVSPVFAARVAECERALSPYVDWSLTDVLRGAEGAADLGRVDVVQPVLWAVMVSLAAVWAGHGVRPAAVVGHSQGEIAAAVVAGALSLEDGAKVVALRSKALRRLAGGGAMASLGVGQERASQLLSDLGDQAVGVGVAAVNGPSSTVVSGPPEQVAAVVAACQEVGERARPIEVDYASHGPQVEEIRDELTRVLEGIRPLDTSGSGTAFYSTVTGGRAVTTDLDTGYWVTNLRERVRFTDAVEALLADGHRAFIEASTHPVLTLGLQETFDEADIPAVTVPTLRRDHGGQAQLLHSLAQAFTAGVDVDWTTLYSSSPTPRVVALPTYAFQRERYWLDGHGGRAGDPADLGLVSAGHPLLGAAVELADGRGHVLTGRISARTHAWLGEHVVADAVLVPGAALAEWMLRAADEVGCGGVEELTLQVPLVLPESGGLRVQVVVGEAAEDGRRDVRVYSRPAGEGAPATGWVCHAEGVLSPDSDRSDDASGLGGAWPPAGAVSLGVEGFYDRVAASGYAYGPSFQGLRAVWRDGADVYAEVVLPEAAGEQAGFGIHPALLDAALHPALLIDQLDTDGTETIGTEPTDGRVWLPFAWNGVTLWAAGATTVRVRLSPHQENADGERALRLTVADAVGAPVLTVDSVAMRPASVDQLRAAVAPGSHATDSLFTVEWTPLPLAAGAGEAAPWDDGWAVLGVGGHPDPAALVAALGDDEPVPPVVLADMTEPTRPIGEGAEEASAEALSATERALELVRGWLAEPRLAEARLVLVTRGAVTVDGPESTTRVDLAAAAVWGLVRSAQSENPGRFVLLDSDVDSDIDSDDDFDADADTDTDTDANLRPNATLRIAVARAMETDEPQLALRAGRALVPRLVHAGTGGAGLVGPVAQPDAWRLDTAGTATLENVVPVPCPEVLEPLGAGQVRVAVRAAGVNFRDVLVGLGMVPGQTGLGGEGAGVVVDIGPEVTHVSMGDRVMGVLDQSFGPLAVTDARLLAPIPDGWSFRRAAAVPVACLTAWYGLTDLAGLRPGESVLIHAATGGVGTAAVRIARHLGAEVYATASPGKHGVLEAMGVDAAHRASSRDLAFEGAIREATGGRGVDVVLNSLAGPFVDASLRLLREGGRLLEMGKTDIRDPELIAAEHPGVTYRVYDLITDAGPDRIGEMLCELGELFASGALEPPSVRAWPLSRAREALRYLSQAKHTGKLVLDVPAPVDPDGTVLITGGTGTLGGHVAEHLVRAWHIRHLLLVSRGGMDAPGAEELVARLGELGAEARIAAVDVTDAAAVYDLVAGVDSAHPLTGVVHAAGVLDDAMVTSQTPERLARVWGPKAMAAAHLHAATAHLRLGMFVMFSSAAGVMGSPGQANYAAANAYCDALAIHRQAMGLPAVSVAWGLWADASGMTGHLDEADLARMSRSGIAAMSGERALGLMDAACWHGDPRPAAVQLDLRALSAQPADTLPALLRTLLDSGTTTRRTAATGAPASGLVAQLTAVPAEEQHRILLTLVRTQAAAVLGHTDAGAVSADTPFKDLGFDSLTGVELRNRLAAATGLRLPATVVFRHPTPSAIAAELREKLCPARPDTPAPGFGELEELETAVARLAPHDEARGRLAKRLEALLWRLGDDAPAEATGEDHATADGGGLDSASDDELFEFIDRELPS

SEQ ID NO: 49213 - protein, 470 aa, Staphylococcus xylosus
MGLGRVTQVMGPVIDVRFEHNEVPEINNALVLDVEKDEGTVSLTLEVALQLGDDVVRTIAMDSTDGVKRGTEVRDSGSSISVPVGDATLGRVFNVLGDTIDLDEKLDSSVERDPIHRESPAFDQLSTKVEILETGIKVIDLLAPYIKGGKIGLFGGAGVGKTVLIQELINNIAQEHGGISVFAGVGERTREGNDLYYEMSDSGVIKKTAMVFGQMNEPPGARMRVALSGLTMAEHFRDVQGQDVLLFIDNIFRFTQAGSEVSALLGRMPSAVGYQPTLATEMGQLQERITSTTKGSVTSIQAVFVPADDYTDPAPAAVFAHLDATTNLERKLTEMGIYPAVDPLASTSRALDPTIVGQDHYEIARDVQSTLQKYRELQDIIAILGMDELSEEDKQTVERARRIQFFLSQNFHVAEQFTGQKGSYVPVQKTVEGFKAILDGEYDHIPEDAFRLVGSMEEVIAKAKDMGVEV

SEQ ID NO: 49214 - protein, 269 aa, Salmonella enterica subsp. enterica serovar Paratyphi A str.
MEKKIGFIGCGNMGKAILGGLIASGQVLPGQIWVYTPSPDKVAALHDQYGINAAQSAQEVAQVADIVFGAVKPGIMVKVLSEISSSLNKDSLVVSIAAGITLDQLARALGHDRKIIRAMPNTPSLVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGKHPGELKDMVCSPGGTTIEAVRVLEERGFRAAVIEAMTKCMEKSEALSKS

SEQ ID NO: 49215 - protein, 580 aa, Flaveria palmeri
TDSESKKPTAVVGGGVEDVYGEDSATEDHFITPWSVSVASGYSLLRDPHHNKGLAFTEKERDAHYLRGLLPPVVVNHDLQVKKMMHNIRQYEVPLQRYQAMMDLQERNERLFYKLLIENIEELLPIVYTPTVGEACQKYGTIFKNPQGLYISLKDKGKVLEILKNWPQKKIQVIVVTDGERILGLGDLGCQGMGIPVGKLSLYTALGGIRPSACLPITIDVGTNNEKMLNDEFYIGLRQRRASGKEYAELMNEFMSAVKQSYGEKVLIQFEDFANHNAFDLLEKYRTTHLVFNDDIQGTASVVLAGLISALKLVGGSLADHKFLFLGAGEAGTGIAELIALEISKQTNAPLEETRKKIWLVDSKGLIVRSRLDSLQHFKKPWAHDHEPVNKFLDAVKSIKPTVLIGSSGAGQTFTKEIVEAMSSFNEKPIILALSNPTSQSECTAEQAYTWSEGRTIFASGSPFAPVEYNGKVYVSGQSNNAYIFPGFGLGLIISGAIRVHDEMLLAASEALAEQVTQEHFDNGLIYPPFTNIRKISAHIAAKVAAKAYELGLASRLPQPENLVAYAESCMYSPKYRNYR

SEQ ID NO: 49216 - protein, 604 aa, Flaveria floridana
PERNVNVSVDSAVRDVNAPVAVEVDRSVGEKPFAVVGGGVEDMYGEDTATEDQYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKNWPHKKIQVIVVTDGERILGLGDLGCQGMGIPVGKLALYTALGGVRPSACLPITIDVGTNNEKLLNDEFYIGLKQKRAAGQEYAELMNEFMSAVKQNYGEKVLIQFEDFANHNAFDLLEKYRTTHLVFNDDIQGTASVVLGGLISALKLVGGSLADQKFLFLGAGEAGTGIAELIALEISKQTNIPLEESRKKVWLVDSKGLIVKSRLDSLQHFKKPWAHDHEPVNEFLDAIKTIKPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEALAEQVTQEHFDKGLIFPPFTSIRKISAHIAAKVAAKAYELGLASRLPQPENLVAYAESCMYSPKYRIYR

SEQ ID NO: 49217 - protein, 612 aa, Flaveria trinervia
SMLNSNSLPERNVSVSVDSAVRDVNAPVAVEVDRSVGEKPFAAVGGGVEDMYGEDTATEDQYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKNWPHKKIQVIVVTDGERILGLGDLGCQGMGIPVGKLALYTALGGVRPSACLPITIDVGTNNEKLLNDEFYIGLKQKRAAGQEYAELMNEFMSAVKQNYGEKVLIQFEDFANHNAFDLLEKYRTTHLVFNDDIQGTASVVLGGLISALKLVGGSLADQKFLFLGAGEAGTGIAELIALEISKQTNIPLEESRKKVWLVDSKGLIVRSRLDSLQHFKKPWAHDHEPVNEFLDAIKTIRPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEALAEQVTQEHFDKGLIFPPFTSIRKISAHIAAKVAAKAYELGLASRLPQPENLVAYAESCMYSPKYRIYR

SEQ ID NO: 49218 - protein, 402 aa, Zea mays
  misc_feature (242)..(242): Xaa can be any naturally occurring amino acid
MAATAAVAGTGSSLSSRRSRSVVSSSFRAAASRFRSPRCVLGSEQLRVAHEGKRMSGAESRTAWAPKVPAPESRLAALPRELRDSRMKIFSGTANRPLAQEIAAYLGIELGKILIKRFADGEIYVQLQESVRGCDVFLIQPTCSPVNENLMELFIMIDACRRASARSITVVIPYFGYARADRKAQGREPITAKLAANLLTEAGSDRVIVCDIHSTQALGYFDIPVDHIYGQPVISMRGILKXLCLCKTISEDLVVVSPDVGGVVRARAFAKKLLNARLAIVDKRRQGHNMSEVMNLIGDVKGKVAILIDDMIDTAGTITSAAALLKQEGAEAVYACCTHAVFSPPAIERLSGGVFEEVIVTNSILLPEDKCFPQLTVLSMANLVGETIWHVHRDGSVSSIFQ

SEQ ID NO: 49219 - protein, 493 aa, Xanthomonas campestris pv. campestris str. ATCC 33913
MYRMLKSLLRVKPIEPAGRVDAGEPVEGSLQGEATLQRTLTAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGNILNLPAVLIVAAVSGLCYVGITQSAFINAIVVAIKIAVICLFVGFGAAYIDPANWHPFIPENTAPGVFGWSGVFRAASIVFFAYIGFDAVSTSAGETKDPQRNMPIGILGSLAVCTIIYIIVCAVLTGLMPYTQLGTAKPVATALEAHPQLTWLKTAVEIGAIAGLSSVVLVMLMAQPRIFYTMAKDGLMPKLFGKVHPKFHTPYVGTVIVGVVAASLAGLIPLSVLGELVSMGTLLAFATVCAGVMVLRFTKPELERPFRVPLAMIVCPLGTLACLALFFQAFQEHWKVFVGWTVIGLVIYFGYGIHHSRLARKA

SEQ ID NO: 49220 - protein, 486 aa, Listeria monocytogenes EGD-e
MKKETHGEIRRDLKTRHLSMIAIGGSIGTGLFLASGNAIHTAGPGGALVAYVAIGIMVYFLMTSLGEMATYMPVSGSFSTYASRFVDPAFGFALGWNYWFNWAITLAVDISTAAIIVQFWLPNTPAWLWSAIFLILIFGLNALSVKAYGESEYWFSIIKVATVIIFLIVGVLTIVGILGGEVIGFSNFTAGDAPFKGGFFAILGTFLIAGFSFQGTEMVGIAAGESATPETSVPKAIKQVFWRILLFYIFAIFIIGMIIPYTNPNLLSAEATDVAISPFTLVFEKAGLAFAASVMNAVILTSVLSAGNSGLYASTRMLWAMARDKKAPKFLGKVNRRGIPMAALIVTTIVGAMTFITTLTENGTVIYTWLLSASGLTGFIAWVGIAISHYRFRKAFIKQGHDLSELKYKAKFFPFGPILALVLCILVIVGQDYAAFLKPEFTNPAWWQKIGISYIGLPIFLVFWLSFKFTNKTKVIPLEDCKFDQK

SEQ ID NO: 49221 - protein, 492 aa, Frankia sp. EAN1pec
MPQLMSVAPCEIVVFGGTGDLAMRKLMPALYHRDRDGQLTPDSRVIAVSRAGLDDAGYRDKVDSELRRFVPELIHEPDVLARFIQRLHHITVDVAEHSTWDELRTLLADGKDHVRVFYLACAPQLFGPTCVGLQTNGLVTDNSRVVLEKPLGHDLVSARRINDEVGAVFAEEQIFRIDHYLGKETVQNLLVLRFANSLLEPLWNSGAIDHVQITVAETIGIGGRGDYYDGSGAIRDMVQNHLLQLLCLVAMEPPSRLDREAVRDEKLKILQALSPLTLGDVERCVVRGQYTAGLVEGAPVPSYQDEVDGSTSTTETFVALKVEVQNWRWSGVPFYLRTGKRLDRHASEIVVQFRPVPHSIFPGIKDAISPNALVLRLQPDEGVRLHLMAKEPGPGGVRLRPVHLNLSFAETFKSRLPDAYERLLMDVVRGNPTLFMRRDEVEAAWAWVEPILAALAASIDSPRRYAAGTGGPAAAIALIERDGRTWHEEVAE

SEQ ID NO: 49222 - protein, 108 aa, Vitis vinifera
MVRGSSQSQASSSVTSRPSTVGMAPRGSAAATAGMRRRRLGTGSAGGGSGGFGSGSSGSNMLRFYTDDAPGLKITPTVVLVMSLCFIGFVTALHVFGKIYRHRSGGVA

SEQ ID NO: 49223 - protein, 691 aa, Frankia sp. EAN1pec
MACRTATVNSRGGLHARPAALFVRAAAQQAVPVRIRKGDGPAVNAASMLSVLALGAMYGTVVTLEADGERAEEALDALAAILAHDQDAADSGQGDGRVGSASASDKALDETGGTGRSRATADVFVGLGVSPGLVTGPAFRMARQPRLPDPRLVLDPDEEAAAAARVLRNVASDLRAHAAATRLSAASDIVTAQAMMAEDPVLLDEVGMRVRSGLDAVHAIDAALADQRRQLEGAGGYHAERAADIDDIRHRAVAALLGLPAPGLPAPGFPFVLVAEDLAPADTATLDTDLVLALVTERGGPTSHTAILARALGLPAVVSCPGAMALDDGTPVRVDGTTGEVHVGVGVDVEADGAGHGEAIAQDTADVRQPGLWRTTSRAAKAGPARGGPGRTADGRPVQLLLNIGSAKDLRGDVAATAEGVGLFRTEFLFLNRRVAPTPDEQRDAYQAVFRAAGSRKVVVRTLDAGADKPLPFLSLPDEPNPALGVRGYRTVWLRPEVLDTQLGAIADAAAACDADVWVMAPMVSTPPEAEAFAAAARGHGLATTGVMVEVPAAALRAGRMLDTVDFLSVGTNDLGQYTLAADRQSGHLADLLSPWQPALLRLVADCAAAGEASGKPVGVCGEAAADPLLAAVLVGLGVTSLSMSGRSIAAVRDSLAAHTIKECRALAEIVIDADDAERARELATKNARQT

SEQ ID NO: 49224 - protein, 221 aa, Corynebacterium diphtheriae NCTC 13129
MCIVGFMSDFRTRYQIVSEKIAAAAQRSGRKPSDIRLIAVSKNHPVAAVQEAMDAGVTVFGENRPQELVEKAQAIPNAYWCAIGRLQRNKAKDIVRYAQEFHALDSLRLAQALDQRLDHQLDVFVQVNTSHEEQKGGIAPSEVEPFLAELSQFSHLHVRGLMTMARNDPCERVVRASFSELRELRDALLPHGELSMGMSGDFEWAIEEGATSVRVGSALFL

SEQ ID NO: 49225 - protein, 428 aa, Escherichia coli O157:H7 EDL933
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEAILGETLDLPKELAERADLPLLSHNLPADFAALRKLMMNHQ

SEQ ID NO: 49226 - protein, 310 aa, Aquifex aeolicus VF5
MKFLITGGAGFIGSNLAFALQERYPEAKIYVLDNFSSGHFKNLIGFKGQVITGDISDPSLWDYVRKNFHFDVIFHEAAITDTTVEDQYFMMKTNADSFRYILDLAVEWNAKVIYASSAGVYGNSPPPMREDKGLEPENIYGFSKLMMDHIAMDYMERYPEMNIVGLRYFNVYGPREDYKGKTASMIYQLAVKMIKGERPRLFKWGEQRRDFVYIKDVIKANLLALEKNVSGIFNVGTGRARSFNEIVSILNKELGTNYEIEYFDCPYDFYQKFTEADLTKIREALGYEPEYSLEEGIKDYLPYIIKRVKK

SEQ ID NO: 49227 - protein, 346 aa, Frankia sp. EAN1pec
MKVARFYAPGDIRIEEASEPVAGPDEVKVRVRNCSTCGTDVKISKFGHHHIRPPRVMGHEVAGEIVDVGDRVEGWQVGDRVQVIAAIPCGRCDECRRGRMTVCPNQESIGYHYDGGFAEYVTVPGKVLAVDGLNRIPEGVGFAEASVAEPLACVLNGQELARVGAGDDVVIIGSGPIGCLHVRLARSRGAGRVFLVELNRERLDRAAALVEPDASICAAETDAVDAVSKLTDGRGADVVITAAASGAAQEQALLMAARQGRISFFGGLPKDNPVIACDSNLVHYRELTIVGANGSSPAHNARALQHIATGDVPVSDLITHRLALTDVLAGIDIVSRGQGIKITIEP

SEQ ID NO: 49228 - protein, 268 aa, Glycine max
MDVGTVLLLCWVTLIPGILSDPSDEACMTHLSKSLQDPNNQLHNWKEENFANPCNDSTTNLRGAICNNGRIFKLSLNNLSLRGTISPFLSNCTNLQALDLSSNFLTGPIPADLQSLVNLAVLNLSSNRLEGVIPPQLTMCAYLNIIDLHDNLFTGPIPQQLGLLVRLSAFDVSNNRLSGPIPASLSNRSGNLPRFNASSFLGNKDLYGYPLPPLRNRGLSLLAIVGIGLGSGLASLVLSFTGVCIWLKITDRKMALEEGKITHLMPDY

SEQ ID NO: 49229 - protein, 80 aa, delta proteobacterium MLMS-1
IHAVDVEGKCAGVAEDLLRLLGEQAPLPTTYAGGVATMADMHRIDQLGGGRLDATIGSALDIFGGSGVKYRDAVAFSQRR

SEQ ID NO: 49230 - protein, 486 aa, Vitis vinifera
MDVDNKFFNAAFLLVATLVVAKLISALIIPRSKKRLPPTIKAFPLIGGLIRFLKGPVVMLREEYPKLGSVFTLKLLNKNISFFIGPDVSAHFFKAPESDLSQQEVYRFNVPIFGPGVVFDVDYSVRQEQFRFFTEALRVTKLKGYVDQMVMEAEDYFSKWGDCGEVDLKYELEHLIILTASRCLLGQEIRNKLFADVSALFHDLDNGMLPISVIFPYLPIPAHRRRDQARKKLAEIFANIIASRKETGKSENDMLQCFIASKYKDGRPTTESEVTGLLIAALFAGQHTSSITSTWTGAYLLRHKEYLSAVQDEQRSLMKKYGSKVDHDILSEMDVLYRCIKEALRLHPPLIMLLRSSHTDFSVTTRDGKEYDIPKGHIVATSPAFANRLPHIYKDPDRYDPDRFAVGREEDKAAGAFSYISFGGGRHGCLGEPFAYLQIKAIWSHLLRNFELELISPFPEVDWNAMVVGVKGKVMVRYKRRELPVN

SEQ ID NO: 49231 - protein, 513 aa, Pseudoalteromonas tunicata D2
MVSKELEYFRAIIQANMEPLAKVTQVSPMPSLEKKLGNKIWLKREDQQPVYSFKLRGAFHKLKQLPAQSKVVTASAGNHAQGVALSASFLGHTAKIVMPVTTPEIKVNAVRDLGGEVILHGHHFDAANSFALNLAEQEGAVFVPPFDDPDVIVGQGTIARELMQQLPQLDAVFIPVGGGGLLAGMSVYIKSLRPDIKVIGVESEESACLKAAMEAGKPVELERVGSFADGVAVKIIGKETFRLAQQFCDEVVTVTSDEICAAMQDVFVSTRAVAEPSGALALAGLKKWCIENKAKGLKLSAVLSGANLNFDRLRYVAERTALGEKNEALFAVTIGEEKGSFRRFCKALGGRAITEFNYRYANSTKAQIFVGVGLRRAQEELDELKAELTQLDYDFTDLSDNELAKLHIRYMVGGQPGQMIKERLFRFEFPEYPGALERFLDTLGANWNITLFHYRNHGAATGNVLAAFEIPDNDNQAFQEHLSRLAYGYQEETNNPCYQRFLAGPVEKLAEAG

SEQ ID NO: 49232 - protein, 459 aa, Mycobacterium sp. JLS
MTLTNETTLPNGLSIDDARAEAARAYELDRAHVFHSWSAQAEISPMVITAAQGSYIWDGEGRRLLDFSCQLVNTNIGHQHPKVVAAIQAQAAKLCTVAPQHANDARSEAARLIAERTPGELNRIFFTNGGADAVEHAVRMARLHTGKYKVLSRYRSYHGGTETAINLTGDPRRWPNDHGNAGVVHFFGPFLYRSQFHATTEAEESARALAHLEDIVRLEGPSTIAAIVLESIPGTAGIMVPPPGYLAGVRDICDRYGIVMIADEVMAGFGRSGKWFSIDHFDVTPDLLTFAKGVNSGYVPLGGVAIGPAIAETFAHRPYPGGLTYSGHPLATAAAVATINAMEEEDIVGNAARIGAEVLGPGLAELAARHPSVGEVRGTGVFWAIELVANPQTREPLAPYGASSAAMNAVVAACKANGLLPFANFNRIHAVPPCTVTADEVREGLAILDQALDVADSHL

SEQ ID NO: 49233 - protein, 150 aa, Zea mays
  misc_feature (24)..(24): Xaa can be any naturally occurring amino acid
ARVRNVLNGGSHVFFRRFPRFRAXPCEAPTFYQAMRQGAEVYQKLKALAKKTYGQSAGNVFDEGGVAPDIQTAEEALDLITKAIEEAGYTGKINIGIDVASSEFYKADEKKCDLDFNNPDSDKSKWITSEQLIDMYKSLPEKYPIVNIDD

SEQ ID NO: 49234 - protein, 463 aa, Rhodopseudomonas palustris CGA009
MYQPNLDLAEMFAAREANRSSMHARHLNEQLVRVLKTIGYDVGFQKGTGQYLYDRDGARYLDLLSGFGVFALGRNHPVVRKALQSVLDADLPNLVQLDVSTLAGILAERLLEQVPYLDKVFFANSGAESVEAAIKFARGATGRNGIVNCDHSYHGLTYGALSLTDDQNFQGGFGPLLPGVTTIPFNDLEALEKVLSTREVAAFIVEPIQGKGVNMPTDEFLPGAAALCKRYGTLFVADEIQTGMGRTGRFLAVEHWNVEPDMVLLSKALSGGHVPVGAVLTRKSIFDKIFNRMDRAVVHGSTFAKNDLAMAAGIATLEVLKAEKLVEAAAKRGAELRLALTRMVPGYELLKEVRGKGLMIGVEFGPPQSLRLKASWTMLETANKGLFVQLITVPLFKDHKILTQVAGHGLHTIKLLPPLTITEDDCAWIERAFDDTIAASHKVPGAIWSLGKTLVDNAVRKSA

SEQ ID NO: 49235 - protein, 380 aa, Geobacter sulfurreducens PCA
MSVYLDNAATSFPKPDAVYEAVDYALRRVGVGPGRGGYRRSIEATRIVFETREAVATLLGVADSSRVVFTHSATEALNLAVSGLLSPGDHVVTTTVEHNSLVRPLHAASGRGVEVTSVAADRRGFVTPDAVAAAMRPNTRLVALSHCSNVTGALQPVEEIGAEVKKRGALLLVDAAQSAGMIPLDAPAIGIDLLAAPGHKGLFGPQGTGILYVADGVELTPLMVGGTGVHSSDEEQPAAMPERYESGTLNTPGIAGLGAGVAFIERTGISAIRERETSLVRQILEGLAGMRRVTVHGPAADEPRGSVVSFSATDTDPQTIGFRLDHDHDISVRVGLHCAPSAHRTIGTYPTGTVRVSPGFFTTDNEVELFLRALREIVGG

SEQ ID NO: 49236 - protein, 434 aa, Staphylococcus xylosus
MPIITDVYAREVLDSRGNPTVEVEVLTESGAFGRALVPSGASTGEHEAVELRDGDKSRYLGKGVTKAVDNVNEIIAPELIEGEFSVLEQVSIDKMMIQLDGTENKGKLGANAILGVSIAVARAAADLLGQPLYKYLGGFNGKQLPVPMMNIVNGGSHSDAPIAFQEFMVLPVGAETFKESLRWGAEIFHNLKSILKNRGLETAVGDEGGFAPKFEGTEDAVETILEAIKAVGLEPGKDVFLGFDCASSEFFEDGVYNYAKFEGENGAKRNAEEQVDYLEELVNKYPIITIEDGMDENDWDGWKVLTDRIGDKVQLVGDDLFVTNTVKLSEGIEKGIGNSILIKVNQIGTLTETFDAIEMAQKAGYTAVVSHRSGETEDTTISDIAVATNAGQIKTGSLSRTDRIAKYNQLLRIEDELYETGKFDGLKSFYNLSK

SEQ ID NO: 49237 - protein, 347 aa, Coccidioides immitis RS
MKIIKHSTQLFPTTATGSLVGMDVRGTLEVTNAFPFPIVDIPADSHLDGAPANAAAAAPRAKSNAVYQSEMIKMLREVNIDANNVGWYTSANMGNFVNLNIIENQYFYQKELNERTVALVHDVSRSSQGALSLRAFRLSPQFMAAFKENKFTTENLQKSNLRYQDIFVELPVQIHNSHLLTSYLHQLPSPPPAENLDLPPSLAALTNDPLASSSLLTPNFDNLALSIDPFLEKNCDMLLESIETHHTENNNFQYYQRSLAREQTKIAAWQAKRKAENATRAQLKQPLLAEDEWQRLFKLPQEPSRLESMLNTRQVEQYSRQIDGFVSATTGKMFAVRGNLLPGETQV

SEQ ID NO: 49238 - protein, 382 aa, Oryza sativa Japonica Group
MAFKSTTNRSHLRLVREVEAIGGNVFASASREQMSYTYDALKCYAPEMVEVLIDSVRNPAFLEWEVKEQLQKIKSEISEVSGDPHGLLMEALHSAGYSGALAKPLMASESAVNRLDVATLEEFVSENYTAPRMVLAASGIEHDELVSVAEPLLSDLPSVKRPEEPKSVYVGGDYHCQADSTSTHIALAFEVPGGWRQEKTAMIVTVLQVLMGGGGSFSTGGPGKGMHSWLYLRVLNNYGQIESFSAFSSIYNNSGLFGIHATTNPDFVSSAVDLAARELHEVATPGKVTQEQLDRAKEATKSSVLMDLESRIVASEDIGRQVLTYGERKPIEYFLKTVEEITLNDISSTAKKIISSPLTLASWGDVIHVPSYESVRRKFHSK

SEQ ID NO: 49239 - protein, 323 aa, Aspergillus oryzae
MAAFIGANLNPCNYIGGVSFNPERDIPDLSGKVALVTGGNAGLGKETILQLAKHRPQRIYLAARSETKAQAAISSLKGSLSNNVEITWLPLDLMSIKSIQTAAQTFNAESSRLDILILNAGVMSLPPGETEMGHEIQLGTNHTGHFLLTKLLLPTLLKTAEEPNSDVRVVSLSSIGHNLAPSFETILDQDRLKKVNTNTRYGASKAANILFAAELARRYPSITSVSVHPGIILTDLYSSVSDRSALAALGSKTLGLFGTQVPQGAYNELWAAAGAKKHDLVNGSYYIPVGHLKPYNQYARSEDMGRRLWDWTESELRKFNALP

SEQ ID NO: 49240 - protein, 510 aa, Corynebacterium diphtheriae NCTC 13129
MCYRLLAAWGASILRLPPLIGFLAAGFIMSALGLEQIPFIDYIAELGVTTLLFTIGLKLNPHDIASPRVVGTATAHAVVNTIVFAGLFALFAIVGWTGLLYIGIAASFSSTVFVMSQLEVHSRSGSAVGRISIGVLVLQDIIAVGVLVVSAGTTPQLWALFLPLILCLRPLVTRMPDRMFRTELLVLTGVGIAVGAYSFFELAGVSGSLGSLVAGIVLSGHPVSQRLSHALISVRELLLVAFFIHIGLGGIPNAAGLGIAAILVAFLAVKAAVFFAILPLMGMGVRTTILAGLTLANYSEFGLIVTAVAVSHGALPDQWLPIMAIAVGASFIVGSIVSAQEEKLVRILARFVPKVSEHRKAPNERPVIVAGADAIVLGMGRVGVGVYDRLTEEYGMHVYGIEFDEDRIIELRDRGYRIVAGDVTDPELWRRIELLDIPQLFAMSLPRYTDSDKVLARIHHDYPGATVATITQTRGREQALLTAGADVAVYLYEGVGDELADQAVAHLRQG

SEQ ID NO: 49241 - protein, 406 aa, Aquifex aeolicus VF5
MSEREEFKFNTVEEAIEDIRQGKMVIVVDDPDRENEGDLVMAAEKVTPEAINFMAKYGRGLICLSLTPERCEQLDLHPMTPMNTDPKGTYFCVSIDAHPKHGTTTGISAYDRALTIKLAISPDAKPSDFVRPGHVFPLKARPGGVLERAGHTEASVDLARLAGLYPAGVICEIMKDDGTMARVPDLMEFAKKHNLKIITIADLIKYRLRRETLVEKVASAHLPTPWGVFKIHAYRHKLTGEEQVALTMGEWKEDEPVLVRVHSECLTGDVFRSFRCDCRPQLEKALEMIAKEGKGVLVYILGHEGRGIGIANKIKAYELQEKGYDTVEANEKLGYPPDLRDYGIGAQILRDLGVRKMKLMTNNPRKIVALEGFGLEVVERVPIKIEPNPYNKIYLQVKKDKLGHMF

SEQ ID NO: 49242 - protein, 312 aa, Corynebacterium diphtheriae NCTC 13129
MTRKIILDCDPGHDDAVAMLLAAANPNIELLGITTIGGNQTLPKVTHNAQVVATIAGITAPIHAGCSRPLVRDVEVAESIHGDTGMEIHNYTLPEPAVGVSDTHAVDFIIDTIMSHEPGTVTLVPTGPLTNIAMAARKEPRIVERVQEVVLMGGGYHVGNWSPVAEFNIKIDPEAAHIVFNEKWPLTMVGLDLTHQALATPEVEARLSAIGSDVADFVVALFGAFRKNYQDAQGFDNPPVHDPCAVAYVIDPTVFTTVKVPIDVELTGALTTGMTVADFRAPAPADCHTQAAVALDFDKFWGLVESAVKELS

SEQ ID NO: 49243 - protein, 433 aa, Pinus sylvestris
MAMAASTMMRSSVTAGSFRENHRPSVAVDAQIRSKITSTDGTVRLPFGSFGSNFFGSTAEFGQGSALQCQSARTLQPVRATATEAPPRVQRSSGKERTKIGINGFGRIGRLVLRVALSKEDIEVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADAPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVASRK

SEQ ID NO: 49244 - protein, 427 aa, Bacillus cereus E33L
MKICTMGLGYIGLPTSAMFAKYGTEVVGVDIHQKVVDKLNNGEIHIEEPGLGEVVKEVVENGKFRASLTPEEADAFIISVPTPNNDDEHKSCDLTYVLTATKKVLPFVKKGNVIIVESTIAPRSMDDHVKPLVEEAGFTVGEDIYLVHCPERVLPGQILHELVHNNRIVGGITPACADAGARVYGVFVQGEIIKTNAKTAEMSKLMENTFRDVNIALANELTKVCNSLDINVLDVIEMANKHPRVNLHYPGPGVGGHCLAVDPYFIVAKAPELANIIKLSRETNVSMPHYVTEKVKELLAGVENPKVAAFGVTYKGNVDDMRESPAMDVIDLIRNEGITVSAHDPHVESDFFKLHSAKEAVKDAHLILVLTDHDEFKTMNYEALAPHMAKAVVLDTRNCVQAVSTAEMKVVNFGTLYEALSENVITV

SEQ ID NO: 49245 - protein, 506 aa, Pseudomonas aeruginosa UCBPP-PA14
MRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 49246 - protein, 441 aa, Bifidobacterium longum NCC2705
MTKHRIQSVDECGVLFRNACNMQSGKIGHFDVRFVKERIFMKTLKDLGDLKGKRVLVRADFNVPLDGTTITDDGRIKAALPTIKTLREEGAKVILMAHLGRPKGKVVPELSLAPVAARLGELLGANVPLAKDTYGEDAQAKVAAMNDGDVVLLENVRFNPEETSKDADERAAYAKKIAALGEAFVSDGFGVVHRAQGSNYDVAADLPAAAGLLVEKEVKALSKATENPERPFTVVLGGSKVSDKLGVIENLLDKANRLVIGGGMVFTFLKAKGYEVGTSLLEEDQLEKVKGYIETAEKNGVELVLPTDVVVNAGFPAGDTPVAPEVVAADAIPADKMGLDIGPESQKLFHDKIVDSKTVVWNGPMGVFEVPEFAAGTKAVAQGLVDATAVGAFTIVGGGDSASAVRNLGFPEDGFSHISTGGGASLEFLEGKELPGLKVLE

SEQ ID NO: 49247 - protein, 442 aa, Chlamydophila caviae GPIC
MDELTTDFDTLMSQLNDVHLTTVVGRITEVVGMLIKAVVPNVRVGEVCLVKRQGMEPLVTEVVGFTQSFAFLSPLGELSGVSPSSEVIPTGLPLYIRAGNGLLGRVLNGLGEPIDTELKGPLVDVNETYPVFRAPPDPLHREKLRTILSTGVRCIDGMLTVARGQRIGIFAGAGVGKSSLLGMIARNAEEADVNVIALIGERGREVREFIEGDLGEEGMKRSVIVVSTSDQSSQLRLNAAYVGTAIAEYFRDQGKTVVLMMDSVTRFARALREVGLAAGEPPARAGYTPSVFSTLPRLLERSGASDKGTITAFYTVLVAGDDMNEPVADEVKSILDGHIVLSNALAQAYHYPAIDVLASISRLLTAIVPEEQRRIIGKAREVLAKYKANEMLIRIGEYRRGSDREVDFAIDHIDKLNRFLKQDIHEKTNYEEAAQQLRAIFR

SEQ ID NO: 49248 - protein, 182 aa, Kluyveromyces lactis NRRL Y-1140
MSKENQNVVLVSVEGERFVVDRKIAERSLLLKNYLQDLNSGDLHDDNDADDDEDDEEDGDDEIVMPVPNVRSSVLQKVIEWAVHHKDSNFPDEDDDDSRKAAPVDPWDREFLKVDQEMLYEIILAANYLNIKPLLDAGCKVVAEMIRGRTPEEIRRTFNIVNDFTPEEEAAIRRENEWAEDR

SEQ ID NO: 49249 - protein, 668 aa, delta proteobacterium MLMS-1
MSTPADQPRLAEENPTTANPWPPCRNACPVHADVRTYVDHIAREEFAQALAVIRRRLPLAAICGRICDHPCEANCRRRDVDQAVAIRELKRFVAECPENDDVPVTAGPGDRQQVAIIGAGPAGLSAALELARRGFRPTIFEKEKVAGGIPGVAIPTYRLPRQALKRDIDWILAHGIELQSGVEVGVDTTINKLKKQGFAAVIIAVGMSQSRILPLPGTDAPGIHGALDFLRAAAAGRELELGREVLVIGGGNVACDTARTAVRLGCDKVRMICLESEEEMPALPEEITESRDEGIEIITRRGPLEVVLEDGKISGLRHRLVTRVFDEEGRFAPEFDDNDLALTPCQSIIFAIGQAVEPGFIKGSKLTMDERGRLVHDPATRQTALPWVFAAGEAVSPPGTVVRACADGRRVAQGVEQFLQDETIQITTEAPAVIDRLPPERAAKVSKTARAEPEIRPAAQRQRDFQPFIGTLPHQQTVTEARRCLECGNGATVQNDYCVKCLNCVRLCPYDAPRIDRTARVPAEHCLACGLCYGACPTGAIRLQNNSPEQLAASSQRLLAELDGKQPRTIAYICDRPATKIGPWREQTGASEAAAIHLPNAGLLEAGQLLQTLEAGAERILVILPATDDEYHKGTGHRLRRRIQRLQADLAALGLDPNRIQLWPEASE

SEQ ID NO: 49250 - protein, 138 aa, Arabidopsis thaliana
MLSSAAVVTSLGQATMVAPFTGLKLYGAFPDTRKTHKDVTYIARNGGRDICVNVWPPIAKKKFETLSYLPDLSDVELAKEGDYLLRNKWFPCVEFELEHGSVPREHGNAPGLYYGRYWTMGKLPLFGCTDSSHVLKEL

SEQ ID NO: 49251 - protein, 481 aa, Aspergillus oryzae
MAKSKAAKRKRNAQVELPQKVPKAAPTLTPPPDGEPKHLKTVVPDEDLEITIDTLTTLAQYPALTKSKACKDLRAAVYDFRQACTTGVNAAEGANLTARITGALADEKYIDAKILLAEMRIRGEQPKIGALCRWVRDLDVVSGLSTQPDAIDRVPLERSAKELELLRVLDAILRVSTPIDTNPDAVDSTSPIAFQSIWDLRPSSAPLPVYASVLDKSILADAPKSPSALRVIETTPGPLRKPPNHHPAILYTSAPNAVPLAPVGPTITYHPHPAVPGLGLALNVLSPAECKAIIAAGESVNFLPDAPLREDGDMSILAHNFYWVVDTTFHDMLWARISSYVPQSINGRLARGINRRFRVYRYVPGAEYRCHIDGAWPPSGILPDDTYVYDASPEDKRQSSMYTFLLYLNDEFEGGETTFFMPAAREGTLNAYPVRPVMGAVAIFPHGEANGALLHEGTGVRKGAKYIIRTDVEYDVKPCEE

SEQ ID NO: 49252 - protein, 126 aa, Leifsonia xyli subsp. xyli str. CTCB07
MTRTDRPADSLLLTGLRVRANHGVYGFERENGQDFVVDVTAWLDLASPAASDDLRQTVHYGELAVEIAEAVKRNPVDLIETVAERVAGVVLAHSPVCSVEVTVHKPDAPIDVPFGDVAVRIVRERR

SEQ ID NO: 49253 - protein, 223 aa, Campylobacter jejuni RM1221
MIFAANLKCNHTRASFKIYAEILNKTMGAKCDDIIVFPPSVAFLENENNFIQGAQNFYPCVNGAFTGELGKEHLDEFGIKCVLIGHSERRALGDEEFIKAKFDFAKEHGYKIVFCIGENLDTKNSGKTLEFLKKQLEIIDLNYEKLIIAYEPIYSIGTGVSAQSTDIAKVLEFLASLTKVPLLYGGSVNENNIKEILSVNHCGGVLIGSAALKVENFIKLIKG

SEQ ID NO: 49254 - protein, 433 aa, Pinus sylvestris
MAMAASTMMRSSVTAGSFRENHRPSVAVDAQIRSKITSTDGTVRLPFGSFGSNFFGSTAEFGQGSALQCQSARTLQPVRATATEAPPRVQRSSGKERTKIGINGFGRIGRLVLRVALSKEDIQVVAINDPFIDAKYMAYMFKYDSTHGVYKGSLKIVDDTTLEIDGHRITVNSKRDPSEIPWGNYGAEYVVESSGAFTTTEKASAHLKGGAKKVVISAPSADAPMFVVGVNEGSYKPEMSIVSNASCTTNCLAPLAKVVNEEFGIAEALMTTVHATTATQKTVDGPSMKDWRGGRGAGQNIIPSSTGAAKAVGKVLPELNGKLTGMAFRVPTPNVSVVDLTCRLEKPASYDDIKAAMKAASEGSLKGILGYTDEDVVSNDFVGDARSSIFDAKAGIALSSTFVKLVSWYDNEWGYSNRVVDLISHMALVGSRK

SEQ ID NO: 49255 - protein, 233 aa, Listeria monocytogenes EGD-e
MTKEKVLWGYDEKTGPEMWGHICSDFEIAHTGKAQSPVDIEQADVVKLKPSTMKFYYKETDYTIRRIEQSVHVFPHDKEQGLRFNGEYYPLVSFHAHIPAEHLLDGYIYPIEWHFVHEKPDGTTLVMSAWMDIDNTNNIEFKNLPTYFPEVFADFETEREITLDVNEFMPEERVFYTYQGSRTTPPTVEGVTWIVLKNAKTLGQEDFTEFEKAIGNTSRPVQDLNGREITFYN

SEQ ID NO: 49256 - protein, 400 aa, Campylobacter jejuni RM1221
MSDIISIKDIDLAKKKVFIRCDFNVPQDDFLNITDDRRIRSAIPTIRYCLDNGCSVILASHLGRPKEISSKYSLEPVAKRLARLLDKEIIMAKDVIGEDAKTKAMNLKAGEILLLENLRFEKGETKNDENLAKELASMVQVYINDAFGVCHRAHSSVEAITKFFDEKHKGAGFLLQKEIDFASNLIKHPARPFIAVVGGSKVSGKLQALTNLLPKVDKLIIGGGMAFTFLKALGYDIGNSLLEEELLEEANKILTKGKNLGVKIYLPVDVVAAPTCSQDAPMKFVPVQEIPNGWMGLDIGPASVRLFKEVISDAQTIWWNGPMGVFEIDKFSKGSIKMSHYISEGHATSVVGGGDTADVVARAGDADEMTFISTGGGASLELIEGKELPGVKALRSKENE

SEQ ID NO: 49257 - protein, 461 aa, Bradyrhizobium sp. ORS278
MAEFDVDLFVIGGGSGGVRAARIAAGYGARVMVAEEYRMGGTCVIRGCVPKKLFVIGSHVRQEIADAAGFGWTIPTATFDWSTLIANKDKEIARLEAAYAANVEKSGARIVKTRAVLEDAHTVRLANGETVRAKYILIATGGAPNHGTPIPGIEHVISSNEAFHLDELPRRIVIQGGGYIALEFACIFANFGSDVTVVYRGDNILRGFDEDVRKHVRSEMEKEGITILTGCTVASVDKHGKDYTTHLSNGSSIASDKVMFAIGRHPAVANLGLEKAGVAINPRNGGIAVDAFSQSSVPSIYAIGDVTHRFNLTPVAIREGHAFADTVFGGKTVRVDHADIPTAVFCQPEVGTVGLTETQARELHDRVDIYKSTFRPIKATMSGRDTRVLMKLVVDGASDRVLGCHIVGDTAAEITQAVAIAIKMKATKADFDATIALHPSAAEELVTMRTVTERHVRQAAE

SEQ ID NO: 49258 - protein, 247 aa, Aquifex aeolicus VF5
MRRLIAANWKMNKTVKETEEYINTFLKFVEHPESREILICPPFTSLYVAGKMLQGTGVKLGAQNCHYEKRGAFTGEISIPMLQEVGCEYVIVGHSERRHIFGESDELIHKKIVACLEMGIRPILCVGEKKEEREAGMTFKVIETQIKLALTGVEEHTDKIDIAYEPVWAIGTGTPATPEDAVEVHTFIRNLINQLNPKNEGKTRILYGGSVNPQNAKEFMKHEEINGLLVGTASLDPESFAKIVYSF

SEQ ID NO: 49259 - protein, 230 aa, Bradyrhizobium sp. ORS278
MDALKRQAAARALEEVESGMKLGLGTGSTAKHFVDLLGEKVRAGLKVVGVPTSEATRAQAEACGVPLTTLDEIDRLDITIDGADEINPALDLIKGGGGALLREKIVASASNRMIVIADDSKWVARLGRFPLPIEVVPFGIAATQREIADAFTKAGVAGPMSLRKSADGHVFVTDGGHWIVDVRLGEIEDPPRLASFLSAIPGVVEHGLFIGLGSTAILAGAQGIRVIQRP

SEQ ID NO: 49260 - protein, 200 aa, Prochlorococcus marinus str. MIT 9313
MTTNECLRVGQQAPDFNATAVVDQEFKEISLSQYRGKYVVLFFYPLDFTFVCPTEITAFSDRYTDFSSRNTEVLGVSVDSQFSHLAWIQTSRKEGGLGDINYPLIADLKKEISTAYNVLDDEAGVALRGLFIIDPDGVIMHSTINNLPVGRNVDETLRVLQAFQYVQSHPDEVCPANWTPGEKTMKPDPVGSKEFFASIN

SEQ ID NO: 49261 - protein, 475 aa, Vitis vinifera
MSHGDHASHKKTIDLVKEYNAQFEDKVIAIMLDTKGPEVRSGDVPKPIMLKEGQEFNFTIKRGVSSENTVSVNYDDFVNDVEVGDILLVDGGMMSLVVKSKSKDLVKCQVIDGGELKSRRHLNVRGKSATLPSITDKDWEDIKFGVDNQVDFYAVSFWEKNYHMMHESCVEKARILLKVIEGLTIRILKSYQILVVKMILEESEGLVHPKPYLQSVVQPYVITKMTLCIKVNLTLLTCANMAMVARGDLGAELPIEEVPLLQEDIIRRCHSMQKPVIVATNMLESMINHPTPTRAEVSDIAIAVREGADAVMLSGETAHGKYPLKAVKVMHTVALRTESSLSTSTTPPSQTIPYKAIIWVQCLLSMPPLWLTLLILPSLTGSMAITLSHYRPSSTIFAFTNEERVKQRLVLYHGVMPIFMQFSDDAEETFSRALSILVNKGLMKEGEHVTLVQSGAQPIWRVESTHHIQVRKVQG

SEQ ID NO: 49262 - protein, 952 aa, Thermococcus kodakarensis KOD1
MMVKIILNGKETEVPDGKPLIEFLREITHVPGFCYTEELDPYGSCRLCLVSTPRGVTTSCTLKPMEGLSVETLTDEVVSMRKTALELILSDHYGDCIGPCQDGCPAHSDVQGYLALIAMGKYHEAVKLMKEKYILPAVLGRVCPAFCEEACRRNLVDEPLAIRQLKRFAADYDLEHGPWIPEIPPSTGKRIAVVGGGPAGLACAYYLRTMGHEVTIFEAMPELGGMMRYGIPPYRLPRDVLDKDIATVIETGIEVKTNTALGRDVTLDELMEKYDAVFLGVGAWKSRRMGIPGEELEGVMHGIEFLRMVNTGEEVKLGERVIVVGGGNTAMDVARTALRLGAKVTVVYRRSKAEMPANEREVEEAIEEGIEFLFLTNPVRILGDGKVEEVELIKMRLGEPDASGRRRPIPIEGSEFRVKADNVILAIGQYCDEEFLRSLGIEAKRGKAIVDDVTLQTNLPGVFAGGDLVLGPSTVIESIATGRRAAIMIDLYLKGKLEKAREVLLEPEKHIEEVLNDEDLYRVLFDLRPYNHWKKATEKDYEHVERRPRAKVELLDPEVRKQNFEEVEPPLTEEQVLEEAKRCMSCGCMEVFRCKLREYATLYNARQDAFEGEGNRFELDESHPFVTLDNNKCVLCGQCVRFTHEVAGEGVVDYMFRGFKTMISPPLGDTLGDAEGLFIGEMTDLCPVGAITEKLPFLKPGPWKTTPVKTVCNGCSFACEMNIEVYDGMLVRASRVEEGWNGHLCDVCRFMRPWAEDLAGPLLNGEPVSWEEARRFIAERDYALILTPELTNEEIAFFKEFAEKRGIPIGSTVEGGLSTATFEDIRKAKRVLLKADPEKYPLLKLLLKDKDVVEEDYEVAILEGPAEPLEAPTLILHEGVNAAGLIRAGIVGIPESKAYVVIGRAERELDGDVLVLPAGLWAAKEGTITNAFGMELEVKKVVEGYSPLELFS

SEQ ID NO: 49263 - protein, 175 aa, Actinobacillus pleuropneumoniae serovar 1 str. 4074
MGLENVPAGKELPDDIYVVIEIPANADPIKYEVDKETGTLFVDRFMSTAMFYPANYGYVNHTLSSDGDPVDVLVPTPYPLQPGSVIRCRPVGVLKMTDEAGGDAKVVAVPHTKLSKEYDHIKDVNDLPALLKAQIQHFFESYKALEAGKWVKVEGWGDVNEARQEILESFERAKK

SEQ ID NO: 49264 - protein, 375 aa, Xanthomonas campestris pv. campestris str. ATCC 33913
MTQPAILVLEDGTVFEGESVGANGLSVGEVVFNTAMTGYQEVLTDPSYARQMVTLTYPHIGNTGFNDQDDEAKQVWAAGLIVRDVPRRPSSWRNQVALPAWLQTRGVVAISGIDTRKLTRLLREKGAQNGALMAGEIDVEKALEAARKFPGLKGMDLAKVVSTETTYQWQEGQLDLNANAFVQAELKFKVVAYDYGVKINILRMLAERGCDVTVVPARTPVAEVLAMQPDGVFLSNGPGDPEPCDYAISAIQELIAKKVPTFGICLGHQLLALAAGAKTVKMATGHHGANHPVQDLDGGRVMITSQNHGFAVDETTLPANVRVTHRSLFDGTNQGIALTDAPAFSFQGHPEASPGPRDVGPLFDRFVASMAEAKS

SEQ ID NO: 49265 - protein, 330 aa, Rhodococcus sp. RHA1
MVVSPLGRIGRALLAFALVVVIGTVGYIDLGFGILDALYQTVTTITTVGFREVHPLTGIGQLFTIMLILAGVGTALYMFGVLLEALIEGHLRHHMERRRMDRRISRMTGHIIICGWGRVGTASAQYLDSLGREIVVVDRDPERLRDLDHPTVIGDVTDDRILEAAGIAHAHALISALDTDADNVYVTLSSRALRPDLTIIARARNEGSMSKLLRAGANRVVNPQLIGGRRMGSFALQPHVAEFFDVVMHDESLDYRMEEIILSPTSPWAGSTLAQIGVQQASGALLLAIRTVAGQFIANPVPSLRVEPGTILIALGTPDELDAARHHVNP

SEQ ID NO: 49266 - protein, 177 aa, Thermosynechococcus elongatus BP-1
MVITAPSAFWPPVASDRAAFIAPNATLVGDVRLGEGCSIWYGAVLRGDVTYIEIGAHTNVQDGAILHGDPGQPTILGEEVTVGHRAVIHGATVEDGCLIGIGAVVLNGVRVGAGSIVGAGAVVSKDVPPRSLVLGIPAKVVREVSDTEAADLRQHARKYEQLAQVHKGTGRNLGFSA

SEQ ID NO: 49267 - protein, 250 aa, Solanum lycopersicum
MPINQITIGSHEELRHPGALKAALAEFISTLIFVFAGQGSGMAFNKLTDGVATPAGLISASIAHAFGLFVAVSVGANISGGHVNPAVTFGAFVGGNITLFRGILYIIAQLLGSTAACALLEFATGGMSTGSFALSAGVSVWNAFVFEIVMTFGLVYTVYATAVDPKKGDLGVIAPIAIGFIVGANILAGGAFTGASMNPAVSFGPSLVSWTWTHQWVYWAGPLIGGGLAGFIYEFIFISHTHEQIPSGDF

SEQ ID NO: 49268 - protein, 468 aa, Staphylococcus xylosus
MVVGDFPIETDTIVIGAGPGGYVAAIRAAQLGQKVTIVEKGELGGVCLNVGCIPSKALLHASHRYDETKNSENLGVIAESVSLKFDKVQEFKQSVVKKLTGGVEGLLKGNKVEIVKGEAYFVDNNSLRVMDEKSAQTYNFKNAIIATGSRPIEIPNFKFGNRVIDSTGALNLQDVPGKLVVVGGGYIGSELGTAFANFGSEVTILEGAKDILGGFEKQMTQPVKKGMKEKGVEIVTEAMAKSAEETENGVKVTYEVKGEEQTIDADYVLVTVGRRPNTDELGLEELGLKFADRGLLEVDKQSRTSAENIFAIGDIVPGLPLAHKASYEAKVAAEVIAGEASEVDYIGMPAVCFTEPELATVGYTEAQAKEEGLAVTASKFPYAANGRALSLDDTTGFVKLLTLKEDNTLVGAQVVGTGASDIISELGLAIEAGMNAEDLSLTIHAHPTLGEMSMEAAEKALGLPIHTM

SEQ ID NO: 49269 - protein, 306 aa, Vitis vinifera
MDHHDFQAQKREMKHKGRNVVWSMAMDKCLIEALVIQAKNGNKIDKCFNENAYTAACIAVNSRFNLNLNNQKVVNRLKTIKKRYKIMRDMLTQNGFTWNPNTKMIECDNDDLWKRYIAAHPDARGFRGKQIDMYDELKIVCGNYQAPSRWARMTDGSQPTAIKNCEDDSASYLSPSSEDLSETDGTESYTGQQEYAQMPDGSGDPPLIQPLSQIPKRARGSEAIQDAMLAVATSIRRLADALERRKNSVDSSELLQAVMEIDGLEEARQMYAFEYLNADPIKARAFMTYNVRMRKIFLFRQFWWWK

SEQ ID NO: 49270 - protein, 242 aa, Oryza sativa Japonica Group
MCTLEQRGRVFVLTLTGDGEHRLGHSLIGSIRAAVSSVAAAAAAAGPGAALVTVAEGRFFSNGLDIGPGGIPPSRVGELVVALRPLAADLLALPMPTVAAVTGHASAGGFLLTLCHDYRLMRADRGVLYMSEIDIGLPLPPYFVAILRAKITAAHALRDVTLRGRKLKAAEAKEMGIVDVVCPTAAETAAEAVKLAEQLAARKWNGNVYSSIRISMFPEACRSVGIVEESDEEKRNHFASKL

SEQ ID NO: 49271 - protein, 588 aa, Geobacter sulfurreducens PCA
MGSARSETRVFSGIGASPGIAIGTARVTDRSRVMVVEASVPPEDIPGEVVRFTAALSRSRDDLLALKESIAARRGAEHLYVVDAHLLILDDSMLRQGTIDLIERDGVNAEAALKKNLDKFKEFFAGIDDDYLRERFGDVETVVERILRHMVGKRHERIDAIDEGKRLIVAHDLSPTDILQMDKEKVVGFVTDLGGKTSHTSILARAFEIPAVVGLETITVEDIDGLPIIIDGTTGTIVVNPSEETFRDYLRRKQHYDYLEQELLKLKDLPAVTLDGHSMRLMGNIEFPEEIPSLKGHGGQGVGLYRTEMLYMNRPGLPDEEEQYRAYATIVENVAPEPVTIRTLDIGGDKLATDLHLEDEMNPAMGLRAIRLSLRRPEVFKSQLRAILRAGCKGSVRLFFPMISGIEEVRSAKAVLRECMEELRSAGIPFDEKIETGIMIEVPSAVTIADLLAREVDFFSVGTNDLIQYSLAIDRTNEHLAHLYQPLHPAILRSLKTVADAAHAAGIRVCMCGEMAGEPLYLPILLGLGFDELSMTAVSIPRVKKILRRARRSDAERLVARALTFATAAEVESFVKSEISARFSESFD

SEQ ID NO: 49272 - protein, 195 aa, Oryza sativa Japonica Group
MPPHEDTLDAGGGDVLTFRLHPLAVLKLSDRIREFQYQAAAAARVSYSSSSSSSSGTAAPEDPPPPPTRMSGCVIGVRRGGTVDVSDILDILILHGPDPATFDRALLEKDQEIYKKAFPDLSVLGWYSIGTNVHATDMGIHHGDYTDMQIHQTEKHRNDRLIEIQEKRRNWMREIDSKESYQEVETLAKFSPKSL

SEQ ID NO: 49273 - protein, 332 aa, Campylobacter jejuni RM1221
MAVKVAINGFGRIGRCVARIILERNDIELVAINDTTDIELTKYLFKYDTVHGEFKGSVDSEGDDLVVNDKKIKVFKSRNVKDLDFAKHGAQIVLECTGAHLTMAKSQEFIDMGVQKVIMSAPAKDDTPTYVLGVNSELYKGESIISNASCTTNCLGPVCRVLQDNFGIEKGLMTTIHAYTNGQSIIDAKAKDKRRSRAAAQNIIPTSTGAAKAMKLVMPELNGKLHGQSMRVPVIDVSSVDLTAQLSRKVSKDEINEAFRKAAATNLKGILMVDDDERVSSDFITCSYGAIVVSDLTQVIADDFIKVIAWYDNEWGYSSRLVDMAVYIANKA

SEQ ID NO: 49274 - protein, 400 aa, Leptospirillum ferrooxidans
MVFWGPENRQVVRNRIFERTGMEDRPVYLDYNATTPVDPEVVDAMMPWFRERFGNPSSGHFFGWEAQEQVEAARTEMAVLIGAKADEIVFTGSATEANNLAILGSTRAMRGEKRSLVTSVVEHPSVLQPFLRRKEEGWRLILLPVDSFGRVDLREAESIIGKDTALVSVMLANNETGTIQPVREIAGIAHSCGALFHVDAAQAIGKIPVDVEALGADLLTLAGHKFYAPKGIGVLYVREGTSLSPLMSGAGHERGLRPGTENVPYIAALGTAARLVRENLREESARIQRLRERLHGTLSAAIDGLRLNGPSNDRLPNTLNLSFPHVKGWELLAAVPGIAASTGSACHWGIHKASPVLLAMQRDETRALGAVRLSLGRFTDEAEVDFAASALISTWHRLSS

SEQ ID NO: 49275 - protein, 415 aa, Zea mays
MESSAKKLSSLRITSLDDETEETEDPHQPPPAGPSAAAADSDDDDEEEEVEVTLGVLSKPKHPGLLLRHLFPSKAGGIPAWLDPVNLPSEKSSCCGFCGEPLQFVLQIYAAVEDNVAAFHRTLFMFMCPSMACLLRDQHEQWKHKHGNPCRSVKVFRCQLPRTNAFYSVQPPKHDRSDKPLCPGAHVCHWCGTWKGDKICSSCKKARYCSEKHQALHWRTGHKNDCLQIISSSAASNSVLPTVGKVPANTSWPEFEIKIDYEGRFDCDSGDENNSKLLVMQRHGKPDAMMQSWMDQFEADSDNKCWASFQERVSRAPNQVLRYCREPNAKPLWALSSGCPSNADIPSCSYCKGPLCYEFQVMPQLLYFFGVGNQPDSLDWATIAVYTCQGACDQSVSYKEEFAWVQLYPTTTTRQ

SEQ ID NO: 49276 - protein, 85 aa, Vitis vinifera
MGSLGAILTYPGDIYPLLKLKMADCHAKKQLPPEPRWVFCYTLLHKASRDFSLVVQQLGTRFCNAIYIYIYIFFFLFGPSSIPRS

SEQ ID NO: 49277 - protein, 163 aa, Leifsonia xyli subsp. xyli str. CTCB07
MTAYDVVIEIPKGSRNKYEVDHETGRVYLDRVLFTAFVYPADYGFFENTLGDDGDPLDVLVLLEYPVFPGVGIKVRPVGVLKMSDEAGGDAKIIAVQHKDPRWQHIQDVNDIPEYTRKEIEHFFARYKDLEPGKFVTIEGWGDAAEAEKIVQAGFANLEAQGH

SEQ ID NO: 49278 - protein, 79 aa, Bacillus thuringiensis serovar kurstaki
RRMKGGVLFHDSADKAAKFINLCDAYHIPLLFLADVPGFMLGTKVERAGIIRHGAKMISAMGEATVPKISIVVRKAYAV

SEQ ID NO: 49279 - protein, 381 aa, Bifidobacterium longum NCC2705
MADYYETLGVERGASDDEIKKAYRKLSRKYHPDIAGPEFEDKFKEVNNAYDVLSNPDKRRMYDSGVDPNNPNAGAGGFSGAGFGDMSDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRTVGVTVPAGINDNARLRLANQGEVGEGGGAAGDLYIDIRIKADKQFTRDGDDLHCWIQVPMSWAVLGHDLSIDTFDGEKTVSIPAGCQTEDTVTLKGLGVTNIRNKDERGNLIAHVNVLIPTKLNETERGLIEQFAASHDSGATHVSQASRPQAGQKKGFFSKLKDALS

SEQ ID NO: 49280 - protein, 490 aa, Blastopirellula marina DSM 3645
MSAARLLPQRARTKIVATVGPACNTPEMLEQMILAGVDVFRLNLAHGELDEHSRVATTIREISERLKRPVATLADLSGPKIRLGTLVQDPIYCVEEQMYRFIRGDVATEPNELVSNYEPLIDEVKVGDNVMLADGTITMEVVEKTEDSVTCVVVAGGILRSRQGINLPGTKLGVETITPRDRDHIRWAAETDLDYVSLSFVREADDIRQLKDLLQAHESRAMVIAKIEKREALDNLEEIVEVSNGVMVARGDLGVEIDVAEVAAAQKLIVKTCTRIGRPVIVATQMLDSMTKNSRPTRAEATDVANAILDGADACMLSQETAVGEHPIVVIKMMNRIMLATEKMLCEDLSNAIRGEEIGLVHPVTQAVVSGATRTADLLNAKLMVMATRTGGTALTKAKIRDCIATIGVSDSKAALRRMSLYWGIIPIDGAPVHNGIQLRRFVDKWGFEAGLLKPNDRVVFVTGGGIMQSAEYIVVVHKVEAPEGYGVTE

SEQ ID NO: 49281 - protein, 276 aa, Desulfitobacterium hafniense DCB-2
MGRSMVKNLLKDGYSVAVYNRTKSSAEELFALGVQWVDSVAGLARLSDVVITMVGYPKDVEEVYLSEEGLIPNAKPGSVLIDMTTSSPLLAQRIALAGKAGGIDVLDAPVSGGDVGAQNGTLVIMVGGEEGVFDKVKPIFEAMGKNIILQGPAGAGQYTKMANQITVAGGMIGVCEAIAYAQKAGLDPSRVLDSIAGGAAGSWSLSNLGPRMIAGNFEPGFYVKHFIKDMNIALESAKEMGLMTPGLELAKSLYEQLAAEGEENSGTHALYKLYMK

SEQ ID NO: 49282 - protein, 124 aa, Prochlorococcus marinus str. MIT 9313
MSDAWTKWQCIQNCGACCRLDPTDRGEAIAVLNERQQEIYFGMVNPDGWCKHYDTGGRRCRIYDSRPDFCRVGLLASLFNLPQDKSESFAIHCCHQQIRSVYGGRSRELRAFERSLRLPLQKDG

SEQ ID NO: 49283 - protein, 80 aa, delta proteobacterium MLMS-1
GRQLDSPGLADLLERWQQQGKSRLSFVLGGHLGLDSAVLERAELVLALSRLTFTHEMARLLLLEQLYRAWTIQQGGNYHK

SEQ ID NO: 49284 - protein, 274 aa, Listeria monocytogenes EGD-e
MNLKDTVKLANGVEMPRLGFGVWKVQDGDEAVNSVKWAIEAGYISIDTAAAYKNEEGVGQAIKESGIKREDLFVTTKLWNAEQGYESTLAAFDESLRKLELDYVDLYLIHWPVKGKFKDTWRAFEKLYKDKRVRAIGVCNFHEHHLKELMEDAEIAPMVNQIELHPQLTQEPLRKFCAENNIVVEAWSPLGNGKLLSNPEIKAIADAHGKSVAQVILRWDLQIGVVTIPKSVHQERIIQNADIFDFELTEEEVAKISGLNKDERTGPDPDNFNF

SEQ ID NO: 49285 - protein, 522 aa, Thermococcus kodakarensis KOD1
MSMEEKLNELYERKKKILEMGGEKAIEKQHAKGKLTARERIEKLLDPGSFVEIGMFVKHRGTEFGLDKKELPADGVITGYGTIDGRLVFVYAQDFTVMGGSLGEMHAAKIKRIMELALEAGAPVIGLNDSGGARIQEGVDSLKGYGEIFKMNTLLSGVVPQITAIMGPCAGGAVYSPAIGDFILMVDSDSSFMFITGPQVVKAVTGVEVTPVQLGGAMIHAQKSGQAHLIGKSDEEVLALIRRLLSYLPSNNMEKPPRVKTNDLPFRKTENLYNIVPDDPNKGYDVRQVIYEIVDRDENGNPDFLEILPYFAPNAVVGFGRMNGQTVGIVANNPIYFAGVLDIDSSDKIARFVRTCDAFNIPIVTLVDVPGYLPGTDQEYRGIIRHGAKVLYAYAEATVPMVTVILRKAYGGAYLAMGSKHLGADFVFAWPTAEIAVMGPEGAANIIFRKEIAAAENPEEVRQQKIQEYREKFANPYVAAARGYIDDVIDPAETRAKIILALEAMESKRVKLPPKKHGNIPL

SEQ ID NO: 49286 - protein, 246 aa, Thermosynechococcus elongatus BP-1
MLSTLKADFQIIFERDPAARNWLEVVFCYPGLQAIVLHRLSHWLWRRGIPFIPRFISHIARLLTGIEIHPGATIGKGVFIDHGMGVVIGETAVVGNYCLIYQGVTLGGTGKETGKRHPTLGENVVVGAGAKVLGNLTIGDNVRIGAGSVVLRDVPSDCTVVGIPGRIVYRAGAKIAPLEHGQLPDSEAEAIRYLLDRIELLEQQVQTLQQQKKVPALVQGHLQPSQGQACRLSDRPIEEFLNGAGI

SEQ ID NO: 49287 - protein, 323 aa, Thermosynechococcus elongatus BP-1
MTPAIAFGVPSVFAAIVLLRFIGIHKGMTISTQLLQRADLIGTQVITRDTGRKLGVINQVWVDTDQRQVVALGVRNTLFTGEQRYILLDSIRQIGDVILVEHDDDVIEALNTYNYSTLIDSEIVTETGELLGKVRGFKFDPDTGDITDLILASIGLPWIPAQLISTYELPIEEIVSTGPDRIIVFEGAETRLRQLTVGLLERIGLGAPPWESDEDEYYQPVTPSSNQLPSGARSPVYPPQRSRSDYEVDWETAPRRRRRQPEYVEYEEEEYEYEERPRPRQVKPPAQAMPVELPESEPSADPWEEQQPIRLEQRQKQEEYDHE

SEQ ID NO: 49288 - protein, 323 aa, Vitis vinifera
MDELMSGNSTIPNQKMKASAKKTLDPITNVYIWDMDETLILLKSLLNGTYAETFNGLKDVQKGVEIGKMWEKYILQVADDIFFYEQIENYNKPFLDALSQYDDGKDLSDYDFNHDGCSSPYDDLNKRKLAYRHRVIAHKYKQGLHNTFDQDMIKLWDDLYDMTDSYTDKWLSSARAFLEQCSDENKDSTPLAPANGVVDSIDAKSQNVNVLVTSGSLIPSLVKCLLFRLDNLITHGNVYSSWEVGKLQCFSWIKERFSGPNVRFCVIGDGWEECEAAQTMRWPFVKIDLRPGSSHRFPGLTLRTVGHYFSIVYGIPDAENDDE

SEQ ID NO: 49289 - protein, 362 aa, Burkholderia sp. 383
MATPQFHPLRIRDVRPETADAVTVSFDVPPELRDAYRFTQGQFVTLKTHIDGEETRRSYSICVGTTDYDRDGELRIGIKRVRGGRFSNFAFDSLQPGHTIDVMTPDGRFFTHLNADHGKQYVAFSGGSGITPVLAIVKTTLELEPRSTFTLIYGNRSVDAIMFAEELEDLKNRYMNRFVLYHVLSDDQQDVELFNGVLDQTKCAEFLGTLTPADAIDEAFICGPAPMMDAAEAALKAAGVPQAKVHVERFGTPLPQAGAPVVEITDQTPAADLEIVLDGKKRKLRLPYEGVSLLDVGLRAGLALPYACKGGVCCTCRAKVLEGEVRMEKNYTLEEHEVKDGFVLTCQCHPISDKVVVSYDER

SEQ ID NO: 49290 - protein, 320 aa, Zea mays
MAYTVTRSYTDQVRPFCQYAATQRFLPTLTPSGQRPRTPSVPPRSPPVTNAHRASSLVAATGRPSLPPYARSKSKSRSRSRSRSRSRSRSPRRRDRLRSERAPHRSRSRSRSPYRRRERRGHRDFACKNCRRPGHFAKECPSAPMCNNCNLPGHFAAECTLQTVCWNCKESGHIASECKNEALCHACNKTGHLARDCPTSGANVKLCNKCFKSGHIAVDCTNERACNNCRQPGHIARECKNDPVCNLCNVSGHVARVCPKTTLASVIQGGPFRDILCRICGQPGHISRNCMATIICDTCGGRGHMSYECPSARIFGLRRL

SEQ ID NO: 49291 - protein, 272 aa, Oryza sativa
  misc_feature (173)..(173): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVXGATVNVAKPKKGQSVAIYGLGAVGLAAMEGARLSGASRIIGVELNPGKFEQAKKYGCTDFVNPRSREDSARGDDGHAKGGLDEAVNAGSIKRDIGTMFI

SEQ ID NO: 49292 - protein, 126 aa, Solanum lycopersicum
MASSSIACVQFSVKKSLVIPSTIVGTKSPVTHKNKKQRSLKVVAAIGDVSSDGTVYLIAGAAAVALVGTAFPILFSRKDLCPECDGAGFVRKGGAAALKANAARKDEVQIVCANCNGLGKLNQVDK

SEQ ID NO: 49293 - protein, 280 aa, Vitis vinifera
MLAVQKAIQICPLSSSFIRRIAMMETLDFLYPSSSFITTMSMINILGLSFFGFLEMMGINLQYSKLWNPNSKRIKVSSRTGMLLLYTPAFLVGFASFWIFPEKGFRPLLVTTALTIHFFKRVLEVLFVHKYSGGMVLDSIILISSGYSTTTATMIHAQHIAQGFMEPAIDLKCPGILLFSVGICGNFYHHYLLSKLRGKGEKGYKIPKGGLFHQVICPHYLFEILEFVGVFFISQTLYSLSFTISTTLYLIGRSYATRKWYISKFENFPRETKALIPYIF

SEQ ID NO: 49294 - protein, 328 aa, Staphylococcus xylosus
MSLLDVLQEKLSGKNVKIVLPEGEDERVLTAATQLQGTDYVTPVVLGNEANVKALANDKGLDIANLEIIDPETSELKQELVTAFVERRKGKATEEQAQEMLKNVNYFGTMLVYTGKAEGLVSGAAHSTGDTVRPALQIIKTKPGVSKTSGIFFMIKDDQQYIFGDCAINPTLEAQDLAEIAVESAKSAKSFGMSPRVAMLSFSTKGSAKSDDVEKVSNAVDMAQEKIKADNIEDVVVDGEFQFDAAIVPEVAKKKAPDAKIQGDANVFVFPSLEAGNIGYKIAQRLGGFDAVGPVLQGLNSPVNDLSRGCSIEDVYNLSIITAAQSLQ

SEQ ID NO: 49295 - protein, 258 aa, Vitis vinifera
MVQPLDFLYPSSFFITTMSLVGFLSISFFGVLEILGIHLQYSKLWNANSRRIKVSSTAGMLLLYAPACLFGFASFWIFPENNFRSLLVASALTIHFFKRVLEILFVHKYSGGMVLDSGILISLSYTLSTATMIYIQHLVQGSMEPSIDLKYPGILLFLVGIYGNFYHHLLLSRLRRKDEKGYKIPRGGLFHLVICPHYLFEIIGFIGVSFISQTLYASSFTLGTTVYLIGRSYATRKWYLSKFENFPREVKALVPYIF

SEQ ID NO: 49296 - protein, 243 aa, Vitis vinifera
MSITTFLVLSLFGFLEMLGIHLQYSKLWNVNSRRPSIKVSSTADMLFLYTPAFLFGLSSFGLFPDNDFRCGLVASALTVHFLKRNLEVLFIHKYSGGMVLDSGIVISLSYFTSTATTIYSQHLVQGSMEPLIDLKCPGILLFLVGISGNFYHHYLLSKLREKDEKSYKIPRGGLFHQVICPHYLFEILAFIGVSFMSQTLYYFSFTIGTALYLLGRSYATRKWYLSKFESFPREIKALVPYIF

SEQ ID NO: 49297 - protein, 584 aa, Populus tremula x Populus alba
PSYTFEFLRSDFIARITIASLAIPQGISYAKLANLPPILGLYSSFIPPLVYAMMGSSRDLAVGTVAVASLLTASMLGNEVNANESPKLYLHLAFTATFFAGVFQASLGLLRLGFLVDFLSHATIIGFMAGAATVVILQQLKGILGLDHFTHSTDLVSVLRSVFSQTHQWRWESAILGFCFLFFLLITRYISKRKPRFFWVSAMAPLTSVILGSILVYLTHAEKHGVQVIGHLKKGLNPPSFTDLVFVSPYLSTAIKTGIITGVIALAEGIAVGRSFAMFKNYHIDGNKEMIAFGTMNIVGSCTSCYLTSGPFSRSAVYFNAGCKTAVSNIVMAVAVMVTLLFLTPLFHYTPLVVLSSIIISAILGLIDYEAAIHLWTVDKFDFIVCISAYAGVVFCSVEIGLVVAVAISLLRVLLFVARPKTFILGNIPNSMIYRNVEQYTNTSSVPGVLILEIDAPIYFANASYLRERIARWVDEEEDKLKSSGETSLQYVILDMGAVGNIDTSGISMLEEVKKVMDRRELQLVLANPGAEVVKKLNKSKLIEKIGQEWMYLTVGEAVGACNFMLHTRKPDPLKEESEAYNKV

SEQ ID NO: 49298 - protein, 624 aa, Carica papaya
MEARVGAFSLALLIFLLHPLWLGSANMEGDALHSLRTNLNDPNNVLQSWDPTLVNPCTWFHVTCNNDNSVIRVDLGNAALSGQLVPQLGLLKNLQYLELYSNNISGPIPSDLGNLTSLVSLDLYLNSFSGPIPDSLGKLSKLRFLRLNNNSLTGPIPMSLTNISSLQVLDLSNNHLSGVVPDNGSFSLFTPISFANNLDLCGPVTGRPCPGSPPFSPPPPFVPPPPISSPGGNSATGAIAGGVAAGAALLFAAPAIAFAWWRRRKPQEFFFDVPAEEDPEVHLGQLKRFSLRELQVATDSFSNKNILGRGGFGKVYKGRLADGTLVAVKRLKEERTPGGELQFQTEVEMISMAVHRNLLRLRGFCMTPTERLLVYPYMANGSVASCLRERPPSQPPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQKNYVDAEVEQLIQVALLCTQGSPMDRPKMSEVVRMLEGDGLAERWDEWQKVEVLRQEVELAPHPNSDWIVDSTENLHAVELSGPR

SEQ ID NO: 49299 - protein, 408 aa, Carica papaya
MNSPPPEEDDQGEVFIDESDVIHEFTVDEEDLPDAEDDASSDAENIEEPDDSMHIFTGHTGELYAVACSPTDARLVATGGGDDKGFLWKIGRGDWGSELLGHKDSVSCLAFSTDGQFLASGGLDGLVQIWDASSGNIKCALEGPEKGIEWVRWHPRGHLVLAGSEDCTVWMWNADRGAYLNMFSGHGSSVTCGDFTPDGKTICTGSDDATLRIWNPRSGENIHVVKGHPYHTEGLTCLAMSSDSSLALTGSKDSSVHIVNIVTGKVVSSLDSHTDSVECVGFSPRYALLGQQQEAWIISLLYGISSTQCLVLHVIMRQRFFITDVNEVHFFRQEGVTCLAWLDASRCLATGCVDGKVRLWDSLSGNCVRTFTGHSDAIQSLSFSANWDFLVSGSIDGTARVFEVAEFH

SEQ ID NO: 49300 - protein, 295 aa, Pseudomonas syringae pv. phaseolicola 1448A
MIASYQAQSQTRVNAALEKLFQAPSPELNRLYEAMRYSVMNGGKRVRPLLAYAACEALGGVAEDANGASCAVELIHAYSLVHDDLPAMDDDDLRRGQPTTHKAFDEACAILAGDGLQSLAFTALLAPHLTSRDAETRLQMVNTLAAAAGPAGMVGGQAIDLGSVGLKLDQAALEYMHRHKTGALIEASVRLGALASGQADQPRLDALQIYARAVGLAFQVQDDILDVESDTATLGKRQGADIARDKPTYPALLGLEAAKRYALELRDQALTALSTFDAAAEPLRELARYIVERRH

SEQ ID NO: 49301 - protein, 508 aa, Zea mays
MATKRGNARGVPVGVLLVAALLLCSLAPASASSYPARVVSGFLSNAASAVVKRLWSLKSTTKIASGGKSMVKYEGGYTVETVFDGSKLGIEPYSVEVTQGGELLVMDSMNSNIYRMALPLSRYSRPKLVAGSPEGFPGHVDGKLREARMNHPKGFTVDDRGNIYVADAMNMAIRKISDTGVTTIAGGKSGRGGHVDGPSDEAKFSTDFEVRYIGSSCSLLVIDRGNQAIREIQLHFDDCVYQYEAGFPLGVALLLAAAFFGYMLALLQRRVLGMYSNGDEQDHESPVKAKLASIPPPYQKPLKPYVHPLLIPNDDEPVKQEEEEGLFTSIGKLVGGAKSSIAEIIGAAFSRKKRVNVHHHQLGRPTSWPAQESYAIPRDETPPPLDTRAPTPRKNYAFMSKEPEKIHHIRHGRPQLHGWTGEAQQPPQPQQVRHQQYVQHHRQYSAGPQTFYEPNCDATKEIVFGAVQEGDTSRRPVEIKAVNHGDAAPYEQNGLRFRSSYSVRYNGN

SEQ ID NO: 49302 - protein, 596 aa, Leifsonia xyli subsp. xyli str. CTCB07
MKKTLTSLFAPAGVCLALSLGASPAAAVTITPDAGPTAGGTRLQIGPVGVTFTAVSAGSLSAYALGDDGNVYAWGDNEYGQLGTGDTVNAHTPVKVMLPAGVKFTALSAGSLSAYALGDDGHAYAWGDNEYGQLGTGDTVNAHTPVKVMLPAGVKFTALSSGGPSAYAVGNDGKTYAWGFNGYGQLGTDTTADAHVPVAVAVPAGVSFTTLSGGSLSAYALGNDGKTYAWGFNGYGQLGTDTTADAHVPVAVAVPAGVSFTAVSAGVSSAYALGDDRKTYAWGDNEYGQLGRGDTANAHAPVAVTVSAGETFVSVSGGAGSVYARGQNGDTYAWGDNDYGQLGRGDTANAHTPIEVAAGVEVTGVLFGSLPGTAVSSQGGKTWTVTSPAHRSGTVSLSVSYTQFGERKSLPAGSFTFGKAPVITENPASQTVSSGDSLTLTAAADGDETPTVRWQSQTSDGNWADIPDATATQYKTDPIRASQSYRAVFANALGSATTTPAIITIATPTPTPTPISPPVPLAVTTTGDLAATGSEIGLLAPLTALLLLAGIAVCHAARPTETFDESAPCRSAGFPGDQPTGLSARRSRAAGVASRS

SEQ ID NO: 49303 - protein, 531 aa, Yersinia pestis CO92
MLSTNNITMQFGSKPLFENISVKFGGGNRYGLIGANGCGKSTFMKILGGDLVPSGGNVFLDPNERLGKLRQDQFAFENNTVLDTVIMGHGELWEVKEERDRIYAMAEMSEEDGYKVADLEVAYGEMDGYSAEARAGELLLGVGIPVEQHYGLMSEIAPGWKLRVLLAQALFSDPEILLLDEPTNNLDIDTIRWLEQVLNERNSTMIIISHDRHFLNMVCTHMADLDYGELRVYPGNYDEYMTAATQARERLLSDNAKKKAQISELQSFVSRFSANASKSKQATSRARQIDKIQLDEVKASSRQNPFIRFDQDRKLFRNALEVEMLTKGFDNGPLFKNLTLRLEVGEKVAILGPNGIGKSTLLKTLLGEYESDAGTVKWSENSKIGYYAQDHASDFDIDLTVFDWMSQWKQEKDDEQAVRSVLGRLLFSQDDIKKKVSVLSGGEKGRMLFGKLMMQRPNILVMDEPTNHLDMESIESLNMALEMYEGTLIFVSHDREFVSSLATRVIEMTPNKLIDFTGNYEDYLSSQGIHS

SEQ ID NO: 49304 - protein, 499 aa, Zea mays
MVVSVAATGPGTDAEPVSSTFFASRYVRDPLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 49305 - protein, 424 aa, Zea mays
  misc_feature (205)..(205): Xaa can be any naturally occurring amino acid
MAVEKTLPGASAGRTVLVTGGAGYIGSHAVLQLLLAGFRAVVIDNLNNSSELAVRRVAALAGDHSRNLSFHKIDLRDKGALEMVFASTRFEAVIHFAGLKAVGESVQKPLLYYDNNVIGTINLLEVMSVHGCKKLVFSSSAAVYGSPKNSPCTENFPLTPNNPYGKTKLVVEDICRDIYRSDPEWKIILLRYFNPVGAHPSGYLXGEDPRGIPNNLMPYVQQVAVGRRPALTVLGNDYATRDGTGVRDYIHVVDLADGHIAALQKLFENSSIGCEAYNLGTGRGTSVLEIVKAFEKASGKKIPLIFGERRPGDAEILFSETTKAERELNWKAKYGIEEMCRDQWNWASKNPYGYGSPDSIKQNGHQTNGSADSSKQNGHRTNGSTDSPKRNGHHAYGSADSPKRNGHCVFGSSDLKPNGNGHLR

SEQ ID NO: 49306 - protein, 245 aa, Pseudomonas sp. 61-3
MTDQRKGSDAEPTTHFGFKNVPESQKAEKVAEVFHSVAAKYDLMNDLLSGGMHRLWKRFAIELSGVRTGNRVLDIAGGTGDLTRKFSHLVGPTGQVVLADINESMLKVGRDRLLDLGVAGNVEFVQADAEKLPFPDNHFDCVTIAFGLRNVTHKEDALRSMLRVLKPGGRLLVLEFSKPTNALMSKAYDAYSFAFMPLMGKLITNDSESYRYLAESIRMHPNQETLKSMMVEAGFDRVTYHNMTA

SEQ ID NO: 49307 - protein, 313 aa, Leifsonia xyli subsp. xyli str. CTCB07
MLSRFRRATTVQVFRPRWHGVVIHSGRPECSCLELGSTSHTALPDAPPHLPWKIMQKFFIPPRRRRWGRAFTWLLASLCALAAVAVAGSPVAVSWAMWAATSSNTGDSWNIASFCTAPAALPATGAAQGGTRVALNLTAAPTTLTFTAVDGGNGHSFALAPEGTVWAWGYDGYGQLGDGGTSRSSTPVPVKGLDGKAAAIGDGSDHSLALTSRGAVWAWGRNFFGQLGNNTTISSIAPVQVKAADRTVSKATGVVVGGNAAADVVMVDCPKPTVIFTVPAHAAGATDITVTTQTKSGTPGPTLTYLGGFTYTT

SEQ ID NO: 49308 - protein, 406 aa, Chlamydophila caviae GPIC
MVCRIKEDFPIFANKELQGEPYIYLDSAATTHKPKKVIEAISDFYSSTYATVNRNVYSSSKNITEDYTAVRGKIREWIHAAYNEEIIFTRGTTAALNLLAISANDTFIPEGGVVLVSEAEHHANVLSWELACRRRGSCVKKIAVDDSGYIDLEHLEALLKAGASFVSIAHVSNVTGCIQPLKHIAHLVHQYGAYISVDGAQGVAHTFVDVVDWDVDFYAFSAHKMYAPTGLGVLYGKKELLEKLSPVEGGGDMVSIYDSENPEYLSAPLKFEAGTPPIASILGLGAAIDYLQSLPDTVYRQEEELTQYLYNELMTIPGMQILGPGINQLRGALVSLKVQGAHPFDIGCLLDLQGIAVRTGHQCAQPAMNRWNLGHVLRVSLGIYNDKKDIDTFMSALRAILARVRV

SEQ ID NO: 49309 - protein, 609 aa, Coccidioides immitis RS
MATLADELLNDFEESDSEIEAKEEWLHADSSEAAGEPPFKGSTMGIEDDGDKELHDNTIMTDTSIVNNALAEEGEEHEDAKASVEKMQFTGISDVRSIARLMKTLQPILEKISYYQSLPSEPQPMSTGSIEDNPEYYLLTESNSLSTSIDNEIILVHKFIRDHYSTRFPELETLITNPLDYAKTVAILRNGPLNDIKSLASSTDNLVGATLRSVLDGPLLMVVAVEGTTTRGRELSSSELQIVLDACEMMLSLDKAKSVLTDYVQSRMNIFAPNLTALIGSLTAAQLLNYAGGLTGLAKMPSCNIPPLGSKKQTQAGFATNVGVRHQGFLFHSPIIQGIPNDLKRQAMRIVSAKVVLAARVDRVHSSRDGSTGEELKQACLERLEKLAEPPPNKGTRALPAPDDKPSRKRGGRRARKAKEATAMTELRKAQNRLAFGKEEKEVGYGTGEGTKGLGMLGQENLGRIRAAQIDQRTKAKLSKSNKGWGATSAVGGTVSSLRGFGQGAGNASVLRSQGLRTAGVGPSVGSGTASTIAFTPVQGLELVDPKAQAELNRKRKAEEDRWFKSGTFTQVGSQSSENGGFKVPQLPPLKKTNTVNSKMAPPPPPLKR

SEQ ID NO: 49310 - protein, 437 aa, Magnaporthe grisea 70-15
MAGGGSIGTNGHADSINSHDDDSKKQDKKKSKRPANTAFRQQRLKAWQPILTPKTVLPLFFAIGVIFAPIGGGLLYASTTVRMISLDYTNCATQGGDNKFENMPSGLVKTQFGSSNQVNPPQWSRSTKKMKFSTNTDPNQNDTDVSVCTLQFTLPENMYPPVLMYYTLTNFYQNHRRYVSSFYDKQLKGDKVDINAVRSSPCTPLTVDSNNKAYYPCGLIANSMFNDTISEPVLLNSNSAEAKNGSEVYKMANNSNIAWPSDADLYGKFPSDMNIDDVVPPPNWRKQYGDKYTKETVPDLKTWQAFQVWMRTAGLPNFSKLYRRNDTAPMREGTYQVEIESHWPADAYRGTKSLLITTRTIIGGRNPFLGIAYIVVGGICIILGVIFTATHLIKPRKLGDHTYLSWNNAPAPKKGAAGAPPSTAQTSGRDYGGRAEA

SEQ ID NO: 49311 - protein, 403 aa, Chlamydophila caviae GPIC
MDRLTVRELSPEENKVLVRVDFNVPIKDGKILDDIRIRSAMPTINYLLQKRAAVILMSHLGRPKGTGFEEKYSLQPVVEVLEGYLGHHVPLAPDCIGEVARQAVAQLSPGRVLLLENLRFHRGEEHPEEDPTFAAELSSYGDFYVNDAFGTSHRKHASVYHVPQAFPGRSAAGLLMEKELEFLGQHLLHSPKRPFTAILGGAKVSSKIGVIEALLSQVNNLLLAGGMGFTFLKALGKSVGNSLVEESGIELARRVLKLAEQRNVRIVLPIDVKVAKACEPGVSWSETLIDQGIPADLEGLDIGTKTIQEFCKIIDASATVFWNGPVGVYEVPPFDQGSMAIANCLARHSSATTVVGGGDAAAVVALAGCTSQVSHVSTGGGASLEFLENGFLPGTEVLSPAQD

SEQ ID NO: 49312 - protein, 272 aa, Thermococcus kodakarensis KOD1
MSEMEVMASIMRDHIIELLREGKRIDGRSFEDYRDLEIKVNVIEKAEGSAWVRLGDTQVLVGIKAELGEPFPDLPDRGVITTNVELVPLASPTFEPGPPDENAIELARVVDRGIRESQAVDLEKLVIVPGKLVRVIFIDVHVLDHGGNLLDASGIGAIAALLSTKLPKVNYNEETGEVEILDEYEPLPVNHVPIPVTFAKIGNSIVVDPSLDEERVMDGRLTITTDETGHISAAQKGEAGAFKMEEVMYALEVALKKGNEIREKVLKAVGRA

SEQ ID NO: 49313 - protein, 249 aa, Thermococcus kodakarensis KOD1
MMGRPEGLKLIDENGKRIDGRKKYELRPIKMEVGVLKNADGSAYVEWGKNKVLAAVYGPREIHPKHLQRPDRAILRVRYNMAPFSVEERKKPGPDRRSVEISKVIRGALEPALLLHMFPRTAIDVFIEILQADAGTRVAGITAASLALADAGIPMKDLVAACAAGKIDGEIVLDLNKEEDNYGEADVPVAIMPLKNDITLLQMDGYLTKDEFLEAVRLAIKGAKAVYQKQREALKEKYLKIAQEVEGNE

SEQ ID NO: 49314 - protein, 448 aa, Galdieria sulphuraria
MGFVLPSTTSYVVYKSSSTIKSKKYNKRNYSSVSRVQVGGSKISSWLSNRLLFQGKEINTTRKTTTKYWIITVSSQTALEEFVNCSGSKGVHESAGISRSKSKVLRNKGIERPVIIGVAADSGCGKSTFLRRVNEIFGTKVSQSHTPQGELVTVICLDDFHTLDRKGRAEKKVTALNPEANNFELMYQQIAALKEGYDIMKPIYNHQTGLIDPPELIQPNHIIVIEGLHPWYDARMKQLLDFTVYLDISDEVKVAWKIQRDMAERGHKLENILASIESRKPDFQQYIDPQKKDAVAVIQVLPTRLIPDDTEKKVLRVRLIQREGIQGFQSVYLYDEGSTIDWIPCGRKLTCSYPGIKFHYGPDNWYNHDVSVLEVDGNFEKLEELIYIESHLNNTSTKFYGEITQQLLRNSSAPGSNNGTGLFQVLTALKMRQLYEELTGKSIAPVLV

SEQ ID NO: 49315 - protein, 470 aa, Klebsiella pneumoniae subsp. pneumoniae MGH 78578
MKKTKIVCTIGPKTESEEMLTKMLEAGMNVMRLNFSHGDYAEHGQRIQNLRNVMSKTGKKAAILLDTKGPEIRTIKLEGGNDVSLKAGQTFTFTTDKSVIGNNEIVAVTYEGFTSDLAVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDMGVEIPVEEVIFAQKMIIEKCIRARKVVITATQMLDSMIKNPRPTRAEAGDVANAILDGTDAVMLSGESAKGKYPLEAVTIMATICERTDRVMTSRLDFNNDNRKLRITEAVCRGAVETAEKLEAPLIVVATQGGKSARAVRKYFPDATILALTTNETTARQLVLSKGVVPQLVEEIASTDDFYHLGKDLALKSGLARKGDVVVMVSGALVPSGTTNTASVHVL

SEQ ID NO: 49316 - protein, 406 aa, Klebsiella pneumoniae subsp. pneumoniae MGH 78578
MTFSVEQVRADFPVLNREVNGQPLVYLDSAASAQKPEAVIGAEAEFYRHGYAAVHRGIHTLSAEATARMEAVRQQAATFLNAGSAEEVVFVRGTTEGINLVANSWGNANVGAGDNIIISEMEHHANIVPWQMLCARVGAELRVIPLNPDGTLQLDVVPGLFDPRTRLLAITEVSNVLGTENPLAALIALAHQHGAKVLVDGAQAVMHHPVDVQALGCDFYVFSAHKLYGPTGIGVLYARSELLQTMAPWEGGGSMIATVSLTEGTTWNQAPWRFEAGTPNTGGIIGLGAALTYVSQLGLTQIAEYEQTLMRYALDALRAVPDLILYGPAQRKGVIAFNLGQHHAYDVGSFLDNYGIAVRTGHHCAMPLMARYQVPAMCRASLAMYNTTEEVDRLVAGLQRIRKLLG

SEQ ID NO: 49317 - protein, 99 aa, Brassica napus
MAIFRTTLLMLLILVCLTTYELHVHAAEGAEGSEGAVKIDCSGRCKGRCSKSSRPNLCLRACNSCCSRCNCVPPGTHGNHHLCPCYASITTRGGRLKCP

SEQ ID NO: 49318 - protein, 565 aa, Triticum aestivum
MHSVSISASASASAIASGGARSKAAAGRRPGEIRFCGLRGDALACGSLRASHAAAATSRAVLRAASANGAAGSGDGFDYDLVIIGAGVGGHGAALHAVEEGLKTAIIEGDVVGGTCVNRGCVPSKALLAVSGRMRELHDEHHMKSLGLQVSSTGYDRQAVADHANNLASKIRSNLTNSMKAMGVDILTGFGKIVGKQKVRYGKVGFPEKEITAKNIIIATGSVPFVPKGIEIDGKTVFTSDHALKLESVPDWIAIVGSGYIGLEFSDVYTALGSEVTFVEALDQLMPGFDPAIAKLAQRVLINPRKIDYHTGVFASKITPAKDGKPVLIELIDAKTKEHKETLEVDAALIATGRAPFTNGLGLENINVVTQRGFIPVDERMQVTDADGNVVPNLFCIGDANGKLMLAHAASAQGISVVEQISGRDHILNHLSIPAACFTHPEISMVGLTEPQAREKADNEGFEVSVVKTSFKANTKALAENEGDGIAKMIYRPDTGEILGVHILGLHAADLIHEASNAIALGTRLQELKLAVHAHPTLSEVLDELFKAAKVNSGVSHSVNEPVAA

SEQ ID NO: 49319 - protein, 624 aa, Carica papaya
MEARVGAFSLAFLIFLLHPLWLGSANMEGDALHSLRTNLNDPNNVLQSWDPTLVNPCTWFHVTCNNDNSVIRVDLGNAALSGQLVPQLGLLKNLQYLELYSNNISGPIPSDLGNLTSLVSLDLYLNSFSGPIPDSLGKLSKLRFLRLNNNSLTGPIPMSLTNISSLQVLDLSNNHLSGVVPDNGSFSLFTPISFANNLDLCGPVTGRPCPGSPPFSPPPPFVPPPPISSPGGNSATGAIAGGVAAGAALLFAAPAIAFAWWRRRKPQEFFFDVPAEEDPEVHLGQLKRFSLRELQVATDSFSNKNILGRGGFGKVYKGRLADGTLVAVKRLKEERTPGGELQFQTEVEMISMAVHRNLLRLRGFCMTPTERLLVYPYMANGSVASCLRERPPSQPPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQRNYIDAEVEQLIQVALLCTQGSPMDRPKMSEVVRMLEGDGLAERWDEWQKVEVLRQEVELAPHPNSDWIVDSTENLHAVELSGPR

SEQ ID NO: 49320 - protein, 466 aa, Burkholderia mallei ATCC 23344
MKITIIGTGYVGLVTGACLAEIGHDVFCLDVDPRKIDILNNGGMPIHEPGLQEIIARTRAAGRIAFSTDIEASVAHGEIQFIAVGTPPDEDGSADLQYVLEAARNIGRHMTGYKVIVDKSTVPVRTAQRVRAVIDEALAARGLAGSAEHRFSVVSNPEFLKEGAAVDDFMRPDRIIIGVDDDAAGAIAREKMKKLYAPFNRNHERTIYMDVRSAEFSKYAANAMLATRISFMNEMSNLADRVGADIEAVRRGIGSDPRIGYHFLYAGVGYGGSCFPKDVQALIRTGSENGQPLRILEAVEDVNHAQKNVLLDKIEKRYGADLAGRTFAVWGLAFKPNTDDMREAPSRRLIASLLARGATVRAYDPVALDEARRVFALDLHDGADALARLAFVDSADDALAGADALVIVTEWKEFKSPDFAHLKSVLKAPVIFDGRNLYEPDAMAELGIDYHAIGRPYVEPFSSERG

SEQ ID NO: 49321 - protein, 93 aa, Vitis vinifera
MEAQNNQHETQPASAAKAPVVTSCRKKKSDDATILQDVKDHIDEFIHASMDEHKTCFTKTIKKMFGMSKVVAERNSNSEGVESSLPLQTTIAN

SEQ ID NO: 49322 - protein, 639 aa, Ustilago maydis 521
MASSHNGGRFASRTAFEALQVEEIESDDEESVVEHKSPAKPAQPAQPSQPAANASSTKDTKSKLNKAQSAPQPAKLDTTDSANKVIAPNGYNGTNTVEPPQSLTSAAVENLGVQDKVIPTPSAPFAASAPKQGAPSGYQTALPTAKPASAKADQPESILNASTKAVSNDHAQDVKFQSPQPPASREANTSQQLPKQPQQSQQSQEDAAAAAKAKWQKIYERTLYTLIMIGGFIGLLLLGHPYMILLVMICQTLVYREIVALFNIPGRPSVTGGGGRSSRMSSAPTSAATSEVDDDDDDERIQKRIQGRRDQLWSKTLSWYFFAVANYFLYGESIIYYFKHIVFVDAWFIPFARHHRFLSFMLYVFGFMAFVSNLKRRNLKHQFGLFCWVHMSLLLIVFSSHFIVNNILEGLIWLWVPASLVVCNDVFAYICGMTFGRTPLIDLSPKKTVEGFVGAFIVTEIFAYGWATFFQRYNYMICPAVSLGMNAFKEVTCDVNPVFHWHYLSLPPAMASLASSIAGHRISAFPWSPFQLHALVMAAFASLVAPFGGFFASGFKRAFNIKDFGDSIPGHGGLTDRFDCQFLMGLFSYVYYSSLIREHHVTVGSVLQTVVTQLTLDDQIELYNEISRYLVGQGKLTKA

SEQ ID NO: 49323 - protein, 225 aa, Triticum aestivum
MDSEHWISRLAAAKRFYAAQLGHSDRAGMEELDMDEEVRPEFACPYCYEDHDVGSLCAHLEEEHPFEPQAAACPVCSEMVTKDMVNHITMQHGYLFKNRRRLRRFIIPGSQALSLRTRDLREAHLQVLLGGGHRSSNNNSTTNISADPLLSSFGLSFPTSDAEQTSKSTLSIPDDATMIKETPAQARKLSIDSSLTSEEREQKRKQASARATFVQDLLLSTLFGD

SEQ ID NO: 49324 - protein, 530 aa, Bacillus cereus ATCC 10987
MIQGTISSWTEDTMSLLTVEKLGHTFGDRTLFKDVSMRLLAGEHVGLVGANGVGKSTFMNIITGQLIHDQGRVEWTPGTHYGYLDQHTVLTPGRTIRDILADAFLPLFEKEKALNEVTEKMGTATPEELEELLEQMAEIQDALEAGGFYLLDMKIEEAARGLGIDAIGLDRDVSALSGGQRTKVLLAKLLLEQPEVLLLDEPTNYLDVEHIHWLTNYLKEYPHAFLLISHDTEFMNKCVDVIFHLEFTKMTRYTATYEKFLELAEINKNQHINAYEKQREFIKKQEDFIAKNKARYSTTGRAKSRQKQLDRMELIDRPETAIKPEFSFKESRASSRFVFEGENVEIGYTHPLLPKLSMTIERGEKIAIVGCNGVGKSTLLKTILGKIKPLSGKTSLGDFLEPAYFEQEVKADNITPIDDVWNTFPGLDQHQIRAMLAKCGLKNEHISRPLSQLSGGEQAKVRLCKLMGEESNWLLFDEPTNHLDVTAKAELKKAMKAYKGTILLVCHEPDFYEDWITKVWNVEEWSQNKN

SEQ ID NO: 49325 - protein, 305 aa, Pseudomonas syringae pv. phaseolicola 1448A
MGAEQASARRAWEAMAAGERVVLSQVGLFADGVAVAQIGHHTFEVCRHYVDEVITVSTDEICAAIKDIYDDTRSIAEPSGALGVAGIKKYVEQRGISGQTLVAIDSGANVNFDRLRHVAERAELGEGREAIIAVTIPEQPGSFKAFCEAIGKRQITEFNYRYHTDREAHIFVGVQTHPENDPRSALITSLTGQGFPVLDLTDNELAKLHIRHMVGGHAERVNDEVVLRFEFPERPGALFNFLNRLGGRWTISMFHYRNHGAADGRVVAGLVVSEEERHLVGTALDEIGYPYWDESENPAYRLFLG

SEQ ID NO: 49326 - protein, 205 aa, Pseudomonas aeruginosa UCBPP-PA14
MSVVFVAASKLPTPFGEFTMHGFLDEESGKEHVALSMGDIADGAPVLGRLHSECLTGDALFSLRCDCGFQLEGALAAIAEEGRGVLLYLRQEGRGIGLLNKIRAYELQDGGADTVEANLQLGFGADQRDYAMCQPMLAHLGVSSLRLMTNNPRKVKALESYAITVAERVPLQRGLNKHNRRYLATKAGKLGHMLGSLHQGEAETT

SEQ ID NO: 49327 - protein, 377 aa, Yersinia pestis CO92
MIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 49328 - protein, 543 aa, Corynebacterium glutamicum ATCC 13032
MIVTNDLEVRVGARTLLDAPGQLLRVQPGDRIGLVGRNGAGKTTTMRILSGETKPYGGSVTTSGEIGYLPQDSREGNIEQTARDRVLSARGLDQLRSSMERQQEIMETATDPGKLDAAIRKYSRLEEQFQSLGGYEADAEAAQICDNLGLEARILDQQLKTLSGGQRRRVELAQILFAATNGSGKSKTTLLLDEPTNHLDADSITWLRDFLAKHEGGLIMISHDVELLGAVCNKIWYLDAVRSEADVYNMGFSKYVDARALDEARRRRERANAEKKAGALKDQAARLGAKATKAAAAKQMIARAERMIDNLDEIRVADRAANIVFPEPAPCGKTPLNAKGLTKMYGSLEVFAGVDLAIDKGSRVVVLGFNGAGKTTLLKLLAGVERTDGEGGIVTGYGLKIGYFAQEHDTIDPDKSVWQNTIEACADADQQSLRSLLGSFMFSGEQLDQPAGTLSGGEKTRLALATLVSSRANVLLLDEPTNNLDPISREQVLDALRTYTGAVVLVTHDPGAVKALEPERVIVLPDGTEDLWNDQYMEIVELA

SEQ ID NO: 49329 - protein, 250 aa, Oryza sativa Japonica Group
MMGGFLSRVLLLAFGYAYPAYECYKTVELNKPEIEQLIFWCQYWILVALMTVMERFGDFTISWLPFYSEAKLMFFIYLWYPKTKGTTYIYGTFFRPYISQHENEIDRNLLELRARATDVVVLYFQKAATVGQNTFFDVLKYVASQSPSQRSSQQPSQVLTCFSSSKLFTEQTHLLLTTGITEFTISVQSLMLKFSGALLKQFYPCCLASLLAICFFFMQDAFTITAVLPSHVDLVSAATFSINYRNRNNL

SEQ ID NO: 49330 - protein, 144 aa, Corynebacterium diphtheriae NCTC 13129
MRWLHYPTMTERTLILIKPDGVERGLIGEIIARIERKGLKISALDLRVADRETAEKHYAEHADKPFFGELVNFITSAPLIAGVVEGPRAIEAWRQLAGGTDPVAKATPGTIRGDFALEVSTNVVHGSDSPESAEREISIWFPNL

SEQ ID NO: 49331 - protein, 392 aa, Prochlorococcus marinus str. MIT 9313
MPLPPHLSDRVVALQPSLTLAISARAKALQQEGRDICSLSAGEPDFNTPEFIIDATVKALRDGITRYGPAAGDPELREAIATKLSKENTVPTNAEQVLVTNGGKQAIFNLFQVILNPGDEVLIPAPYWLSYPEMARLAGAKVTTLPSTPENGFCLDLNNLEASIGPKTRLLLLNSPGNPTGRVMARKELETLADLLRDHPQILVMSDEIYEFILEEGQQHYSFSAIAPDLSNRTFIVNGFAKGWAMTGWRLGYLAGPADAVKAATALQSQSTSNVCSFAQRGALAALQGSRECVKKMVKSYNTRRELLTSGLLSLEGMSLVPPKGAFYAFPKLPPESLDSVSFCEQALENHGLAMVPGAAFGDDSCVRLTCAVSPETICDGLERLRKALKQS

SEQ ID NO: 49332 - protein, 515 aa, Leifsonia xyli subsp. xyli str. CTCB07
MTTSHDPADELENRLEHLGDVSQAVQDFASEQEGYRKSLSARQVQMIAIGGAIGTGLFLGAGGRLQQSGPLLVFVYAVCGFFAFLVLRALGELVLHRPSSGSFVSYAREFFGEKMAYVAGWMYFLNWAMTAIVDSTAVALYVKYWSLFSSVPQWLLALIALVIVVSLNLISVKVFGEMEFWFALIKVGALATFLVVGIVVLAAGWPTDLGPTGIPMLAENGWLLPNGIATIAMAIVLVQGVVFAYAAVELVGIAAGETEHPEKIMPRAINSVVFRIAVFYCGSVLLLALLLPASAYSGSESPFVTFFSHFGGPQLSAVVGSIMNFVVLTAALSSLNAGMYSTGRILHSMAQTGAAPRFTSRMSKQGVPYGGILLTAAIGVFGVFLNLVVPAQAFNIVLNVAALGIVTSWAMIVLCQMRLRRWSLRGTMKRPAFSLIGAPFTAYLTLAFLLAVLVLMTFDYPTGTWTVASLVVIAPLLVIGWFAQRGRILAIAARREGHTGAYPVIAARPLRRERE

SEQ ID NO: 49333 - protein, 339 aa, Bradyrhizobium sp. ORS278
MAEISDEIGKSGAWRFAVAPMMDWTDRHCRVFHRLLSRRALLYTEMVTTGAVIHGDRTRLLGFDRSEHPVALQLGGSDPADLATSARIGEDFGYDEINLNVGCPSDRVKDGRFGACLMAEPALVAACVAAMKRVVTIPVTVKCRIGIDDQDPEVALDALADAVVDAGADALIVHARKAWLNGLSPKENRDIPPLDYDRVYRLKARLPRVPVIINGGITSIEAAQDHLAHVDGVMLGRAAYQEPWRLLDVDPVLFGEAGPQRSMKDALAALEPYIERQVAQGMRLHAITRHLVGAYHAVPGARAFRRHLAERGVKPDAGIEVLREAVAMIEERAPSVALA

SEQ ID NO: 49334 - protein, 379 aa, Magnaporthe grisea 70-15
MRKSLRSARRTAINPVAVRDLLIRCSSRPRSDSRKLPRDAAVGDGNDDPRGKFNPAALSTQKEPARRTSSPRQASLESQIREFLHAKKPREQGAGKEPLEQLQAAQAAAAAAALVAQPSAQPVAMHLGMFEIGKPLGRGKFGRVYLAREREHGFVCALKVLHKRELQDAHVERQVQREIEIQSNLRHPNILKMYGHFHDSKRIFIILEFAGKGELYKHLRKETRFPEWRAAQCIAQMASALRYLHRKHVMHRDIKPENILVGFYGEIKISDFGWSVHAPSDRRTTFCGTLDYLPPEMIKPRTADKSYDHRVDLWALGVLTYELLVGEAPFEDTPAMTHKKITRRDMKVPSFEPEGIRQVTALDRQHTPRRLNKKEWPRN

SEQ ID NO: 49335 - protein, 466 aa, Rhodospirillum rubrum ATCC 11170
MTETSFDVVVLGAGPGGYVAAIRAAQLGLKTAVVEREHLGGICLNWGCIPTKALLRSAEVFRQIRHAGAYGLKVTGAEVDVAAVVKRSRGVAKQLAGGVGHLLKKNKVTVIDGHGRLAGAGKLTVEKDGKTTTLAAKAIILATGGRARTLPGLEADGKLVWTYKNAMIPESLPKRLLVVGSGAIGIEFASFYTDCGSQVTVVEVLERVLPVEDEEISAFAKKSFEKQGMTIKTATTVKALKKSGDEVTATLEKDGKTEEITVDRVIMAVGIAANIEDIGLETVPSIKVERGHVVTDAFCRTGDPGIFAIGDLTAPPWLAHKASHEGVLVAEVIAGKKDLHPLDTMKIPGCTYCHPQVASIGLSEAKAKAKGFTVKVGRFPFVGNGKAIALGEAEGLIKTVFDARTGELLGAHMIGAEVTELIQGFAIAKTLETTEEDLIHTVFAHPTLSEMVHESVLDAYGRAIHF

SEQ ID NO: 49336 - protein, 225 aa, Bradyrhizobium sp. BTAi1
MQKYRPVMLVVLDGWGWREEVADNAIRQARTPNFDHLWGTGPHALVQTSGLDVGLPQGQMGNSEVGHLNIGAGRVVMQDLPRISAAITDGEIKSASALIDLMERLRRTGGTCHLLGLISPGGVHSHQDHATALAEILAETGVSAVVHAITDVRDTPPRSADVYVSRLSAALPLSIPIVSVCGRYYAMDRDHRWERVAKAYCTIVEAYAYDEGRLIDACARARRGL

SEQ ID NO: 49337 - protein, 440 aa, Rhodospirillum rubrum ATCC 11170
MPIEILMPALSPTMEEGTLAKWLKKEGDPIAAGDVIAEIETDKATMEFEATDEGVLGKILVADGTAGIKVNQPIGILLEEGEDASALVQAAPAKAPDAPAKAAPEPAPVAAASQSDAAPAPAAAAPKRAAGERLFASPLARRIAAAEGLDLGALQGSGPHGRIVRRDVEAALAAGTGKTAEKAVAAPVAPAAPPQAVAAAAPKPVALPDAPHTKVANTSMRKIIARRLTESKQTVPHFYLTVDCKIDALLDLRKSLNARAEKRGDGVKLSVNDLIIKAVALALRKVPAANASWSDEAIVLWSDVDISVAVATPGGLITPIVRKADQKGLATISAEMKDLATRARDGKLKPEEFQGGGFSISNLGMYGIREFAAIINPPQGCILAVGAGEQRPVVEAGALAIATVMSCTLSVDHRVVDGAVGAEFLSAFKILIEDPMAMML

SEQ ID NO: 49338 - protein, 161 aa, Leptospira interrogans serovar Copenhageni str. Fiocruz L1-130
MKHILKILVNNHPGVMSHVSGLFTRRSYNIDSIAVGVTVNPEISSMVIVVKGDEATVDQVKRQLLKLPDVLEVEDLAYHDCVSRELVLLVVKLTETTRAEILSVCEVFEAKIADLTHSSLTIEYSGNSRKVNAIVEIMSKYGIEEIVRTGQIAIRYRSVGS

SEQ ID NO: 49339 - protein, 146 aa, Bradyrhizobium sp. BTAi1
MTELSAMIDEGGARRFRIRLERPDGTFTFDAASDEYLLYSMIDAGIESPYICEQGWCLACAARLVSGKVDRSDALTVYAEDAEAGFLLLCSTKPCSDLILTLDERQTRRDMVQHRIEHNQLARAYPPGARLRFRRGRATPRMSSGD

SEQ ID NO: 49340 - protein, 492 aa, Ashbya gossypii ATCC 10895
MYDNRHHVIDLVGNTPLVELSKLPKALGIKPQVYAKLELYNPGGSIKDRIAKTMIERAEESGIIHPSRSTLIEPTSGNTGIGLALIGAIKGYRTIITLPEKMSNEKVSVLKALGAEIIRTPTAAAWDSPESHIGVARKLEKEIPGAIILDQYNNEMNPYAHYFGTGREIHHQLRNLGKFDQLHGLVAGAGTGGTISGTAKYLKEQKPDVKVVGADPMGSILAQPASLNDTDISEYKVEGIGYDFIPEVLDRSLVDQWIKTEDKASFKYARQLISNEGTLVGGSSGSAFAALVEYCNAHPELTEDDVLVVIFPDSIRSYLTKFVDNEWLKSNNLWDDEIVAPLAKNEEDAFNGATVKDLQLRPVVAVSETAAVSEVVKILKDNGFDQLPVLAENSKKLGGLVTLSQLLKKLSSGAEVSSIKSLFLDFRKLNNFDDISSYNDNKTGKKKFVTFTVDSKLSELNRFFEKNSSAIITDGFTPVHVVTKVDLLSYLA

SEQ ID NO: 49341 - protein, 318 aa, Listeria innocua Clip11262
MSNEYFDPKLKIFSLNSNRELAEEIAKEVGIELGKSSVTHFSDGEIQINIEESIRGCHVYVIQSTSNPVNQNLMELLIMIDALKRASAATINIVMPYYGYARQDRKARSREPITAKLVANLIETAGATRMITLDMHAPQIQGFFDIPIDHLNAVRLLSDYFSERHLGDDLVVVSPDHGGVTRARKMADRLKAPIAIIDKRRPRPNVAEVMNIVGNVEGKVCIIIDDIIDTAGTITLAAKALREAGATKVYACCSHPVLSGPAMKRIEDSPIEKLVVTNSIALPEEKWIDKMEQLSVAALLGEAIVRVHENASVSSLFE

SEQ ID NO: 49342 - protein, 437 aa, Exiguobacterium sibiricum 255-15
MYKLKQLQAAIRDVRREELVEHSGKVVQVIGLMIESRGPTAVAIGERCLIRIHRGDEIEAEVVGFREGHVLLMPYGETTAIAPGSIVIATGKPLHVPVGDDLIGTVLDGLGRSLDGKSLAHLRTTSIVRKPPSPLDRPRIDEVLSTGIRAIDGLLTVGQGQRVGLFAGSGVGKSTLLGMIAKRSMADINVIALIGERGREVKEFIEAELGEEGMSRSIIVVATSDQPPLVRLKGAYTATAIAEYFRDQGKNVVLMMDSVTRFAMAQREIGLATGEPPASKGYTPSVFALLPQLLERSGKTTEGSITAFYTVLVDGDDMNEPIADAVRGILDGHFVLDRNLANKGQYPAIHILRSISRVMNQITSTEHKDSAITFRQLLSTYLDAEDLINIGAYKSGTNPDIDRAVEKYPELIGFLKQRVEEKSHFEDGMSRLISTIR

SEQ ID NO: 49343 - protein, 615 aa, Mycobacterium sp. JLS
MSSAQTRVVSRLETADRALEQLDELIERLEKAEDAWSDWLTAVSPEHRASATNMVHYWSLRQSDLRDLQRRLAGLGLSSLGRSEPHVEGTLRLVHAAVAAMRHGSWHPPGVTAVDANVGDELLREHAVDLFGPAPAERATRIMVTLPSSAATDPDLVRDLIARGMNVARINCAHDDAEAWTAMAGHVRRAAESTGRKCLVAMDLAGPKLRTGPIRPGPRVIKLRPTRDALGRVVTPFRLRLTASEEPTGSSESAMAVVPVDEAWLARRRDGDVVGFHDARGAKRQLVLSRPDEMAGAVIATGDKTSYLATGTVLHAGAHDPCEVGLLPEREQTLMVQRGDELTLTRDCAPVPADHGGAPRIGCTLPEVFDHARPGEKIRFDDGRIGGEIVAVERDALRVRIDRTAPGGSKLGSAKGVNVPDTHLPIAALTDKDVEDLATVVAIADIVQISFVQRPSDITQLHDELHRLGGDHLGVVLKIETRRAFEHLPQLLLTAMRRPRVGVMIARGDLAVEVGYERLAEVQEEVLWLCEAAHLPVIWATQVLESLAKSGLPSRAEISDAAMGERAECVMLNKGPHIVDAVVVLDDILRRMNEHHYKKNALLRQLRSWRPDATE

SEQ ID NO: 49344 - protein, 446 aa, Escherichia coli
MILEHDSVLERYPRIQKVLNSTVPTLSLNSSTRYEGKITNIGGTIIKARLPKARIGAFYKIEPSQRLAEVIAIDEDEVFLLPFEHISGMYCGQWLSYQGEEFKIRVGDELLGRLVDGIGRPMGSNITAPYLPFERSLYAEPPDPLLRQVIDQPFTLGVRAIDGLLTCGIGQRIGIFAGSGVGKSTLLGMICNGASADIIVLALIGERGREVNEFLALLPQSTLSKCVLVVTTSDRPALERMKAAFTATTIAEFFRDQGKNVLLMMDSVTRYARAARDVGLASGEPDVRGGFPPSVFSSLPKLLERAGPAPKGSITAIYTVLLESDNVNDPIGDEVRSILDGHIVLTRELAEENHFPAIDIGLSASRVMHNVVKSEHLRAAAECKKLIATYKNIELLIRIGEYTMGQDPGADKAIKNRKAIQSFIQQSTKDISSYEKTIESLFKVVA

SEQ ID NO: 49345 - protein, 332 aa, Ralstonia solanacearum GMI1000
MTIKIGINGFGRIGRMVFRAAIANFKDIEVVAINDLLEPDYLAYMLKYDSVHGRFDGEVSVDGNTLVVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKAASYDEICAEMKAQSQGALKGVLGYTEDKVVATDFRGDARTSIFDAEAGIALDGTFIKVVSWYDNEWGYSNKVLEMARVVAK

SEQ ID NO: 49346 - protein, 548 aa, Debaryomyces hansenii CBS767
MISRSIRLRVNKQLLQRSKVELKNFKSTISLTSTTTDYPTNHYDAKEPYLTPTFINNKFIKSDSQTWFDIHDPATNKVILKVPQSTSEELEEAIASAQSAFEEWKDYSIIKRQSIAFRFVELLKANQKRIAAIIVSEQGKTFPDAMGDVLRGLQVAEAACNIPNDMMAQSLEVARDMETKMVREPLGVVGSICPFNFPAMVPLWSLPLVLVTGNTAVIKPSERVPGAAMILAELCEQAGVPPGVVNMVHGKHDTVNKIIEDPRIKAITFVGGDKAGKYIYEKGTKLGKRVQANLGAKNHLIVLPDADKNQFINAVSGASFGAAGQRCMAISVLVTVGKETAAWVEDVAKDAAALKVGSGFDSTSDLGPLINPESLTKAKEIIEDSVKQGAKIILDGRNFKHDDAKFHKGNFLGPTILTNVKPGVRAYDEEIFAPVLSVVNVDTFDEAISLVNANKYGNGVSLFTTSGPAAQKFAKNIACGQVGVNVPIPVPLPMFSFTGNKGSFLGDLNFYGKAGITFLTQPKTITSLWKTTPFDDVLKPSTSMPTHD

SEQ ID NO: 49347 - protein, 321 aa, Bacillus cereus ATCC 10987
MAVNEKVELATFAGGCFWCMVSPFEEMEGIIKVVSGYTGGHKENPTYKEVCSETTGHYEAVQITFDANKMPYEELLNIYWRQIDPTDVGGQFHDRGQSYETVIFYHNEEQHKKAEASKEGLARSGRFSKPIATKILPAATFYPAEEYHQGYHKKNEFRYELYRKGSGRDAFIKQHWPKDNAHLKEKLNEMQFYVTQENGTEPPFRNEYWNHKEEGLYVDIVSGEPLFTSLDKFDSGCGWPSFTKPVMSASVKEKMDVSHNMTRTEVRSKEGDSHLGHVFPDGPGPNGLRYCINSAALRFIPKEELEKEGYGDFLILFGNKK

SEQ ID NO: 49348 - protein, 166 aa, Pseudomonas syringae pv. phaseolicola 1448A
MSNHDQKRDEGYIEKLVQVNRVAKTVKGGRIFTFTALTVVGDGKGRVGFGRGKSREVPAAIQKAMEAARRNMIQVDLNCTTLQYAMKSAHGASKVYMQPASEGTGIIAGGAMRAVLEVAGVQNVLAKCYGSTNPVNVVHATFKGLKGMQSPESIAAKRGKRVEEII

SEQ ID NO: 49349 - protein, 509 aa, Candida albicans SC5314
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDGAMFNNYCNDHQ

SEQ ID NO: 49350 - protein, 421 aa, Corynebacterium glutamicum ATCC 13032
MSDFLNADGSLNVDKVREEFPILKRTVRDGKPLAYLDSGATSQRPERVWRAEEHFVLHTNAPVHRGAYQLAEEATDAYEGAREKIAAFVGAEQHEIAFTKNATEALNLVAYTLGDDRSGKYRVQAGDTVVITELEHHANLVPWQELCRRTGATLKWYKVTEDGRIDLDSLELDETVKVVAFTHQSNVTGAVADVPELVRRAKAVGALTVLDACQSVPHMPVNFHELDVDFSAFSGHKMLGPAGVGVVYAKSPILDELPPFLTGGSMIEVVTMEGSTYAAAPQRFEAGTQMTSQVVGLGAAVDMLNEIGMEAIAAHEHALTAYALEKLTAIKGLTIAGPLTAEQRGGAISFGVEGIHPHDLGQVLDDQGVNIRVGHHCAWPVHRSMNVQSTARASFYLYNTFEEIDRLAAAIEKAKQFFGVE

SEQ ID NO: 49351 - protein, 565 aa, Yersinia pestis CO92
MELEYESKRPLYIPYAGPILLEFPLLNKGSAFTNDERNHFNLHGLLPEAVETIEEQAERAYRQYQDFKNDDDKHIYLRNIQDTNETLFYRLLEAHLSEMMPIIYTPTVGEACEHFSDIYRRARGLFISYPNREHIDDMLQNATKQNVKVIVVTDGERILGLGDQGIGGMGIPIGKLSLYTACGGISPAYTLPVVLDVGTNNPQRLNDPLYMGWRHPRISGDEYYAFVDEFIQAVKRRWPNVLLQFEDFAQKNATPLLNRYRDELCCFNDDIQGTAAVTLGSLIAASHAAGSQLRDQTVTFLGAGSAGCGIAEQIIAQMMSEGLSEIQARARIFMVDRFGLLTDKLPNLLDFQSKLVQKSDDLHHWNLHNDAISLLDVVRNAKPTVLIGVSGQPGLFTEELIREMHSHCARPIVMPLSNPTSRVEARPEDIINWTDGAALVATGSPFPPVSYKEKLYPIAQCNNSYIFPGIGLGVLASGASRVTDGMLMAASRALAESSPLARHGEGALLPNIDDIQAVSKAIAMRVGQAAQLQGVAIVTSEEALSKAIEHNYWQPQYRSYKRTSF

SEQ ID NO: 49352 - protein, 405 aa, unidentified eubacterium SCB49
MSFDIKKIREDFPILKRKVNGAPLVYLDNAATSQKPQQVIDCIVDYYSNYNANIHRGVHTLSQEATDAYEKARKTLQQHFNAAQVHEVLFTSGTTEGINLVASGFSEILKPEDEIIVSALEHHSNIVPWQMLCEKTGAKLKVIPMCEDGSLQMDVYDTLLNDKTKLVFVNHISNALGIINPIETIIEKAHQVGAAVLIDGAQACSHIKADVQALDVDFYVTSAHKMCGPTGVGMLYMKEDWGKKLPPYQGGGEMIATVTFEKTTYAEMPHKFEAGTPNICGGIAFGAAVDYLNEIGFDAIKKQEAALLDYATAQLLQIEGLKIYGTASEKTSVISFNVGEIHPYDIGTILDKLGIAVRTGHHCAQPIMDFYCIPGTVRASFAFYNSIEEVDALVHAVKKATMMLS

SEQ ID NO: 49353 - protein, 209 aa, Corynebacterium diphtheriae NCTC 13129
MNNNGMQMPQARYVLPSFIEQSAYGTKETNPYAKLFEERIIFLGTQVDDTSANDIMAQLLVLEGLDPDRDITMYINSPGGSFTSLMAIYDTMQYVRPDVRTVCLGQAASAAAVLLAAGAPGKRACLPNSRVLIHQPATQGTQGQVSDLEIQAKEIERMRTLMEQTLARHTGRSAEQVRIDTDRDKILTAEEAVEYGIVDQVFDYRKLNG

SEQ ID NO: 49354 - protein, 175 aa, Triticum aestivum
  misc_feature (35)..(35): Xaa can be any naturally occurring amino acid
MAPTVMASSATTVSPFQGIKSTAGLPVNRRSGSAXLSSGSNGGRIRCMQVWSIDGIKKIQTLSYLPPLSTEALLKQVDYLIRSKWVPCLEFSKVGFFFREHNSSPGYYDGRYWTMWNLPMFRCTDATQVLNKVKEAKNEYPDAYVRVIGFDNMRHVQCVSFVAFWAPGCEESGQA

SEQ ID NO: 49355 - protein, 199 aa, Corynebacterium diphtheriae NCTC 13129
MTDQIRMAQASAGMNLSDSVYERLLRERIIFLGTQVDDEIANKLCAQILLLSAEDPTRDISLYINSPGGSVTAGMAIYDTMKYSPCDIATYGMGLAASMGQFLLSGGTKGKRFALPHARIMMHQPSAGVGGTAADIAIQAEQFAQTKREMAELIAEHTGQSFEQITKDSDRDRWFTAQQAKEYGIVDHVIESAQGPLSN

SEQ ID NO: 49356 - protein, 444 aa, Kluyveromyces lactis NRRL Y-1140
MSEEREPLLDGQDGKGQLSANTNVSRREAGVNSTASGSSGGKYIPNTNSATETANVARKPQQQQENTILDPLLPKVSTKVGPQRTSRKAQKLKLLPDEAFERINEDDAPQDRDVYSQVNRITDKPARRDAEKLGKNQRHLLPRVTAYCTASLYKMKELIRWLKDCKRFNHTHPKLFDECLYTPFIYTDWRGDKRFEHEDVIRLDDEGGEISTSDKQPDLFIFEYGVIVMWGFTEREEKAFLRDLERFEKEKLAEEDVQVEQFNYYITQSYQPRIYNDFITLRDGSNYMIKLSISHAIAQSVKISLFEELVDNTIEDTQDIPQEIASSGKVSMSKEDIMKSIGELFILRININLHGSVLDSPEIMWSEPQLEPIYQATRGYLEINQRVALVNQRLEVISDLLQMLKEQLGHSHEENLEFIVILLVGVEVLVSVVNIIVDIVADKR

SEQ ID NO: 49357 - protein, 344 aa, Leifsonia xyli subsp. xyli str. CTCB07
MSWRMPAETAPHERTWIAFPRAGITLGENAASAEEAYAAWTAAAHAVAEFEPVAMVVDPSESERAARMLGSHIDQVEAPLDEFWMRDVGPTFVVDDERPGVLGAVDWTFNGWGGPAWSQWRASAEIARFVAERIGAELISSALVNEGGGIHVDGEGTVLLTETVQLDPRRNPYAGKARVEAELARTIGATHAVWLPRGLTRDYGEFGTNGHVDIVTAIPSPGRLLLHTQRNPGHPDFAVSRELRAFLAGTTDAAGRPWEIVELPAPETLRDEEGFVDWSYVNHLMVGDGIVACGFGEGRANAEAAAILEAAYPGRRVTMVDSRPIFARGGGIHCITQQQPAVAA

SEQ ID NO: 49358 - protein, 425 aa, Rhodospirillum rubrum ATCC 11170
MAEIIDIHAREILDSRGNPTVEVDVLLDSGAFGRAAVPSGASTGAHEAVELRDGDKTRYAGKGVLKAVEAVNGELFSALSGLDATDQLLIDQAMIDLDGTPNKARLGANAILGVSLACAKAAAEEAELPLYRYIGGARSHILPVPMMNIINGGQHADNPIDVQEFMIMPVSAPTVADAVRMGAEVFHALKKKLKDAGHNTNVGDEGGFAPNLASADEALAFIVKAIEAAGYKAGEDIVLALDAASSEFYKDGKYVLAGEGKTLDAEGMVKYYAELCKRYPILSIEDGCAEDDWAGWSLLTAELGAKVQLVGDDLFVTNPLRLAEGIRKGVANSILVKVNQIGTLSETLEAVEMAHKAGYTSVLSHRSGETEDSTIADIAVATNCGQIKTGSLSRSDRLAKYNQLIRIEEELGPVAVYAGASILRG

SEQ ID NO: 49359 - protein, 92 aa, Vitis vinifera
MAMRNFYNEIRGLKVKELPAHVKPMFTIDYIKKSINKGLDNYHAKYIQTSSIDPLLHVCYGGIIFSYLVALPEERRHLEHQQHAKEHGGSGH

SEQ ID NO: 49360 - protein, 127 aa, Listeria monocytogenes
MGIAVLGGAGYIGSHAVNELITRGYEVVVIDNLRTGHRESIHKKAKFYEGDIRDKAFLSSVFEKEKVDGVIHFAASSLVGESMEVPLDYLNNNVYGTQIVLEVMEEFDVKHIVFSSSAATYGEPERV

SEQ ID NO: 49361 - protein, 252 aa, Rhodospirillum rubrum ATCC 11170
MTVRRPLIAGNWKMNGLKAEGQGLARDLAQRLNKAGGVDFDLLLCPPFPLISTVVGAVAGSGIAVGGQDCHAKAKGAHTGDVSAPMLADLGCQFVIVGHSERRADHGETDALVKAKAEAALAAGLIAVICVGETEAQRDAGETLAVVSGQLAGSLPTHADSGKVVIAYEPVWAIGTGRVPTTEDVAKVHGALRKDLVGALGADGNGVRLLYGGSVKPDNAAELMALENVDGALVGGASLKAEDFWAIAQSCA

SEQ ID NO: 49362 - protein, 102 aa, Chlamydophila caviae GPIC
MVKVVSAENFNSFIATGLVLIDFFAEWCGPCKMLTPVLESLEAEVSSVLIGKVNIDDHPAPAEQYGVSSIPTLILFKDGKEVDRVVGLKDKDSLIRLINQHS

SEQ ID NO: 49363 - protein, 556 aa, Corynebacterium efficiens YS-314
MAEFIYTMRNVRKVIGEKVILDDVTMAFYPGAKIGVVGPNGAGKSSILKIMAGLDQPSNGDAFLDPGATVGILLQEPPLNEEKTVRQNVEEGLGEIFEKKQRFEAIAEEMATNYTDELMEEMGVLQEALDAADAWEIDSKIEQALEALRCPPGDEPVTHLSGGERRRVALAKLLLSEPDLLLLDEPTNHLDAESVLWLEKHLADYKGAVLAVTHDRYFLDHVAQWICEVDRGKLHPYEGNYSTYLEKKSERLEVAGKKDQKLQKRLKDELAWVRSGAKARQAKNKARLQRYEEMVAEAEKYRKLDFEEIQIPTPPRLGNKVVEVENLTKGFDGRTLIKDLSFTLPRNGIVGVIGPNGVGKTTLFKTIVGLEEPDSGKVTVGETVKLSYVDQNRANIDPEKTVWEVVSDGLDYIIVGQNEMPSRAYLSAFGFKGGDQQKPAKVLSGGERNRLNLALTLKQGGNLILLDEPTNDLDVETLGSLENALVNFPGCAVVISHDRWFLDRTCTHILAWEGNISEGQWYWFEGNFEDYEKNKVERLGADAARPSRVTHRKLTR

SEQ ID NO: 49364 - protein, 353 aa, Arachis hypogaea
MDLINSVLNLFVPPASLITLAFSWPALCFPHACEWLYNTVYGDNMDGKVVIITGASSGIGEQIAYEYALRRACLVLVARREHRLRGIAENARRMGARHVMIVAADVVKEDECRRFVNETINFYGRVDHLVNTVSLGHTFYFEEVTDTSVFPVLLDINFWGNIYPTLVALPYLHRTNGRVIINASVESWLPLPRMSLYAAAKAALVNFYETLRFELRDEVGVTIATHGWIGSEMTSGKFMLEEGAEMQWKEEREMNVIGGPVEEFARLMVAGACRGDAYVKYPSWYDVFLLYRVFAPNVLNWAFRLLIAPQGTKRTSSYVGTGRSLEGRPMLEAPSPRTALLAPYSFSGGGQLS

SEQ ID NO: 49365 - protein, 479 aa, Bradyrhizobium sp. BTAi1
MFIDGRWVGALGGATFDVLDPATGETIDSVPEAGPADVDAAIRSAEMAFQAWKATPVAERARLQKAAARLMRENAEQLGRLLTRELGRPLAGAITEIQRSAELLDVYAEEGLRLHAEMPLTGVAGEKIIITREPAGVVIAITPFNYPVTLLCFKLGAALMAGCTVVAKPAEDTPLSTLRLAELFRKAGYPTGCFNVVTGRGPDVGMQMIAHPTPRKIAFTGGTQAGKAIAAAAAGTMKRVTLELGGQCPAIVCADADIGAASAAIARHAFANSGQFCYRVNRVYVERPVYTRFLDALADRVLQLDVGNGLTSTCALGPLVNEKIYRNSDRQIADARASGATILTGGARLTGGLYDKGWFLPPTVIADAGPSSLIMTEETFGPVLGVAPFDHHSEALRLANATIYGLAAFVFSRNLATGLTLAERLEAGSVWINDIQRSNQRAPFGGMKQSGIGREKGRYGVEDYLEYKTIYLTYDAELR

SEQ ID NO: 49366 - protein, 337 aa, Bradyrhizobium sp. ORS278
MTSKRPAPDLSKPRLTTSAMIASIASEGQRTKPAPFGHALVELARSRPEVVGMTADLGKYTDLHIFAKEFPDRTYQMGMAEQLLFGAASGLAAEGFMPFTTTYAVFASRRAYDFIHQTIAEEDRNVKIACALPGLTSGYGPSHQAAEDLALMRAMPNMTVIDPCDAHEIAQVVPAMAAHQGPVYMRLLRGQVPLVLDEYDYKFELGKAKLLRDGRDVLFISSGLMTMRALEAATALSDDHVDVAVLHVPTIKPLDAETIAREAGRSGRLVVVAENHTVIGGLGEAVAGVLMRAGVHVPFRQIGLPDEFLDAGALPTLHDRYGISLSEVVKQVKGWLK

SEQ ID NO: 49367 - protein, 265 aa, Ralstonia solanacearum GMI1000
MTAPPTSFPPRLAGKVALVTGATQGIGAATARLFARHGARVIVNALVRDAAAEAFAASIGHDGNVLLVQADVRYRDQADAMVAAGVARFGGIDVLVNNAGINVFSDPLALSEADWARCLSVDLEGAWHCARAVLPHMLARGAGSIVNIASVHGHKIIPGAFPYPVAKHGLIGLTRALGIEYAARGIRVNSISPGLILTPIAEAGFAAAPDPEAERRRQADLLPCKRIGEPEEVAYTALFLASDEARFINAADILIDGARSQLYHE

SEQ ID NO: 49368 - protein, 216 aa, Brassica napus
MLCRMVVVNGRKKKPGLVPVYLNVYDLTPINGYAYWLGLGVYHSGVEVHGVEYGFGAHEHSTTGIFEVGPKQCPGFTFRKSILIGRTELDPQQVCAFLEKLAEGYCGNTYHLITKNCNHFCNDVCVRLTRRSIPSWVNRLARFGLFCNCVLPAELNETKVRQVRSKEEKIPEVKKLRSRSSRFPPSSSLSSSGSLNRNRRGERRRQRLPPTPPVSA

SEQ ID NO: 49369 - protein, 259 aa, Glycine max
MEELEQWKEQLSHFANLALDRLREVPPNQLYAAAAIAIFTTLLLLSIRLFKRAKSNTIVLTGLSGSGKTVLFYQLRDGSTHQGTVTSMEPNEGTFILHNEKTRKGKIKPVHVVDVPGHSRLRPKLDEYLPQAAGVVFVVDALDFLPNCRAASEYLYDLLTKGSVVRKKIPMLILCNKTDKVTAHTKEFIRKQMEKEIDKLRASRSAISAADIANEFTLGVPGEPFSFTQCSNKVTTADASGLTGEISQLEEFIREHVKR

SEQ ID NO: 49370 - protein, 186 aa, Zea mays
MGSGSFLKVLAKNFDVLAGPLISLAYPLYASVRAIETKNPVDDQQWLTYWVLYSFVTLFELTFAPIIEWLPFWSYAKLFFNCWLVLPWFNGAAYVYDHFVRPMFVNRRIVNIWYVPRNEKLGKSDDVLSAAERYIEQNGPEAFEKLISKSTKSSKSRSTKRSILEEAEAERESWGENPFYDKNYRH

SEQ ID NO: 49371 - protein, 189 aa, Pseudoalteromonas tunicata D2
MNTTLINTKLKTFKATAYHNGDFKALTEQDLLGKWSVVFFYPADFTFVCPTELGDLADNYAKFQELGVEIYSVSTDTHFAHKAWHDSSDTIGKVQFPMIGDPTGTITRNFGVMIEEDGLALRGTFVMNPEGEIKIVETHDLGIGRSATELLRKIQAAQYVASHDGEVCPAAWQPGEETLAPSLDLVGKI

SEQ ID NO: 49372 - protein, 391 aa, Glycine max
  misc_feature (358)..(358): Xaa can be any naturally occurring amino acid
MGRGLGVVLVLLAVYCGLDPFQHSPIAHFPDFEVKRVDMPAWSEVPTDQDKHNLLQKSEIKFANQVQGPESIAFDPLGRGPYTGLADGTIVFWNGHSWLHFAYTSPNRSEICNPIASATPFSYVKNEHICGRPLGLRFDKKTGDLYIADAYFGLLKVGPEGGLATSLVTEAEGIPLRFTNDVDVDTEGNVYFTESSALYPRRNFLQLVFSGDDSGRVLKYNLATKETTVLVRNIQFPNGISLSKDGSFFVFCEGVVGRLRKYWLKGEKAGTSEILAILPGYPDNVRVNEDGDFWVALHSRRYMYAYYNGIYPKMRKIILKLPIPIKIHYLLQIGGRQHAAVIRYSPEGKLLQILEDSXGKVVKAVSEVEEKDGKLWMGKCLMPFVAVYNLK

SEQ ID NO: 49373 - protein, 554 aa, Arabidopsis thaliana
MKKKQQKQEFVAETSEMNNNNECSGQDQQKRYVWPWVGLVANVPTEVEPSGRRVGKSGSTLRDEFTLKGFNPTRVKPIWNTKGHTGFALVEFAKDFKGFESAMQFEKSFDLDRHGKRDWKKGHRLRDDKLYGWLAREDDYNRSDTVGKNVKKKRDLKSISQIVEEDQRKLYHLFENMCQTIEKNKQRKQQLEQKVDETLESLEFHNLMLNNSYQEEIQKMEKNMQEFYQQVLGGHEKSFAELEAKREKLDERARLIEQRAIKNEEEMEKTRLEREMIQKAMCEQNEANEEAMKLAEKHQKEKEKLHKRIMEMEAKLNETQELELEIEKLKGTTNVMKHMVGCDGDKDIVEKIAKTQIELDARETALHEKMMTLARKERATNDEYQDARKEMIKVWKANEELMKQEKIRVKIMGELNPAPFLPAVMNKHKAMMLCSVWAAEIGDVQWTPFRVDESDGTPKQKLHISQHSKCEMQRVVDENDEKLRMLKNQYGEEVYSEVVRAKLEMEEHNASGSYETEELWNYEENRKATIEEITDVMLKIRSKLAAMKNKRKRP

SEQ ID NO: 49374 - protein, 386 aa, Rickettsia akari str. Hartford
MNIHEYQAKEILRKYGVPTSTGLVVTKTEKINETIDKLNTEVYVVKAQIHAGGRGKAGGVKVVKSKEEAKKVAHDMFGINLVTHQTEPQGQKVNCLYIESGCDILKEYYFSIVFDRSASCITFIASTEGGVDIEEVAAKTPAKIIKFSVDPATGLQDFHMRGIAYELGFKDNQAKQMKEIVKSVYNAFVETDAAQIEINPLIVQTDGNLLALDAKITFDDNGLFKHPNITAMRDHDEEDPLETRAANAGLSYVKMGGNIGCMVNGAGLAMATMDIIKLYGASPANFLDVGGGADRERVKEALKIILSDKEVQGILVNIFGGIMRCDIIAEGIIAAAKDIGIKVPLVVRLAGTNVEKGEEILSNSGLDIIPAHDLADAANKIVAAIR

SEQ ID NO: 49375 - protein, 248 aa, Magnetospirillum magnetotacticum MS-1
  misc_feature (183)..(183): Xaa can be any naturally occurring amino acid
MTSGPVPVPLDDVRDAARLLDGVAYRTPVHTTRAISEAAGVRVLLKCENLQRAGSFKVRGAYVRMARLSADEKARGVVAASAGNHAQGVAFAAGLLGIRAVVYMPVDAALPKVAATRQYGAEVRLVGADVDETLAAARAEADRTGAVFIHPFDHPDVVAGQATIALEILEQVPDVRTVVAPLXAAAGSSPGSPRRSPRPRRTCASSGCRRSVPRPTRARSPRESRRRPGSPGRWPTHRGRDPGCVLQI

SEQ ID NO: 49376 - protein, 328 aa, Corynebacterium glutamicum ATCC 13032
MVSVGTMKAILVSRTGGPEVLEFTDTDAPKPTDDQVLVEVDMAGVNFIDTYYRQGEYHARLPFIPGFEGTGRVLEDPQGLIAAGTKVAWCDAMGSYAQQVCVPRDRLVAVPEGVSSEVAASMLMQGITAHYLTNGVYELEEGDSCLITAGAGGVGLLATQMAAAKGVRVYSVVSTDEKAELALDAGAYEVFRYSDNLAEQVRRHNGGRGVDVVYDGVGQSTFNESLEAVRPRGTVCLFGAASGPVEPFDPQLLNTHGSIFLTRPSIGAWTSEEGEFAKRAQAVTQAIVEGTLRVRVTGTYSLADAYIAHRDLQARSTSGSLVLEIPKD

SEQ ID NO: 49377 - protein, 117 aa, Hordeum vulgare subsp. vulgare
KHMIEDDCADNGIPLPNVNSKILSKVIEYCNKHVQAKPADAAGPGASDALPPADDLKNWDAEFVKVDQATLFDLILAANFLNIKGLLDLTCQTVADMIKGKTPEEIRKTFNIKNDFS

SEQ ID NO: 49378 - protein, 413 aa, Podospora anserina
MGDLQGRKVFKVFNQDFIVDERYTVTKELGQGAYGIVCAAVNNQTNEGVAIKKVTNVFSKKILAKRALREIKLLQHFRGHRNITCLYDMDIPRPDSFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQNYTKAIDVWSVGCILAELLGGRPFFKGRDYVDQLNQILHILGTPNEETLSRIGSPRAQEYVRNLPFMAKKSFPSLFPNANPDALDLLDRMLAFDPSRRISVEEALEHPYLAIWHDASDEPDCPTTFNFDFEVIDDVNEMRKMILSEVVNFRAQVRTVPGQAGSAGNIQQAPSNVPIPAGGPGQQWTAEDPRPMEYGNQMQGLEAELGGR

SEQ ID NO: 49379 - protein, 370 aa, Yersinia pestis CO92
MSEKSPEQTTPGLLQSQILKVLTAFTHPTLQKDLNTLRAIHHCALLDNVLHIELVMPFAWQFGFEILKESVSEELLAVTGANAIDWKLSHNITTLRRANDQPGVKGVRNILAVSSGKGGVGKSSTAVNLALSLAEGGVKVGILDADIYGPSIPNMLGTMNQRPTSPDGKHMAPIMAHGMATNSIGYLVTEENAMVWRGPMASKALMQMLQDTLWPDLDYLVIDMPPGTGDIQLTLSQNIPVTGALVVTTPQDIALIDAMKGIVMFEKVHVPVLGIVENMSMHVCSNCGHLEPIFGTGGAEKLAEKYHCKLLGQIPLHISLREDLDRGEPTVVSRPDSEFTDIYRQLAANVAAEMYWQGEAIPTEISFRAV

SEQ ID NO: 49380 - protein, 514 aa, Corynebacterium glutamicum ATCC 13032
MSTNTTPSSWTNPLRDPQDKRLPRIAGPSGMVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAARDVIQNHLIQLLALVAMEEPISFVPAQLQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 49381 - protein, 124 aa, Vicia faba var. minor
  misc_feature (65)..(65): Xaa can be any naturally occurring amino acid
MASTKKITLKSSDGEAFEVDEAVALESQAIKHMIEDDCADSGIPLPNVTSKILAKVIEFCKKHVXAAASDDKPTEDELKAWDADFVKVDQVTLFDLILAANYLNIKNLLDLTCQTVADMIKGKT

SEQ ID NO: 49382 - protein, 213 aa, Yersinia pestis CO92
MTDKAHQCVIIGIAGASASGKSLIASTLYRELREQVGDQHIGVIPEDGYYKDQSHLSMEERVKTNYDHPSAMDHNLLLEHLQALKAGKPVELPLYSYTEHTRKKETVHLEPKKVIILEGILLLTDIRLRQEMNFSIFVDTPLDICLMRRMKRDVNERGRSMDSVMAQYQKTVRPMFLQFIEPSKQYADIIVPRGGKNRIAIDILKAKISQFFE

SEQ ID NO: 49383 - protein, 515 aa, Podospora anserina
MSKPQPPNLTLEFPSPQPSPGSSVPKMNSVPLLRPALPGGNRSGGRAPRLGLAIPPSPNAKPLSNPGPAPGRPALPTLHLATPMGSSSVVPQEQPQHIKPALSLQSASGGSESSAAHSRSGSFGPFDGRASNPTSAGSQFSALSFAEQYGIGPTRHAGTGDPVSAVGSLYSNASESVGMERENSLHGLESFDKLSLDKARSADVEDLDDEGWRIVSMEKRIVELGSLGEGAGGAVTRCKLKGGNTVFALKVITTNPDPDVKRQIVRELGFNKDCMSEHICRYYGAFVDPSTATISIAMEFCEGGSLDSIYKEVKRLGGRTGEKVLGKISEGVLQGLTYLHSKKIIHRDIKPSNILLCRNGEVKLCDFGVSGEFGTKGDANTFIGTSYYMAPERITGQSYTITSDVWSTGVTLLEVAQHRFPFPADGTEMQPRAGLIDLLTYIVRQPIPKLKDEPEASIFWSDSFKYFIECCLEKDPLRRATPWRMLEHPWMVEMKTKRVNMSKYLTQVWGWDDKK

SEQ ID NO: 49384 - protein, 379 aa, Petunia x hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHKLPFAQINKAFDLMLKGEGLRCIINMED

SEQ ID NO: 49385 - protein, 648 aa, Glycine max
TLIARSLLGQNKFDRCFTRPSTFLIQTHIFVVISFSAFPNSSQRFTKPFQRLCFSMATSPKDTSSPGSPSVPSSPSSTKAPSNQEQPEFHIQPIQMIPGQAPVPEKLVPKRQQGVKISENPSIATSPREVDTEMDKKIRSIVSSILKNASVPDADKDVPTSSTPNAEVLSSSSKEESTEEEEQATEETPAPRAPEPAPGDLIDLEEVESDEEPIANKLAPGIAERLQSRKGKTPITRSGRIKTMAQKKSTPITPTTSRWSKVAIPSKKRKEFSSSDSDDDVELDVPDIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCVRFSPAVINKYLGRPTEGVVDIAVSEHQIAKEITAKQVQHWPKKGKLSAGKLSVKYAILHRIGAANWVPTNHTSTVATGLGKFLYAVGTKSKFNFGKYIFDQTVKHSESFAVKLPIAFPTVLCGIMLSQHPNILNNIDSVMKRESALSLHYKLFEGTHVPDIVSTSGKAAASGAVSKDALIAELKDTCKVLEATIKATTEKKMELERLIKRLSDSGIDDGEAAEEEEEAAEEEEDAAEDTESDDDDSDATP

SEQ ID NO: 49386 - protein, 556 aa, Corynebacterium diphtheriae NCTC 13129
MGEFIYTMKNVRKAIGEKLILDNVTMAFYPGAKIGVVGPNGAGKSSILKIMAGLDQPSNGEAFLDPGATVGILLQEPPLNEEKTVRGNVEEGLGGIFEKKQRFEQIAEEMATNYTDELMEEMGRLQEELDHADAWEIDSKIDQALEALRCPPSDEPVTHLSGGERRRVALAKLLLSEPDLLLLDEPTNHLDAESVQWLEKHLADYKGAVLAVTHDRYFLDHVAGWICEVDRGKLYPYEGNYSTYLETKAARLEVAGKKDQKLQKRLKEELAWVRSGAKARQAKNKARLQRYEEMAAEAEQYKKLDFEEIQIPTPPRLGNQVVEVEHLDKGFDGRVLIKDLSFTLPRNGIVGVIGPNGVGKSTLFKTIVGLEQPDGGEVKVGQTVKLSYVDQNRENIDPEKTVWEVVSDGLDYIHVGQNEMPSRAYLSAFGFKGPDQQKPSKVLSGGERNRLNLALTLKQGGNLILLDEPTNDLDVETLGSLENALQKFPGCAVVISHDRWFLDRTCTHILAWEGNVAEGQWFWFEGNFEDYERNKVERLGADAARPSRVTHRKLTR

SEQ ID NO: 49387 - protein, 371 aa, Aspergillus oryzae
MPSGSVLVTGGTGYIGSFTALALLEAGYKVVVADNLYNSSAEALRRIELISGKKAEFAQVDVTDEAAFDKVFEAHPDIDSVIHFAALKAVGESGEKPLDYYYVNVYGTLNLLRSMVRHNVYNIVFSSSATVYGDATRFPNMIPIPEECPLGPTNPYGNTKFAVETAITDVINAQRNNAAKAGNEEESKKWNGALLRYFNPAGAHPSGIMGEDPQGVPYNLLPLLAQVATGKREKLLVFGDDYKSHDGTAIRDYIHILDLADGHLKALNYLRANNPGVRAWNLGTGRGSTVYEMVRAFSASVGRELPYEVAPRRAGDVLNLTANPTRANTELGWKAERTLEQACDDLWRWTKNNPQGYRQEPPAELLEQLKK

SEQ ID NO: 49388 - protein, 113 aa, Vicia faba var. minor
KHMIEDDCADETGIPLPNVTSRILAKVIEYCKKHVEAPKIDEYGMPVDGKDMKKWDAEFVKVDQDTLFDLILAANYLDIKSLLDLTCKTVANMMDGRTPDEIRRTFNIKNDFT

SEQ ID NO: 49389 - protein, 497 aa, Kluyveromyces lactis NRRL Y-1140
MAGITGITPEFKNSDLIRKGAFVDGQWLETASETFNVTDPATLEVIATLPDQSIEVIHEAIDSAAEAFRLFKKTTPKTRSTWLRNLYNLMMENVDDLAKIITWENGKALSEAQGEVKYAASYFEWYAEEAVRMYGTTIQPNNGSNRAFTVRQPVGVCGIICPWNFPSAMITRKAGAALAAGCTVVVKPDSQTPLSALALAHLAEKAGFPKGVFNVVLTATRTPEFGLALCESPKVKKISFTGSTNVGKILMKQSASTMKKLSFELGGNAPVIVFDDADLEQAVTQTILSKFRGLGQTCVCANRIYVQRTIIDSFAEKLAKQVNEFVIGHGLDSKTTHGCLINENAIKKVEAHVKDALEKGAKTVVAGGRLPELGPNFYAPTVLSHVPSTAVVNKDETFGPLCALIPFDTMEEVVGYANDTELGLASYVFSKNIDTVYTVAEALETGMVSCNTGLFSECTIPFGGVKESGFGREGSLHGIEDYTVIKTITIGNLPAPL

SEQ ID NO: 49390 - protein, 243 aa, Campylobacter jejuni subsp. jejuni NCTC 11168
MLYILANGSMATALAYGLKDDYEICIVGRSIEKLQALAKEGFKTLLYKDFNIEGKDVILAFKPYALENIAQMLKGQARILISVLANVDFEKLQTIKAQNYVRIIPNTAAKYKASTTPYILKNSHFENEILDILKTFGSAYKLDNEIQMNAAMAISGCAPAFLALIAESIANAGVYEGLSKELSLNLTRSLFKSSNALLEHEHPAIIKENICSPGGVTIKGIKILEQKGIRGSFFEAINASSAK

SEQ ID NO: 49391 - protein, 374 aa, Petunia x hybrida
QVIRCKAAVAWEAGKPLVIEEVEVSLLQKMEVRLKILYTSLCHTDIYFWEAKGQNPVFPRILGHEAAGIVESVGEGVTELVPGDHVLPVFTGECKNCAHCKSEESNMCSLLRINTDRGVMIHDDQSRFSINGKPIYHFVGTSTFSEYTVVHVGCVAKINPLAPLDKVCVLSCGISTGLGATLNVVKPTKGSSVAVFGLGAVGLAAAEGARIAGASRIIGVDLNASRFELAKKFGVTEFVNPKDYNKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHQLPFSDINKAFDLMLKGEGLRCIIHMEH

SEQ ID NO: 49392 - protein, 349 aa, Arachis hypogaea
MDLIHTFLNLVAPPFTFFFLCLFLPPYWGLKFMVSILSWLLSENVAGKVVHITGASSGIGEYLAYEYAKRGACLALSARRETALHQVADTARHLGSPDVIVMRADVSKPEDCMRLIDQTVNHFGRLDHLVNNAAISIATLFEETPDISNLRPIMETNFWGSVYTTRYALQHLRKSRGKIVVMSSVDSWLPAPRRHIYSASKAALVSLYETLRVEVGSEIGITIVTPGYIESEITKGKFLSAQGEVDVDQDLRDVEVSAVPVGSVSGCAESIIKSTLRGDRCLTVPSWFRMTYLIKLLCPELLEWTFRLLYLTAPGTPTSDALSKKILDATGAKNLFYPPSIQSPDVKTD

SEQ ID NO: 49393 - protein, 1049 aa, Streptomyces coelicolor A3(2)
MFIQLLQAACLPGAHGDPPPVLVTLGVRADFYDRCLRYPELADALQHRHMVLGPLTTAELREAVTAPARAVGMELEPGLAELIIREVSTDGPRGGCDSHAFRAVGEHDAGVLPLLSHALLATWQRRKAGRLTLAGYRAAGGIQGAVAATAERAWSGLDPAARTAARLLLLRLIRLSEDTQATRRRSTRRRLAEEARDPDKTEESLEALVRARLVTLDADTVEITHEALLHAWPRLRDWIDEDRAGNLLRQRLEEDGLAWEESDRDSALLYRGSRLAQADGWAKSADDTFLTRSAVEFLAAAVRLRRRTVMISRAAVSALVVLALLAVGSAVLAWQQRNDAVFEQVVAEADRVQDTDPSLSAQLDLAAHRLRPDDEDVRNRLISIVNAPLATPLLGHTGAVYLTSFSPDGRILATASYDRTVRLWDVSDPGRPQQLGKPLTGHTSWVSTAVFSPDGRTLASASDDGTIRLWDVTDPGRPRPLGAPLDGHGGTVYLLAFSPDGRTLASAHDDHAVRLWNVADRRAPEALDTLTGSTGAVRSVAFSPDGDTLASGGDDDKVRLWDVSDPRRPEPAGAPLAGHSGLVHSVAFSPDGHTLASGSADDTVQLWDVTDPAGAKPVGAPLTGHSGPVWAVAFSPDGAMLAVSSADSTASLWNVSDPAYPSQVGVPLAGGSGEMYALGFSPDGHTLATGSGDSKVRLWSLPTSDMIGRIGAFRPDGHVLATAARDGRVRLWDVTDPGRPVSLSAPFEPGDGDIRSLVFSPDGGTLAVLVGGRALQLWDVTDPAGPTAHGPPVALSTRYAGPDTLAFSPDGRTLATAHDDRTIQLWNADDPSRPRRLGKPLAGHSGYVNTLAFSPDGRTLASGGADDAVRLWDVTDPAHATRLGAARTGHLGPVNVLAYSPDGHTLASGSDDGTVRLWDVTEPGEGSGGGTTLAGHTDSVVSLTFSQDGDTLASGANDNTVRLWSVTDPAEAAPIGRAMSPNAKTGNFLSFSPVSHMLGVSSGTDTVRLWSLGVDDAIDRICSATRGVLTEEKWHEYLPRLDYEPPCHQ

SEQ ID NO: 49394 - protein, 579 aa, Ashbya gossypii ATCC 10895
MRAREIFSARRGPAWSGAEPRMDGQDAEAGAPADIVAHADLGVAPAGAGAPSSKFLRFYRAATARSRGASGRRGRASPRRGGAVDSSVDEGATAVPSSRDAAKEESPRRKQPVRVPQTPAKLAAPALEADDSDGFVTARSTPLRSPRRQLTFSSPSKSPRKTRKQDVLLAQVPSFKLDPGFVPAAVPKGYRLPEDRNLTYFFDGFEGYIDQKKPIRAHKKSRNSMAIAPSVSRDEFRLLSGALNGFMHQTPRAVLTGHQQRLFPQYWFEVMQGFTLLFYGIGSKRRFLETLVFEYLSPKLALSGAPEGADVEGVPCVVINGFNPACNYRDCFQSIAAYMLPDELRHAETKYWHNHVHLQIQKMVEHWAAQPPQVQMVVLVHNLDGPMLRKDPFQQMLSSLARIRQIAIVASVDHIHAPLLWYSLRAQLYNFVFHDVTNYEPYAIEAAFQESVRLNRSELQAGSIDAARYVLASLTANSKRLFRLLLETVVANMQSAKRIKLTNSRRAGISFGVPFSAFYQACAAQFVASNEMSLRSMLREFVEHKMAHLAKDKAGQEIVYVNYSFGEMQKLLSDALSSV

SEQ ID NO: 49395 - protein, 386 aa, Exiguobacterium sibiricum 255-15
MNVHEYQAKELLRSYGVPVPNGIAAFTVEEAVDAAEQLSGPIKVVKAQIHAGGRGKAGGVKLAKSQEEVKEFATELLGKTLVTHQTGPEGKVIQRLLVEEGCAIDKEYYLGIVLDRVTGRVVIMGSSEGGMDIEEVAEATPEKIIKEVVDPAVGLQAFQARKLAFAMGVPVKLVNKFVGMVTKLYTFFVDKDCSIAEINPLVTTKDGDVLALDAKLNFDSNALYRHADVVALRDETEEDPREVEASKNDLNYIALDGNIGCLVNGAGLAMATMDIIKHFSGDPANFLDVGGGATKEKVTEAFKLILSDENVKGIFVNIFGGIMKCDVIAEGIVAATKEVGLELPLVVRLEGTNVDAGKQILKDSGLAITAATSMADGAEKIAALVK

SEQ ID NO: 49396 - protein, 283 aa, Solanum tuberosum
MSKDVIEEGQVHHRGKDYVDPPPAPLLDMAELTKWSFYRAVIAEFIATLLFLYVTVATVIGHKKLNKLDQCDGVGILGIAWAFGGMIFVLVYCTAGISGGHINPAVTFGLFLARKVSLIRAVAYIIAQSLGAICGVGFVKLFMKHYYNAEGGGANFVQPGYNKGTALGAEIIGTFVLVYTVFSATDPKRSARDSHVPVLAPLPIGFAVFMVHLATIPITGTGINPARSFGAAVIYGNEKIWDDQWIFWVGPMVGAMAAAIYHQFVLRAGAVEAFGSFRSNQTN

SEQ ID NO: 49397 - protein, 351 aa, Corynebacterium efficiens YS-314
MFYVTWCPLFVSGVPARRESAGKEEERCSMTHVLVLATGGTIASTAGPSGSGAVATEGIDALLNKVEVSGITVSGRNVLTTNSFLLSHRDLRLIVEAVTDALRDEGVDGVVLTHGTDTMEESAYLLDLIHDSDKPVVLTGSQRSNDGIGYDGDINLVDAITVAGAPEARGQGVLIAFAGGIHPARGTRKLHTIDPSPFGGTGPLGYVTGGAVGFHATARRGPALPPPDRGFDDTRVDVVVSHPGADATAARAAVAAGARGVVILGTGAGNGNQEIRSWVAEAVSRDITVGVSFRAVGGPVRPLYGNGGASDLADAGALLLGDLPWPQARILLAHLISIHGIVSSSMVAPYI

SEQ ID NO: 49398 - protein, 308 aa, Listeria innocua Clip11262
MTIVNSITDLIGKTPIVKLNRLPEAGSADVYVKLEFQNPGGSVKDRIANAMIESAEKSGALKPGDTIIEPTSGNTGIGLAMVAAAKGYQAIFVMPETMSIERRKLLQAYGAKLVLTPGPDGMKGAIAKAEELAKENNYFVPQQFHNPANPAVHEETTGPEIVEAFGKDGLDAFIAGVGTGGTVTGVGHVLKKNYPDVKIYALEPEESPVLSGGSPSPHKIQGIGAGFVPDTLDTKVYDGILKVSSEDALETAREVAKKEGILVGISSGATIKAALDLAKELGAGKKVLAIVASNGERYLSTPLYNFED

SEQ ID NO: 49399 - protein, 124 aa, Listeria innocua Clip11262
MDKIYLNELAFYGYHGVLQEETKLGQTFRVSLILGLSTKKAGQSDSVDDTVSYADVYETVKGIVEGTPFKLIEALAEKIASEVLTDYPLLEEITVKLIKPNPPIPGHYDSVAVEIKRKRSDLDG

SEQ ID NO: 49400 - protein, 588 aa, Actinobacillus pleuropneumoniae serovar 1 str. 4074
MSDKKIKGLEWQEKPLSDNERLKTDSNFLRGTILDDLKDDLTGGFKGDNFQLIRFHGMYEQDDRDIRAERLEEKLEPLKFMLLRCRLPGGIIKPYQWIEIDKFAREHTRYQSIRLTNRQTFQYHGVPKGKLQPMHRLLHSIGLDSIATAADMNRNVLCTSNPIESELHQQAYEFAKKISEHLLPRSRGYLDVWVDGKKVESSDDLLKIEDEPILGKTYLPRKFKTAVAIPPLNDVDVYANDLNFIAIQDENGQLCGFNVLVGGGLSFEHGNTKTYPNVAYSLGFVPLEHTLAAAEGVVKTQRDFGNRSDRKNARVRYTVQNMTLDGFRAEVERCMNIKFEPTRPYEFTERGDRIGWVKGIDNNWHLTLFIESVRITDKPEKPLMTGVLELAKVHKGDFRITANQNLIVANVAEQDKAQIEAIARQYGLIQEISKLRENAMSCVSLPTCPLAMAEAERVLPDFISELDKVLSKHNVADESIITRITGCPNGCGRAMLAEIGLVGKAIGRYNLHIGGDRAGLRISRLYKENITLQEIVNEIDQLVARWATERQTNEAFGDFVIRSNIIAPVVNAHIDFWDATKIIPTTII

SEQ ID NO: 49401 - protein, 251 aa, Zea mays
HASAALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 49402 - protein, 314 aa, Solanum tuberosum
MAAANGSSDLSSEMEVDAFRRLFPLRYHEHHLLKSVRPDARKLGSARDTTLALGAVASADGSALAKIGSTTMLAAIKMEVMTPTVECPDEGSIAIEFHMPPICSPLVRPGRPAEAASVISKQLSDTILSSGMIDLKELCLVGGKAAWMAYLDIYCLDADGALFDTALLSAVAAFSHLNIPVVSLNDDGRIVLVSEDTVRLKLEKEPVNTEKRKLKLNSLPFSLTCILHKNYILADPTAEEEPIMETIVTVVLDSSHQLVSLNKPGGPVLSHTSVIQDCIGLARRRAKELQSVLNEAISDMEVGLKCDDYTIHSC

SEQ ID NO: 49403 - protein, 172 aa, Burkholderia sp. 383
MAKMQAKVQADERDDGLREKMISVNRVTKVVKGGRILGFAALTVVGDGDGRIGMGKGKAKEVPVAVQKAMEQARRNMFKVPLKNGTLQHEVHGKHGASAVLLAPAKAGTGVIAGGPMRAVFDVMGVQNVVAKSHGSTNPYNLVRATLDGLRKQSTPADIAAKRGKSVEEILG

SEQ ID NO: 49404 - protein, 353 aa, Triticum aestivum
MGSTADEEACMFALQLGSSSILPMTLKNAIELGLLDTLVAADGKLLSPAELAAKLPSTANPAAPDMVDRMLRLLASYKVVSCTLEEDKDGRLSRRYGAEPVCKFLTPNEEGVSMAPLALMNQDKVLMESWYYLKDAVLDGGIPFNKAYGMSAFEYHGTDPRFNRVFNEGMKNHSIIITKKLLELYKGFNGVGTLVDVGGGIGATVGAITAHYPTIKGINFDLSHVISEAPPFPGVTHVGGDMFQKIPSGDTILMKWILHDWSDEHCATLLKNCYDALPTHGKVMLVECILPVNPEATPKAQGGFHLDMIMLAHNPGGKERYEREFEALAKGAGFGAMKTTYIYANTWVIEFTK

SEQ ID NO: 49405 - protein, 648 aa, Aspergillus nidulans FGSC A4
MRWIPSPGGSMLVSRGLLHKIRPSPSAQLPLSVFPSSSFVFGSRCHSGAAVTQKSRMARFPSQQSRPVHATPHVNHNGPIEQNYDTANPAYIRKYLRTYGLTPPRPESYETQKTRCLAQLALKQTPIDKFLYLSTLRKNNVHLFYRLVTDHLRELTPLIYTPVVGEACQRWSEIYQQPEGMYLSWEDRGNLASVIANWPQPNVEITCITDGSRILGLGDLGINGMGIPIGKLALYTTCAGIRPEATLPLTLDLGTSNKALREDPLYLGSRRDKITPDEEREFLDELMAALTERWPGIVIQFEDFKNPFPALERYQDVYTCFNDDIQGTGAVILGGVINAVKRSGVPCKDQRAVFFGAGSAGVGVAKQIVAFFMREGMTEDEARSCFWLVDTKGLVTADRGDKLAEHKVYFARTDNAGQQFKTLEEVVDHVKPSILMGLSTQGGVFTPEILRKMAEWNTNPMIFPLSNPSSKSECDFETAVTNTDGRVLFASGSPFPTMSFTNSAGETKMYYPGQGNNMYVFPGIGLGTILSKAVKVTDSMIYASGEALSKALTAEEIERGLLYPDLTRIRKVSVVVARNVIRAAQEAKVDRETTLRTMDDETLDAWIKSRMYDPHTEVQSLEREVGSILSTLGAPQQFVNGSSDEAKL

SEQ ID NO: 49406 - protein, 781 aa, Ralstonia solanacearum GMI1000
MTTVDTQPQQPARTDEELKAQQRAALRKAALEYHEFPTPGKISVTPTKPLSNQRDLALAYSPGVAAACEEIVADVSNSFRYTARGNLVAVVTNGTAVLGLGDIGPEAAKPVMEGKAGLFKKFAGIDVFDIEINEKDPQKLVDIVASLEPTFGGINLEDIKAPECFFVERELRKRMKIPVFHDDQHGTAIVVGAGITNALKVVGKDIKQVKLVASGAGAAALACLDLLVDLGLPRENIWVTDLAGVVYEGRTELMDPDKAVFAQKTDKRTLAEVIDGADIFLGLSAAGVLKQDMVKRMADRPIIFALANPNPEIMPELAKEVRPDVIMGTGRTDYPNQVNNVLCFPFIFRGALDVGATTITREMEVAAVHAVAELARQEQSDIVATAYGIQDLSFGPEYLIPKPFDPRLIVKIAPAVAQAAMDSGVAQRPIEDMDAYRQHLQQFVYHSGTLMKPIFSTAKKVPMEHKRIVFAEGEEERVLRAVQVVVDEKLANPILIGRPGVIAHRIERFGLRLREGVDFTIVNPEHDQRFREYWETYYKLMARKGVTPQYAKLEVRRRSTLIGAVMIHKGEADGMICGTVSNTAAHLRYIDQVIGGTNCVYAAMNGLVLPGRQIFLTDTHVNIDPSAEQLAEITIMAAEELCRFGIKPKVALVSHSNFGSSEAPSAAKMRETLAILRERAPQLEVDGEMHGDAALDQKLRDSLVPDSTLTGEANLLVMPNIDAANIAYNLLKTAAGNNIAIGPILLGAKRPVHILTPSATVRRILNMTALTVVDAAAQAQR

SEQ ID NO: 49407 - protein, 433 aa, Desulfotalea psychrophila LSv54
MQEASGNRRPSEMIMAPFGERQNSAYSPLRTFFFVSKQGNISPQDRKMKNGAVIIPAAGSGTRMKLDYPKQYHAVAGTPIIVHTIRAFNKHPCIAKIILVVPQDHLEESKALLQKYQLENISIVTGGARRQDSVLRGLQEVPESIDIVLVHDGARPMVSAELISRCYKGAQQYGAVIAAVPVKDTLKRGAGRIVTGTVDREGLWQAQTPQAARKALLVKAFKENGMRNVTDESTLLEGVGIPVTLIEGSETNIKITRPEDLILAENFLREKKEPMQKIRIGHGFDAHQLVEKRRLILGGVEIPYHLGLAGHSDADVLVHALCDALLGAIGAGDIGRHFPDSSDAFKDIYSIRLLESVMQKVGELNYKIGNADISVICQAPKLAPYLKQMQEIIATSCACQISDINIKATTTEKMGYTGRGEGISCHAVVLLQQ

SEQ ID NO: 49408 - protein, 429 aa, delta proteobacterium MLMS-1
RQSGPAVGGWPRYSARRGARRPGSALGYPAQGRRQDPFSRGGDGRAPLGPVIREYLVSEAMHALGIPTTRALAAVSSGEQVMRERLLPGAVITRVAASHIRVGTFEFFARRGDFASLRTLADYVIPRHYPEINGPEINGPETNGPEIGGAGGHSRYLALLAAVIARQAELVARWMSIGFIHGVMNTDNTTISGETIDYGPCAFLDHYHPETVFSAIDTGGRYAYHMQPRIAQWNLARFAESLLPLLHDDQEQAIALATALLQDFMPRYEKAWLTRMGNKIGLTDPQPDDRKLIEELLAAMADNEVDFTLFFRRLANAVENPTEADGIRPLFNRPEAWEHWAEGWHKRLAADPLPPAERAKRMRSVNPAIIPRNHRIEQAISKATEAADFSDFTKLNQALNHPWEDNPERDRWLAPPAPEERVRQTFCGT

SEQ ID NO: 49409 - protein, 338 aa, Bacillus cereus ATCC 10987
MAILVTGGAGYIGSHTCVELLNSGYEIIVVDNLSNSSVESINRVKEITGKQFKFYKEDVLNQEALDAIFEENAIEAVIHFAGFKAVGESVAIPLTYYHNNITSTLVLCEVMQKHNVKKMIFSSSATVYGIPETSPITEEFPLSATNPYGQTKLMIEQIMRDVAFADREWSIALLRYFNPFGAHESGRIGEDPNGIPNNLMPYVTQVAVGKLKELSVFGNDYPTKDGTGIRDYIHVVDLAKGHVKALEKVLNTTGVDAYNLGTGTGYSVLEMVEAFERVSGKKVPYKITERRPGDVAICFADASKAKRELGWEAKRGLEEMCADSWRWQSNNKNGYLEV

SEQ ID NO: 49410 - protein, 458 aa, Streptomyces sp. FR-008
MPSTCPAPTSIGFRGCPHRRKGRTSRGRRIAVPTRPCGKVRKGHQHAKKWRVSMRGGSVAVVGGSIAGCAAALAASRGGAERITVFERADARLRDRGVGIGVHDARYAELRDAGYMADEMPWAPLNRRVWSVRDGDAEHGRAIGTQPFPFRAYNWGSLWSELRRRVPETATYRAGAKVEAVEQDADGVTVRLADGEPERFDLVIGADGYRSVVREAMYPGTGAAYAGYIGWRGTSPDVSGLPSDGLDAHNITFPGGHCMAYRIPDGSGGHRLNWVLYTAPPRIDGLHPDLRTPTSLPPGRLNAELTEHLRALVAEHFPPFWAAKLLSTPAETTFIQPIYDLDVPHYATDRMVLIGDAASVARPHLGAGSVKALQDATALEAAWVAGESWKEILEGYHAARGPVGTAMVGLARRMGSAQVEETPDWSAMGQAEFDAWWQEQNNGSDRRSGFGGHSLKSR

SEQ ID NO: 49411 - protein, 193 aa, Brassica napus
  misc_feature (177)..(177): Xaa can be any naturally occurring amino acid
MAASLQLYGVQTPGLALSSKRLEFGTKGICNFSVTPTSSSAIFRTVEHSCRNTPLRVSCEAARVDLIERKQTETRSVSGTGKELTCVMKFGGSSVESAERMKEVANLILSFPDERPVIVLSAMGKTTNKLLKAGEKAVTCGVTNVESIEELSFIKELHLRTAHELGVETTVIAQHLXGLHQLLKGISMMKELP

SEQ ID NO: 49412 - protein, 244 aa, Aspergillus nidulans FGSC A4
MSDLPTFRNLTLSRYGNVFIITMQKPPENRLNTWYCQELIRAFRTVEKILGPDSEGAVITRGSDAKFWCTGLELDESDTNPFANSDGFYPLVHTVLDFPFPTIALLTGHTFGGACPFALAHDYRIMNSKRGFFSMPPVNLGLHFDGIGSLPRLKLRPDIAAKMLLEAHRWTGEEALRDGIVHAIADPDEMLDVALEMGRKWAPKAKMGVYAALRAELWGEAIRKFQQISYVHGRLTSTPAKAKI

SEQ ID NO: 49413 - protein, 392 aa, Pseudomonas fluorescens Pf-5
MRYSALTQRIAGEGSAAWDIHYRALALREQGGDVLLLTIGDPDFDTPRPVVQAAIDSLLAGDTHYSDVRGNLALRSCIARCHHQRTGQIVDAEHVVVLPGAQCAVFSVAQCLLDPGDEVLVAEPMYVTYEGVFGACGATVVPVPVRAEQGFRLDPQEVAARISPRTRAMLINSPNNPSGASLSLDDWQVLARLCMEHDLWLVSDEVYGDLLYEGQHLSPGGLPRMGGRTATINSLSKSHAMSGWRVGWVIAPPVLVGHLSNLALCMLYGLPDFIQNAAVVALTRELPELPQMREEYRQRRDLVCTLLGQCPGLRPVLPDGGMFVMVDVRRTGLGAQAFAERLLEGYGVSVLAGEAFGPSVVGHIRIALVLDRERLAEACRRIAQCTAQLLAL

SEQ ID NO: 49414 - protein, 585 aa, Debaryomyces hansenii CBS767
MEPKEVESTNSESIPLSNGVSSRSSTFDDKKEHTKWQSFKDSFKRYEGYEEEEEVDLEKLDDIQKGNIRTAKSPLKRKLKSRHLQMIAIGSSIGTGLFIGSGSALNTGGPLGILIAWALTGSAIFCTIQAMGELAVTFPISGSFNVYASRFIDPSVGFAVAWNYFFQFLVLLPLELVAGSITMTYWITSVNPDVWVLIFYLVVISINFFGVKAYGEAEFVFSSIKVLAVVGFIIVSIVIAAGGAPNGHYVGDRYWHDPGLFANGFKGVSSVFVTSAFSFGGTELVGLTAAETDNPRVTLPRATKQVFWRILMFYMISLTLICFLVPYNSDSLLGASSVDVTASPFVIAINNGGIGGLPSVMNAVILISVISVGSSSVYATSRTLTALAEQGLAPKICGYIDRAGRPLVAIIITNIFGLLSFIAASGKQEEVFNWLLLISGLSSIFTWWSICVAHIRFRRALYVKGRSSDELSFKSQTGVIGSIYGATLNTLVLIAEFWVSLFPLGESPSAEGFFQNYLGFVVLLVFYVGHKIWKNNWILCIRAKNIDVDVGRRETDLEALKQELEEERAILRTKPLYYRVYRFWC

SEQ ID NO: 49415 - protein, 259 aa, Corynebacterium glutamicum ATCC 13032
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 49416 - protein, 202 aa, Vitis vinifera
MSQSLHFVVSSSRSPNLTLPNHSYLKLSPPPSNLRFPVTFARRPISASSSDLDSNSPSKVLVSDNGKGGVLPATSPEYVPPPSDSSSIDVDAVTETDLKENGFRSTRRTKLVCTIGPATCGFEQLEALAVGGMNVARINMCHGTREWHRRVIERVRRLNEEKGFAVAIMMDTEGSEIHMGELGGAPSAKAEVFWIRFLLVWL

SEQ ID NO: 49417 - protein, 452 aa, Hordeum vulgare
MECGLRANVLWDAVDPGGDAFKKEGAEHWKDRRPSNPLLPTDWPIVGMLPSLIANWNNIHEYAAAGLSASGHNLELRCPSATSVRYFVTCCPSNVRHIFTSNFANYVKGEKLAKVLGILGGTIVTADGESWRRQRDTIHHVMTRPRLQASIYGCCRSKLAGGLVPLLNHLADAQASFDMEDLLGRLVFDITVIAVFGRDPCRLTASMPPMHVAAAMDTVMEVAVCRDILPVSFWKTMRWLNIGQERKLAEAEAVLYGFVAESIQRKMEVTTTTGRSTEDDILSHYIHVPSPDPEFLNRGREPTDFLIRTFINFMVAMRDPMGSALSWLVYNLATHPHAMLAIREELAPIAAARKSVGGVVVFEPNETKDLVYQRAAMFESLRLYPIAPLERKEVVADDVLPSGHKVRAGDTILISTYSMGRLECVPRQEHLRGAGDINHRHGGLELRCGGAG

SEQ ID NO: 49418 - protein, 405 aa, Corynebacterium glutamicum ATCC 13032
MAVKTLKDLLDEGVDGRHVIVRSDFNVPLNDDREITDKGRIIASLPTLKALSEGGAKVIVMAHLGRPKGEVNEKYSLAPVAEALSDELGQYVALAADVVGEDAHERANGLTEGDILLLENVRFDPRETSKDEAERTAFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLARFGDKIVLPVDLVAASEFNKDAEKQIVDLDSIPEGWMSLDIGPESVKNFGEVLSTAKTIFWNGPMGVFEFAAFSEGTRGIAQAIIDATAGNDAFSVVGGGDSAASVRVLGLNEDGFSHISTGGGASLEYLEGKELPGVAILAQ

SEQ ID NO: 49419 - protein, 260 aa, Pseudomonas syringae pv. phaseolicola 1448A
MTITLKTPEDIEKMRIAGRLAADVLEMIAPHVKPGVTTEELDRLCHDYIVNEQQAIPAPLNYKGFPKSICTSINQVVCHGIPSDKKLKNGDSLNIDVTVITDGYHGDTSRMFHVGTVPVWAERLSKVTQECLYKAIEIVKPGTRLGDIGAVIQKHAEKNGFSVVREFCGHGIGKVFHEEPQVMHFGEAGTGIELQEGMTFTIEPMINQGRPETKILGDGWTAITKDRKLSAQWEHTLLVTADGYEIFTLRSDDTIAQKAP

SEQ ID NO: 49420 - protein, 336 aa, unidentified eubacterium SCB49
MANKNQTLGEFIIQNQTEFKYSSGELSRLINSIRLAAKVVNHEVNKAGLVDILGAAGDTNIQGEDQQKLDVYANDIFIKTLINREIVCGIASEEEDDFITISGNNNKNKYVVLMDPLDGSSNIDVNVSVGTIFSIYRRVTPEGSPVTIDDFLQPGNRQVAAGYIVYGTSTMIVYSTGHGVNGFTLNPAIGTYYLSHPNMQFPEDGNIYSVNEGNYVRFPQGVKDYIKYCQKEEGDRPYTSRYIGSLVSDFHRNMIKGGIYIYPNNSKNPEGKLRLLYECNPMAYLAEQAGGSASNGFTRILDINPTELHQRVPFFCGSKNMVLKAEEFMKNASPKS

SEQ ID NO: 49421 - protein, 172 aa, Prochlorococcus marinus str. MIT 9313
MDLRHLIQDVPDFPKPGILFRDISPLLRDPDGWDEVMRQLGDLCTELKPDLIVGIESRGFIVGTALATNRKIGFVPVRKPGKLPGDVLGIDYSLEYGSDRLEIHADALQGHPRVLLVDDLLATGGTARATVELIEKAGGDLVGCGFVIELAALGGRQQLPVEIPVKSLIIYS

SEQ ID NO: 49422 - protein, 331 aa, Oryza sativa Japonica Group
MKVKAIRVHKIGGPEVLTWEEVEIGEPSEGEIRIKNKAIGVNYVDIYYRTGLHQEPLPFVPGKEAVGVVSAVGPGVTGIEVGDVVGYADTPMGTYTEEQIIPATLAIPIPPSVDHITAASVLLKGMTTYVLVKQAFKIQAGHTVLVHAAAGGVGSLLCQWANALGATVIGTVSTQEKAIQAAEDGCHHVIIYTEEDFVAQVAEITSRKGVHVVYDAVGKDTFKGSMECLMPRGCMISYGQCSGRPDPVPVSDLASKSLILGRPGMRHYTATRDELLHAAGEVFAGVAAGVLRVRVNHVYPLHEAARAHADLEARRTSGSVVLLPAMPAADS

SEQ ID NO: 49423 - protein, 562 aa, Rhodospirillum rubrum ATCC 11170
MSALINGLRFDTLRGDLFGGITAAVVALPLALAFGVASGAGAIAGLYGAIFVGFFAALFGGTPAQVSGPTGPMTVVMTGVVMQFAHDPALAFTVVMMGGLVQMIFGALGLGRYVTYVPTPVVSGFMSGIGAIIIILEIAPLLGVAGGQEGVLATLAALPRVIAATNPAAAGLGALTLALVVLWPKAWGKIVPAALVALVVGTLIARFALPGVPVIGAIPTGFPQPHLPSIDLGVLPSMIASALMLGLLGCIDSLLTSLVADTLTRVPHKSDRELLGQGLGNVIAGLFGGIPGAGATMRTVINIRAGGRTPLSGALHALVLLALVLGLAPLAEGVPHAVLAGILLKVGWDIIDWPYLRRLRQAPRDGVVTMVVVLVLTVAVDLITAVAVGIIVKSLLAARAMAPYQLDRIRVVSGDGGGLALGQSEQALLARAGSAIALVHLSGPFSFCSANDMIRRSLRLGGTQVVVFDLTEVPMIDTSVALALGQMIGEVGESGARVVIAGMGGPGIETLATLGVLDRFTPADLVETRRTALERALSLVEEKNTPGNPDGENPNCQKTREK

SEQ ID NO: 49424 - protein, 157 aa, Rhodospirillum rubrum ATCC 11170
MSSNPNQRSAPADFPPPAAKSDKDWRAILTEDQYRVMRHQGTEAAWSSALNGEKRSGAFLCAACQAPLFASDDKYDSGSGWPSFTRPVDKQAVDTSVDHKLIVPRTEVHCSACGGHLGHVFEDGPRPTGLRYCINGVALDFKPEAPQATASHTPTDD

SEQ ID NO: 49425 - protein, 178 aa, Zea mays
GKFPVEAVAIMAKIAERIEQEDINPSQAEASRTSIPNAISSAVSQIAETLNAAAIMSLTKTGSTARHVSKFRPKTPILAVTPHVDVSRQLQLVWGVKPLLVLDLPSTSQTFQAAINVAQENHFLRDGDLVVMTAGTLQGVAGSTDLIKVEVVKAILGRGVGIGQGAVSGRARVASRPQ

SEQ ID NO: 49426 - protein, 842 aa, Glycine max
  misc_feature (660)..(660): Xaa can be any naturally occurring amino acid
MLPTLTELRRALDMQSALESLVEEGNYWKAFQVLSEYLQLLDSLSELSAIQEMSRGVEVWLGRTLQKLDALLLGVCQEFKEDGYITVIDAYALIGDTAGLAEKIQSFFMQEVISETHSVLKAIVHEDEEGLSQNSWLTYSDLCLRIPDSKFRQCLLRTLAVLFDLMCSYHEIMDFQLERKDSAAQTSNKCNEEISCSPGETQEVDSDVRACNNSMSSSRDVIHGSSSREESATKSSLTETSGSPYSDFHDTIKEAGKEDSATSSIESPWYHLRKEATTFVSQTLQRGRRNLWHLTASRVSVLLSSAAVCTASIHQFLKNYEDLSIFILTGEAFCGIEAVEFRQKLKVVCENYFIAFHRQNMHALKMVLEKETWLKLPPETVHMISFAGLIGDGAPLISLSSGKSTNVSAVHSTKSVNVVHTGARKNGFSHWIKSGNPFQQKLPTSNEGRGYSQPNGSVCGEFDGSSTNNFHDDKTPRKNDFNQMNGANSVSEDENEDLLADFIDEDSQLPSRSSKPHHSRALSSHVNDEENTTQTGSSLCLLKSMDKYARLMQKLEVVNVEFFKGVCQLFGFFFYFIYETFGQQNASSTGKGTSSSLNYRLRTALSRVNQDCEEWIKSQSSSPTSLSSPFVHAELTPTHPPNTNYGHSSGTSLGLKVGGXVPDLTEHVHRTTVRLLLHINGYVERVANCKWEVKELGMEHNGYVDLLLGEFKHYKTRLAHGGIRKEVQDLLLDYGLEIVAETLVEGLSRVKRCSDEGRALMSLDLQVLINGLQHFVALNVKPKLQMVETFIKAYYLPETEYVHWARAHPEYSKSQIVGLVNLVATMKGWKRKTRLDILEKIE

SEQ ID NO: 49427 - protein, 329 aa, Solanum tuberosum
MAVNGSAPSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEEEARKQIKSIWNYADVIQSSDVELEFLTGSNKIDDESAMSLWHPNLKLLLVTLGEKGLNYYTKKFHGSVGGFHVKTVDSTGARDSFVGALLTQIVDHQAILEDEARLKEVLRFSCAFGAITTRKKGAIPALPTESEALTFLKEEA

SEQ ID NO: 49428 - protein, 243 aa, Prochlorococcus marinus str. MIT 9313
MRKPVIAGNWKMHMTCAQAREYTAMFLPLIEATPNDRHVVIAPPFTAISSMAESVGGTRLELSSQNVHWEDDGAYTAEVSPTMLLEHQVRYAIVGHSEPRKYFSESDEQINRRARSAQAHGLIPIVCVGESDEQRERGEAERVIRRQVEQGLEDTDPDKLVVAYEPIWAIGTGKTCEASEANRICGLIRRWVGASELIIQYGGSVKPGNIDELMAMSDIDGVLVGGASLDPESFARIANYQTS

SEQ ID NO: 49429 - protein, 586 aa, Ashbya gossypii ATCC 10895
MSGFVSDKPAVPKATSDSSSSAVSIEYAGNRNAWTRFTDSFKRAQVDTAVDLEGKDADNGLNKTQQTLKHNIKTRHLTMISLGTGIGTGLLVASGKALHFGGPAGLVIGYVTTSTMLYCVVQACCELGVAYATLPGNYNAYPTFLVDKGFGFAVALVYGLQWATVLPLELVTASMTVKYWTSSVNPDVFVAIFYVFLLFIHFFGSRGYAEAEFIFNSLKVLLMAGFIIMAISLTAGASEQGYIGGQYWHDPGAFGGDRAIDRFKGICSVWVQAAFAYGGSEFIALTAAEQANPRESVPKATKRWLYRVVVVFLLPVILIGFLVPHNSDQLLSAEGGSGSRASPFVIAAALHGVRVVPHIINFIILTSVISVGNSAMYSAPRILLSLAEHGMCPKIFTYVDRQGRPLVTLIFVSLFGLIAFVAASNQEENVFTWLSAIAGLSQLFTWTAIAVSHVRFRRAMRVQGRSLGELGYRANTGALGSYYAIFFNVIVLIAQFWIAIAPIPKHGELDVEFFFQNYLAFPVLVVFYLGYKLWKRDFRLVIPSSEVDLLSHRQIFDEEVLLQEEAERKERLRNSTLFKRLLDFWC

SEQ ID NO: 49430 - protein, 130 aa, Brassica napus
  misc_feature (9)..(9): Xaa can be any naturally occurring amino acid
MTSVWKTKXLPGLNKIFDKDGKKAAAAEFLKSFNKEEIDKEIGDKKTELEPKLVETIEASPPEIKGLIKDKKTSKIKKNSVAVTKFLDDLAKIDFPGAKLVSDAVAKSGTTPLSPAIVFILDKVAPFVPA

SEQ ID NO: 49431 - protein, 157 aa, Listeria innocua Clip11262
MIRIGQGYDVHKLDYDRELIIGGIKIPYEKGLLGHSDADVLLHAITDAIIGAIGALDIGHFFPDTDMAYKDADSAELLAEIWRQVEAEGFKLGNLDATIIAEKPKMAPYVELMKRRIAELLHAEPSQVNVKATTTEKLGFTGREEGIASLAVVLLEK

SEQ ID NO: 49432 - protein, 248 aa, Herminiimonas arsenicoxydans
MRRKLVAGNWKMNGSLAANALLLAEIKAEFGNPACDVAVCVPAPYLAQCLSLLSDSTIALGAQDVSSHDSGAYTGEVSTAMLLEFACRYVIVGHSERRAYFGETNELVAQKTVRALSAGLMPIVCVGETLEQREAGQTDEVVGRQIDAVLSSIAENDLAKIVVAYEPVWAIGTGKTATPEMAQEVHVMLRRRLHAKNAQAATEVRILYGGSMKPDNAKELLAMPDIDGGLIGGAALKAADFLAIIRAA

SEQ ID NO: 49433 - protein, 288 aa, Solanum tuberosum
MAENKEEDVNLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYIVMQCLGAICGAGVVKGFMVGPYEKLKGGANFVSPGYTKGDGLGAEIIGTFVLVYTVFSATDAKRSARDSHVPILAPLPIGFAVFLVHLATIPITGTGINPARSLGAAIIYNKDEAWNDHWIFWVGPFIGAALAAVYHQIIIRAIPFKSSRS

SEQ ID NO: 49434 - protein, 204 aa, Listeria innocua Clip11262
MPTRLKEDIATIIKNDPATKTFFDAFLTNPGLHALWWHRVANFFYRHKMVLFGKVLSQTARFWTNIEIHPGATIGRRLFIDHGAGIVIGETAEIGDDVTIFHGVTLGGTGKDCGKRHPTVGDRALVSAGAKVLGPVDIGADARIGAGAVVLKDVPPGATVVGIPAKVVRLNGRTVGHAVPKMDELTLRIAELENIVEKLLKEKE

SEQ ID NO: 49435 - protein, 484 aa, Cryptococcus neoformans var. neoformans B-3501A
MDGVPGITQCSIPPGGSFTYNFTVSHQSGTFWWHSHYSNSMADGIWGPLIVHSANESLQRGRDYDEDRIVFITDWMHDNSEVIVAALISPEGYRGSTVPPQGDAILINGRGQTNCTATGSSSCFYPPPPEIQVPVDRRVRLRMISASSHAMYRVSIDNHSMEIVETDGTAVYGPTIHEMSISSGERYSAIINTTEGKEGDAFWLRTSVALACMSQGSTQVGLAVLRYTGNGNITTAEPRTEAWTDLARHDTPCVGLDEMYALSPREPLNASKTALQSRVLNSKLGTFVDVYGTSFEGYGFNNVTYQNQINDPLLSIVQRGGSCNHSLITNATFPDIGAGNIIINNLDAQIGHPYHIHGNEFQVIGRGFGALTLDDLSNIEFILDNPLRKDTIWMQGGSWLVLRIITDNPGVWACHCHIGWHLAKGKVGCNVTSPTDLFANCFVQMAVVVVQPKAIEDIQWSESWTNLCANTDPNAFGPARRSFP

SEQ ID NO: 49436 - protein, 331 aa, Bradyrhizobium sp. BTAi1
MGTKGAILIAGGAGYIGAHCSKAVADAGFTPICYDNLTLGHRSFVQWGPLVVGDIADSIKVASTIRQYDVQAVMHFAASSAVGESVADPQKYYLNNVAGTLGLLQGMREAGCTRLVFSSTGAVYGNAGREPIPESAAGPTVNPYGRSKYMIEQILSDYRAAYGFSAIALRYFNACGADASGAIGELRDPETHLIPRALMAILGHVPDFAIFGTDYETPDGTAVRDYIHVDDLAAAHIAAIGRLMEGHRGGAYNLGTGSGYSVREIVDAIRNETGEQVPLVYRERRPGDPPVLVADPRRAEQELGFKPRRSDLGHIIRSAWAWHQKAHPRIA

SEQ ID NO: 49437 - protein, 114 aa, Oryza sativa
EIFDPETNSWAEMPVGMGEGWPARQAGTKLSAVIDGDLYALEPSTSSDRGKIKIYDPQEDAWKVAIGQVPVGDFAESECPYLLAGFLGKLNLWKVIVSKNLAAAELVSCQVLNI

SEQ ID NO: 49438 - protein, 219 aa, Burkholderia sp. 383
MAFLLHQARFYTTVNHLRDLPPTVQPEIAFAGRSNAGKSTAINVLCNQKRLAFASKTPGRTQHINYFSVGPADEPVANLVDLPGYGYAEVPGAAKAHWEMLLSSYLATRSQLCGLILMMDSRRPLTDLDRRMIEWFVPTGKPIHTLLTKCDKLTRQESINALRTAQKGLDAYRDQGVQGKLTVQLFSAMKRVGLDEAHELIESWVRPSVADEKSEPVAQ

SEQ ID NO: 49439 - protein, 624 aa, Cryptococcus neoformans var. neoformans B-3501A
MRGLAKLFFLSCSFVSLVSSEKTDESPTAVSDNYMPKATATIDPSVFALSNDFEITDVPTTREYTFDIAKAFASPDGYEREVYVVNNMFPGPVIEANTGDTIIVHVNNHLDEGQSLHWHGLRQLGTAFMDGVPGITQCPIPPGGSFTYNFTVSHQSGTYWWHSHYSNSMADGIWGPLIVHSPNEPLQRGRDYDEDRIVFITDWMHDNSEIIIAALATPEGYKGNIAPPQGDAILINGRGQTNCTATGSSSCFYPPPPEIQVPVNCRVRLRFISATAHPMYRISIDNHPMEVVEADGTAVYGPTVHEISVAPGERYSAIINTNEGKEGDAFWLRTSVALSCMFGAVSQEGLAVVRYTGNGMVSTEEPQTSAWSDLAGVTVPCTGLDQTYTLSPRDSLSAPREPLQSHFFNSERGAFVNVLGNTFQGYGFNNISYQNQIFNPLLSIVQRGGSCENTLVSSRTFPDFGPGNIIINNLDTVIDHPYHLHGNEFQVIGRGTGALSIDNLTNIDFTLDNPVRKDTLWIQGGSWAVLRITADNPGVWALHCHIGWHLTEGKLAVIVVQPSAIGHMESPESWTNLCANTDPNAFGPAKRSSSPSIQSSKTSSFQYLREVKGKVVKRRGAREA

SEQ ID NO: 49440 - protein, 167 aa, Zea mays
MAQRDKKVEEPTELRAPELTLCANSCGFPGNPATNNLCQACFLAATASSSASVSPPPPSSSSSPAVLQFDDQQQNPRPCAPAASGPTEEPPRPARASAPASSSSVRRCQTCRKRVGLTGFRCRCGDLFCGAHRYSDRHDCCFDYRAAGRDAIARDNPVVRAAKIVRF

SEQ ID NO: 49441 - protein, 317 aa, Rickettsia akari str. Hartford
MNKFKNIAVYGGGSFGTSLAALAAQNCSNVTLFLRDEEIAKEILHKKTNIKYLGGIKLPAHLHATTNLSVIKDFELIIIAVPSYAFDDSIKLLKTHGISEDNTLLIATKGFARNPTELFSDRLKTLLPHSSTAFFAGPNLAKELAKNLPASASIASLDIDIANKIANNISSKIFTTNMTSDIVTLQVAGALKNIFAIKSGIDLASEQGENARATLIVDALKEIITLSKVFGGLQKNSDILLEAGVVGDLVLTCYALGSRNTNFGYELGISSDKKKFLQEYKQLVEGREALKLVLDLIKQYDLHMPIISEVASYVMPA

SEQ ID NO: 49442 - protein, 202 aa, Sinorhizobium meliloti
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEF

SEQ ID NO: 49443 - protein, 535 aa, Debaryomyces hansenii CBS767
MVNSPTLSALSYNSVLDFKKVNKASNWIIQKFGGTSVGKFPENIVDDIAKVFSQQNRVAVVCSARSSNTKSEGTTSRLIKSADLALEDGDFHALLKVIEEDHVENAKSRISDTKIQEELIENTMKELERANELLKACQVIGEISARTLDSIMSVGEKLSCLFMAALMNDRGLKATYVDLSDIIPLDYDFTSGFDEKFYKFLSSELGKKVLSLDSDVVPVLTGYFGVVPGGLLNGVGRGYTDLCAALIAVGTQAEELQIWKEVDGIFTADPRKVPNARLLDSVTPEEAAELTYYGSEVIHPFTMEQVIKAKIPIRIKNVKNPWGSGTIIFPDNLGRRGEETPPHPPAAYETLSSSYIATHKKKSATAITAKQDIVVINVHSNKKTLSHGFLAHIFTTLDNFKLVVDLISTSEVHVSMALQIQPDQELHLKNALKELRKMGTVDVTREMTIVSLVGKQMVNFIGIAGNMFKVLADERINIEMISQGANEINISAVIDAKDTLRALQSIHAKLLEGSYDLLGKTESAVDTRLEGLKLQ

SEQ ID NO: 49444 - protein, 396 aa, Zea mays
  misc_feature (156)..(156): Xaa can be any naturally occurring amino acid
  misc_feature (170)..(170): Xaa can be any naturally occurring amino acid
  misc_feature (190)..(190): Xaa can be any naturally occurring amino acid
MGGTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFDAYSYVXDIALKVAALVPERXCVTYTGMKGTGKWTVQQAAXLPVAAPTIEASLDSRFLSGLKDERVEASKIFQGDYYSTGSPVDKAQLVEDVRQALYASKICSYAQGMNFFKAKSAEKGWGLNLGELARFWKGGCFFRAFFLDRIKKAYDRNPGLASLLVDPEFAQEIMDRQAAWPRVVCLPINNGVSPPGMSASLAYFDSSRRARLPANLVQAQRDYFGAPTYERVAMPGSFPPEWFKIARNFSTN

SEQ ID NO: 49445 - protein, 380 aa, Lagenaria siceraria
MKKMALHSNKHRTQRLHNSLFFFDFLHCTEQQHLQTEHPIFLNNGGTNDFPLFQQTTTHFLVYEDEELNHLLSKEKDQNLQTGAVLKTLVQTDNALSLARTEAIDWLLKVNAFYGFSSLTALLAINYLDRILSGPYFQRDKPWMLQLAAVTCISLAAKVEEIRVPLLLDLQVEDSKYIFEAKTIQRMELLVLTALQWKMHPVAPVSFLGIITKGLGMKNQYIQREFLRRCERILLSLVSDSRSVGILPSIMAVSAMVSVVEEMGNCNPLEEFQDQLLNALKINKGRVKECCKVIMEAKIKGSGKRKHVEEEAEAEAESESSEAETEGEAEAEAGSPNGVMEANFSCESSNDSWEMGTIVSEYTHFSSSSSSSSKRIRPTR

SEQ ID NO: 49446 - protein, 137 aa, Idiomarina baltica OS145
MSNQQSDTNWNDLSDEQWRERLTPEQYQILRQQGTEAPFSGDFIQVNEHGEYHCAGCGQLLFTGQQQFEGHCGWPSFDEAIDGAIEYREDSSHGMQRIEIVCSRCKGHLGHVFNDGPTETGQRYCVNSLALTNRGED

SEQ ID NO: 49447 - protein, 476 aa, Idiomarina baltica OS145
MLRRTKIVTTLGPATDDPSVLKSLIQAGANVVRLNFSHGSADDHIKRAEMVRKLSAELKAHVAILGDLQGPKIRVARFKNDKVTLSQGEKFTLDAQYDSQSGDEHIVGLDYKELPHDVEPGDILLLDDGRIRLQVERIDGSAVHTLIVVGGQLSNNKGINRLGGGLSAKALTEKDLEDIKTAAQIGVDYLAVSFPRSGDDINEARQLLRAAGGNGVLCAKIERAEAVASEHALDEIIRASDAVMVARGDLGVEIGDAQLVGKQKLIISRARQLNKVVITATQMMESMIENPMPTRAEVMDVANAVLDGTDAVMLSAETAAGKHPVATVKAMAEICLGAETHPSAQLKHHDLEEHFSSISEAAAMSAMYAATHLTGVKAIIALTESGFTAKLMSRITSHLPIFSLSRHSGSRHKCALYRGVYPIQFDSTESKNPILDAIAVIKGLGHVAKGDLVVLTHGDVMETVGSSNTCKVIEVQ

SEQ ID NO: 49448 - protein, 323 aa, Solanum tuberosum
MKLAPLDSIQNAHEDSLWTAAWVRSDGDKPALLLTGGLDETVRLWDPTKLTCLHTNTGHCLGVVSVTAHPNRRIAASASLDSFIRVFEVDTNNTIATLEAPPSEVWQLQFSPDGSTLAAAGGGSSSVKLWDTTQWQLVATLSIPRQGGSQPSEKSGSKKFVLSVAWNTDGRLLACGSVDGTISVFDVARAKFLHFLEGHCMPVRSLVFSPSLHDSRILFSGSDDGHVHVYDAEGKTLLTSLSGHASWVLSVDVSPDGAAVATGSSDKTVKLWDLKMRTATQTLTNHTDQVWSVAFGPPSRIDVRSCMLASVSDDKSISFYQYS

SEQ ID NO: 49449 - protein, 423 aa, Corynebacterium efficiens YS-314
MTTHPLTMPIPEYFEEILESVRSDVSGEVAQYIPQLKDADPNPLALAMCTVDGHIYGAGDDEHEFTMQSVSKPFAYALALQEQGPEKVFATVGLEPSGEAFNELSLDGSTNRPMNPMINAGAIAVNQLINGSESSVEDRVEKIRSYFSALAGRELNIDRQLSETEIEGADRNLSIAHMLRNYGIIEDDAHDAVLSYTLQCSVKVTARDLAVMTATLAAGGTQPLTGEKLVDARVARLVLSTMASAGMYDEAGQWLATVGIPAKSGVSGGLVGVLPGQLGLATFSPRLNSQGNPVRGVEIFKALSEDMGLHLMSAELLTQHAVRAIEERGDTTVIQLQGAMNFSAAENFLFTVTDHDFTGEKVVLDISRVPMFRPMGRRLVKEGLRRIRDNGFKVAIYDPEDILPDFDFSDGTKSPQVDDPEEL

SEQ ID NO: 49450 - protein, 122 aa, Oryza officinalis
PVGENKRGGEVYRLYDVGGQRNERRKWIHLFEGVNAVIFCAAISEYDQMLFEDETKNRMMETKELFDWVLKQRCFEKTSFMLFLNKFDIFEKKIQKVPLSVCEWFKDYQPIAPGKQEVEHAY

SEQ ID NO: 49451 - protein, 453 aa, Ashbya gossypii ATCC 10895
MWRARTMASQEEFYRTQIFGTVFEITNRYADLNPVGMGAFGLVCSAVDTYTQQPVAIKKIMKPFSTAVLAKRTYRELKLLKHLRHENLICLEDIFLSPLEDIYFVTELQGTDLHRLLQTRPLEKQFLQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFTERFKNLKPDAVDLLEKMLVFDPKKRITAGDALTHPYLAPYHDPTDEPVADAKFDWNFNDADLPVDTWRVMMYSEILDFHQVPDSQINPNDTFDDQVAAATAAAEAARQQQQQKQQQQKQQQQRHQGVEHGAQHVQLQHGAKQLSADPLVGDSNGGIPLNVSAANETLNNFANQAAQYATDFE

SEQ ID NO: 49452 - protein, 502 aa, Bradyrhizobium sp. ORS278
MNAPVSRSVSDDGLLDLAVIGGGINGAGVARDAAGRGLTVLLCEKDDFAQGTSSRSGKLIHGGLRYLEYYEFRLVREALIEREVLLASAPHIIWPMRFVLPHSPEQRPAWLVRTGLFLYDHLGGRKQLPASRNVDLAHEPEGAPLRPEFRRGFEYSDCWVDDARLVILNLVDAARKGAVILPRTRAVSARREGECWRLEMRSDSGELRSVRAKALVNAAGPWVQDVVQGVAGLNSAHNVRLVKGSHLVVPKFWGGSQAYLLQNTDRRVIFVNPYETDLALIGTTDIVHDGRAEDVAIDGGEIDYLLAVLDRYFRAAPVRADIIHAFSGVRPLYDDNADNPSAVTRDYVFEVHGTAEQPPLLSIFGGKITTFRKLAEHALERLGPWFPRMGPAWTVAACLPGGDLGGSFDRFLDGLARDYPDLPRETVAHYARLYGSCARDLLGSARRRDDLGRHFGGTFYERELAYLREREWAMTAADVLDRRTKHGLHLTRAEREAFEAQL

SEQ ID NO: 49453 - protein, 425 aa, Lactobacillus curvatus
CKNLALNIESRGYTVAIYNRTGAKTEAVMQDHSEKKLVPSYTIEEFVQSLEKPRRIILMVKAGAGTDAVINELLPLLDKGDILIDGGNTFFGDTIRRNAELDKSGINFIGMGVSGGELGALEGPSMMPGGQKEAYELVAPILEQMSAKAEDGQPCVTYIGPNGAGHYVKMVHNGIEYGDMELISESYNLLRNVVGLSVEEIADVFKEWNHGELDSYLMEITADILTRKDDLETDKPIVDVILDAAGNKGTGKWSSQSALELGVPQSLITESVYARYISAMKDERVAASKILPAPTVAKLTEDKKELIEKIRQALYFSKIMSYAQGFEQMRVASDQYDWSLNYGEIAKIWREGCIIRARFLQKITDAFDKKADLNNLLLDDYFLDITKNYQGAVRDVAAMAIQQGVPAPGFSAAITYFDSYRSEVL

SEQ ID NO: 49454 - protein, 318 aa, Exiguobacterium sibiricum 255-15
MSTVLEHEIRIFALNSNKPLAEEIAKVIGIPVSESSVKHFSDGEISMNIEESVRGDDIYIIQSTSQPVNENLMELLIMIDALKRASARTINVVIPYYGYARQDRKARSREPITAKLVANLLEVAGATRVVTMDLHAAQIQGFFDIPVDQLMGVPLLASYFEKKNIDPNELVIVSPDHGGVTRARKLAEQLKAPIAIIDKRRPKPNVAEVMNIVGQVDGKIAIIIDDIIDTAGTITLAANALIENGAKQVYACCTHPVLSGPAMERIENSAIEELVVLNTIDLTQRECASKIKQISVARLLAEAIIRVHEQKSISPLFS

SEQ ID NO: 49455 - protein, 5541 aa, Streptomyces sp. FR-008
MSNEDRLRAYLKRAVTDLQEARQQLSDAENRDREPVAVVAMACRYPGGVRTPQDLWELARDGVDAISAFPANRGWDLDHLFHPDPAHHGTTYTREGGFLHDAGEFDPAFFGISPREALAMDPQQRLLLETSWEALERAGILPDTLAGSTTGVFVGTGHGDYDGASRGRQKEVAGHLLTGNTVAVASGRLSYTYGFEGPAVTVDTACSSSLVALHLAVRSLRQGECSLALAGGATVMSTPKMFTEFSRQQGLAADGRCKPFAAGADGTAWSEGVGLILLERLSDAQRNGHEILAVIRGSAINQDGASNGLTAPNGPSQQRLIRQALIDAGLTSGEVDVVEAHGTGTTLGDPIEAQALLNTYGQDRGDAHPLLLGSLKSNTGHTQAASGVAGVIKMVQAMRHGTLPKSLHVDAPTPHADWATGGVELLTESTTWPETGRPRRAAVSSFGVSGTNAHLILEQAPEDQTPRAEEPGTEPSADDSADTVRSWMVSGKSRAAVGEQAARLAASVRASDASVLDVAHALVSSRVAMDRRAVVVGSDREELLAGLDALAAGEPSVRVVEGTAGEGAGDVAFVFPGQGSQWVGMAVELLGSSPVFAGRVAECAAALEPFTEWSLLDVLNGVEGAASLERVDVVQPVLWAVMVSLAEVWRAQGVEPGAVIGHSQGEIAAAVVAGGLSLEDGARVVALRSRALRALSGLGGMVSVARNVDEVRGLLAGWEGRISVAAVNGPSSVVVSGDAEALDEFVAACDASGVRARRVAVDYASHSAHVERIEEELAGLLAPVAPRSCDVPFYSTLSGGVIDTAGLDAGYWYRNLRGTVEFEAGTRALLADGFRVFVEVSAHPVVATGVQETIEDASVQAGVVGTLRRDEGGLERFALSLGEAWALGAEVDWETHYAGTRPRHVDLPTYPFRRDWYWLTPAESAAAAATGDPADGDFWSAVESGDLTRLSSVLEVTGDDVEAFGTLLPALASWRRRRTLRSTLDTWRHRVTWTALTGADDAVPAGRWPALVPAGHADDPWVHAVLGALTGRGLRVERHDLTGDEDTAALTALLTGTGDTEPDGAEGIAGVLSLLALDERPHPDHPAVPRGLATAKELLHALSGTEASVWALTRGAVAVDSRDRLTSPVQAETWGFGRAVALELPDAWGGLADLPADPDARSLARLATLLGGPEDQIAVRSSGAYARRLARMPLPEPARVTDVDAELAVRAADDDGIGGWGDHDTVLITGGTGALGAHVARSLAASGARHLVLTSRRGPGSPGAVGLVAELEELGARVTVADCDVADRDQLARLLDSLPAGLPLTGVVHAAGVLDDGVLDALTLDRFEAVLRPKTLGTAHLHELTRDHDVTLFVLFSSIVGVLGNAGQANYAAANAYLDAVAEQRRAEGLPVTSVAWGPWADAGMATADVLADRMSHDGLAPMDPVTAVAALRAAVAEGVPHATVLDVDWRAYGTAMTAARPSPLVGDLPEVRRALEAAAATAPDTHALRDRLRGLAPAEQDRLLTDLVRAEVATALRHSSPEAVDVNRAFKDLGFDSLTAVEVRNRITAATDVKLPTTLLFDYPNTTAVVAHLRTLLLGDERPVAAPVVVSAGVTDEPMAVVAMACRFPGGVTTPEELWHLMAAEVDAVSTPPEDRGWDLDALYDPDPERHGTTYSREGGFIQDVAGFDPVFFGISPREALAMDPQQRLLLETSWETFERAGIDPGTLRNSATGVFVGSITTDYQVRLGGAAAQEQLAGHLMTGNASSIASGRLSYTYGFEGPAVTMDTGCSSSMVALHLALQSLRTGECTMALAGGVTVMSTPEPYVEFSRQRGLAADGRCKAFAEGADGMGFAEGVGLVLLERLSDARRNGHPVLAVVRGSALNQDGASNGLTAPNGPSQQRVIRQALANAGLAPGEVDVVEAHGTGTPLGDPIEAQAILATYGQDRDPARPLLLGSLKSNIGHTQAAAGVAGMMKMILAMRQGTLPKSLHITRPTSVVDWSSGAVRLVTESTPWPETGRPRRAGVSSFGISGTNGHLILEEAPAPEPAEDEPADPFTEPSADDSADTVRSWMVSGKSRAAVGEQAARLAASVRTSDASVLDVAHALVSSRVAMDRRAVVVGRDGEELLAGLDALAAGEPSPRLVEGSVGDGSGKVAFVFPGQGSQWVGMAVELLGSSPVFAGRVAECAAALEPFTEWSLLDVLNGVEGAASLERVDVVQPVLWAVMVSLAEVWRAQGVEPGAVIGHSQGEIAAAVVAGGLSLEDGARVVALRSRALRALSGLGGMVSVARNVDEVRGLLAGWEGRISVAAVNGPSSVVVSGDAEALDEFVAACDASGVRARRVAVDYASHSAHVERIEEELAGLLAPVAPRSCDVPFYSTLSGGVIDTAGLDAGYWYRNLRGTVEFEAGTRALLADGFRVFVEVSAHPVVATGVQETIEDASVQAGVVGTLRRDEGGLERFALSLGEAWALGAEVDWETHYAGTRPRHVDLPTYAFQRQHYWPRFAELGGDVSSAGLDSPDHPLLGASVELAGGDGLVATARWSLRTHPWLADHAVSGTVIVPGTALVESVIRAGDVLGCGRIEELALQAPVVLQERGEAQVQIGVGEPDASGRRPVTVHTRTTGPDGATEDLWTLRAQGTLTEPGAPAVDRPEEFTSWPPPGATAVAAEGFYELLAGRGYEFGPVFQGVRATWSRGEDLYAEVVLPEQVRGDAGRFGIHPALLDAALHAAHLAPGSAGRTVVPFTWSGVCLHAAGATALRVRVSPAGQDAISVQLTDPTGAPVATIDALAVREIAPDTLDPSARAARDWLFRLDWTPVTPPAAVPAATGWAVLGTPADPVTAPDGSGTTLPAFATPGALAEHTEANGHRPDAVLLFAGAAASGTAAAPDAEPGVPDAVLDDVLATVQSWLADETTEGVPLVVVTRGAVPTGPADPAHDLPGAAVWGLVRSAQSQHPGRLVLVDLDIHDDSWLALPAALAAGEPQLALRQGAAYAPRLVRPRTSDALTVPEGTGNWRLDIPEKGSVDRLDLVAAPGTAEEPAAGEVVIEVRAAGLNFRDVLNTLGMYPGPAVLLGAEAAGVVTAVGEGVTGFAPGDRVMGLVSGGFAPRAVADARMLAPVPDGWTWAQAASVPVAFLTAYYGLRDLAHLDAGESVLVHAAAGGVGMAAAQLARHWGAEVYGTAGDHKRTLLRADGWDDAHLASSRTLAFEDRFRTTSGGRGVDVVLNSLAGDYIDASLRLLAPGGRLVDMGKTDVRDPGQVLRDHPAAALYQAYELREAGEDRIQEMFRDLSELFASGALRPLPTVTWDVRHAREAFRHMAQAKHYGKIVLTLPRAWDPEGTVLVTGGAGVLGGILARHLVTRHGMRHLVLTGRRGPDTPGAGELAAELRELGAEVTLAACDAADADALAAVLAAVPAEHPLTAVVHAAGVLDDGVLESLTPDRLRTVLAPKADAARHLHRLTRDLDLTDLVLFSAGAGVFGNAGQANYAAANTYLDALAHRRRADGLPTTSLSWGLWADTSALTGQLDDTDLARVRRSGVLPLSAADGMVLFDAALTEQRPHLVPVRLETGQLRASGDEVPPLLRSLYRGPVRRTAEAGAATGTDGLRARLAGRSAEDRLSTLRDLVGAHAAAVLGHDDTEPFHAGRAFRDLGFDSLTAVELRNRLSAATGLRLPATLVFDHPTVAALAAHLDGELSDGTPAALPAAPAPAPAAPGDDDPFAIVGMACRLPGDIHSPEDLWRLLADGADAVAPFPDDRGWDLARLYDSVPEGQGSSRTREGGFLHDAADFDADFFGISPREALAMDPQQRLLLETAWETFERAGIDPRSVRGSRTGVFAGLSSSDYLKRVTHVPDEIAGYVNNGNANSIVSGRVSYTLGLEGPAVTVDTACSSSLVALHMALQALRRGECTMALAGGVTVMSSPEIIVDFSRQRGLAADGRCKPFAEAADGTGFSEGVGLILVERLSDARRNGHQVLAVVRGSAVNQDGASNGLSAPNGPAQQRVIRQALADAGVGAAEVDVVEAHGTGTRLGDPIEAQALLATYGRDRDGGHPLFLGSVKSNLGHTQAAAGVAGVMKMVLALRHRLLPESLHIDAPTPHVDWADSGVRLLTEATAWPEAGASRPRRAAVSSFGISGHQRPRHPGGGPPPPPARTAASRSPPAPDAAETRPAPLPWVLSARSEAALRGQAKALLTHLDAHPGTDPADIAHTLVTRRAQLEKRAVVVGSATGDFRAGLAALAEGSPAAHVVTGGRGAGRDRRTVLVFPGQGSQWAGMGAELLDASPAFADRVAACEEALAPYVDWSLTAVLRQEEGAPALDRVDVVQPVTWAVMVALAEVWRAHGLRPAAVLGHSQGEIAAAAVAGALSLADAARIVAVRSRAIARELSGHGGMVAVTAPHDEVTALLADLPGVCVAAVNGPSSVVVSGDTGGLDTLLAACEEQGVRARRVPVDYASHSAHVDRLAESLPAALDGIEPRDGDIPFFSTVTADWHPGTGLGAAYWHRNLRGTVRLEESLRALVEQGHDVFVECGPHPVLTVGIEDTVAALGADAVALGSLRRDDGGPARVLTALAAAHVEGVPVDWRPAVSHGTAVDLPTYAFQRRRYWLDAGTPQGDPAGLDSVVRLADGGAVLSGSLSLTTQPWLDAHRTHGAAVVPTTALLDWAVRAGDETGLPVVAALDEHSPLVVPEEGHVEIQLTVSAADTDSRPFSVHSRLHAADAGEPATPWTRNATGDLTDRPTTTPQASGTWPPADAVAADPAPVRALAEDRGLDLAAPFDTVRSLWRAGTDVLAEVALPDAAHADAARFRLHPALLQTPLALAATTEEATAPVLPAAWRDVTVHATGASRLRVRLTPGDDATWSVEARDAAGDLVLTGTAVTRSAGPDRLPATAGPDAPHRVAWLPWTDTTSSATPEPHGPWAVIGAPGRLTAALERSGATVQLHPDLAALTTALDNDEAAPPALVVAFHGHDSGEDPTKAAHTSAARALTLSTAWLREPRLADARLLLVTEGAVATGPDDTVPGLADATAWGLLRSAQTEHPGRFLLADLDPAPGDTDEDSAADALIAAAAAAARTGEHQFAVRAGTVTVPRLVPAGHPEGAPAPAATAPWGEGTGAGTVLITGGTGTLGALVARHLVTRHGVRHLLLTSRRGPGAPGAAALREELAALGAEAEIVACDVADREQLAGVLDAVPAEHPLTAVVHTAGVLDDGTLDGLTADRVAHVLRPKADAAWHLHELTRDTKLTAFVMFSSYAGVAGGPGQANYAAANAFLDALAQHRRASGLPAHSLAWGLWEDRSDLTGALDTTGLARLERSGIRPLTAGQGLALLDASTALDTAHLVPVRLDTRTLRADEVPPLLRALARPAVRRAADSGPGAATGAPADLRERLAGLSGPQQRALLHRTVLGHLAAVLGHASAASLDADRGFLDLGMSSLTAVELRNRLNADTGLSLPTTLIFDHPDPAALVRHLQTELGTGAGEPDQAVFAELAALEAAVGGAALDDQDRARLAQRLKALGWKLDATSQDADEPDDDSDLDTTTDDEMFDLIDNELGLA

SEQ ID NO: 49456 - protein, 7771 aa, Streptomyces sp. FR-008
MTTPSEKVVEALRASLKETERLRRQNRDLAAAASEPVAVVAMSCRYPGGVTSPEDLWHLVASGTDAVGGFPTDRGWDLDALRDAGVDARGHSVSQRGGFLDGVADFDAAFFGVSPREAVSMDPQQRLLLETSWEAVERAGIDPRSLRGSRTGVFVGTNGQDYAYLLVRSLADATGDIGTGIAASATSGRLSYTLGLEGPAVTVDTACSSSLVALHAAAHALRAGECGLALAGGVNVMSAPGSLMEFSRAGGLAGDGRCKAFADEADGTGWSEGVGVLLLERLSDARRNGHPVLAVLRGSAVNQDGASNGFTAPNGPSQQRVIQQALAAAGLTAADVDAVEGHGTGTPLGDPIEAQALLATYGQGRPEDRPLLLGSVKSNIGHAQAAAGVAGVIKMIMAMRHGVVPRSLHADHPSRHVDWDSGAVRLLSEAVEWPETGRPRRAGVSSFGISGTNAHVVIEQAGPAAEPESPAEPETVPTVVPWPVHARSEASLDAQIEAVTALTDATPLDIGHSLATGRSLFEHRAVLLSGLDGVPAEAARGRATERSLAVLFSGQGAQRAEMGRELYARFPVFAKALDEITALLDPRLDRPLREVMFARRRTPEAALLDTTGYTQPALFAVEVALHRLVESWGVVPDFVAGHSIGEIAAAHVAGVFSLEDACTLVAARARLMQELPAGGAMVAVQATEAEAAPRLTEGVALAAVNGPDSVTLAGEEAQVLALAAEFAAEGRKTQRLAVSHAFHSPLMEPMLAEFRRVAESLTYHEPVLPVVSNVTGALADDRLLCDPEYWVDHVRSTVRFADGVRALAGAGADTFVELGPDGILTALAQQCLDGPDVVAVPVLRKDRAEERALLTALARLHVAGVDIDWAACFEGTGARRTELPTYRWQHERYWPVLMAAAGDVSAAGLVSAEHPLLGAAVSLAGSDGVLFTGRLSAQTHPWLLDHTVGGMVAFPGTGFLELAVRAGDQVGCDRVEDLTLAKPLILTENSAAVVQVHVGAADADGARRVTVYSQAVDDPEQRWTEHASGLLTRGERVTGFDSTVWPPRGAVAADLEGFYARTEYGPVFQGLRAVWTRDDEAFVEVALPPQVDDAEYYGMHPALLDAAVQSVGFAGLGDGKKLVPFSWSGVSLHAGGASVVRVRVARVGEDTVSIAAVDVEGAPVLSADSLILRAPSALRAPTLHSSEQDGLLRLEWVAAPEGGAAPVRAVTLGTDRAWPGPLASLADAAAVTPAPDLVLVPLEGVEDDTPTAVHAATARTLALIQEWLEPATSAAGRLVFVTRGAVATGTDTGVSDLAAAAVHGLVRSAEAENPGRFALLDLDAGTAAPSGELLAQLPPLLAAGDTQFAVRDEAVLVARLARLSTGASLLPVPGLPWRLDTTVPGSIDGLSLVPAPEALDEPEGRAVRVEVRAAGLNFRDVLNALGMYPGEAGLLGSEAVGLVTAVGPDVTGIAVGDRVTGMIPGGLADTVLVDERYVTRVPEEWSDEDAASVPLVFLTALYAFRDLASVQAGERVLIHAGAGGVGMAAIQLARHMGAEVFATASEPKWETLRGLGLDDAHIASSRDLGFEEKFREVTGGAGMDVVLNALAGDFVDASLRITAPGGRFLEMGKTDIRDPQTTGEVRYRAFDLGEAAPERIGEMLTELLGLFAEGALQPLPVRAWDVRRAREAFRFMSQARHVGKIVLTMPPRWNPEGTVLVTGGTGGLGREVARHLVSARGVRRLLLVSRRGPAAEGVDAFREELAGLGAHVDVVACDVADRAAVAGLLGSVPVGHPLTAVVHTAGVLDDGVVTGLSPERLSGVLRPKVDAAWHLHELTRDMGLAGFVMFSSVSGVMGSAGQANYAAANVFMDALAQYRRAEGLAGLSLAWGAWEQTSGMTGTLTEADMQRVTASGAAPLTVEQGLALLDAATGSDEPLVVPIGAPSGDQRVLGLVPPLLRNLVRGTRRSAATAAGGASTAADLARRLLALPAEDRVRHAVELVRTEAAAVLGHASARAVEPGREFRELGFDSLTAVELRNRLTTVTGLRLTATLVFDYPTPHGLAEHLVAELLDEHGETGTPVVAADVADDPVVIVGMACRMPGGIETPDDLWRMLADGEDRITGFPTDRGWDLDALFGGGGDNRGVSATRRGGFLHDVGGFDAGFFGISPREAMAMDPQQRLLLETSWEALERSGIDPTGLRSSATGIFVGTTGQDYANLVMTSREDVEGHASTGLATSVISGRVSYALGLEGPALTVDTACSSSLVALHLAAQSLRSGESSLALAGGVTVLSTPMNFFGFTRQGGLAGDGLCKAFADAADGTGWSEGVGMLVLERLSDARRNGHDVLAVVRGSAINQDGASNGLTAPNGPSQQRVIRQALATAGLSADEVDAVEAHGTGTTLGDPIEAQALLATYGQDRPEDRPLLLGSIKSNIGHTQAAAGVAGVIKMVLAMRHGALPRSLHIDQPSTHVDWEAGAVRLLTETTGWPETGRPWRAGVSSFGLSGTNAHVILEQPEPETADTESPEPQAEPEALARVVPWPVSARTEEALPGQLARITALDAAPLDIGHSLATGRASFDHRVVLLAGADGEDEPVEVARGRAVERRLAVLFSGQGSQRAGMGRELYGRFPVFTKALDEVLALLDPKLDRPLREVLFAEEGSETAALLDTTGYTQPALFAVEVALYRLVESFGVVPEFVAGHSVGEISAAHIAGVLSLEDACTLVAARARLMQELPAGGAMVAVQATEAETAGRLTGGLSLAAVNGPDSVVIAGPDHEVDALASEFAAEGRKVQRLAVSHAFHSALMEPMLDAFHDVAKGLGYGEPRIPVVSDVTGTLAEPGQLSRPEYWVEHVRSTVRFADAVHALDQAGANAYLEIGPGGVLTVLAQQTLDAAGTASDSVTAPALRKDRAEEPALLTALATLHVTGVPVDWAGCFEGTGARRVELPTYAFQHERYWPRPSAHGGDVTGAGLSPAAHPLLGAATGLAASEGVLFTGRLSLTTHPWLADHTVGGGMVLFPATGFLELAVRAADEVGCDRVEEFTLATPLLLPADTAVVVQVWAGAPDESGARTVSLYSRSADVPDATWTQHATGVLTSGAVTLPAVAEIWPPKGAVAVGLEDFYDRTEYGPVFRTIRAVWKRGDEAFVEAALPPQADDAEYYGMHPALLDAAVQSVGFAGLDDEHQLLPFLWAGVSLHAGGASVVRFRVARTGEDSVSIAAVDVEGAPVLSAESLVLRVPAGDHAPAARRTELDSLLRLEWTAGPETGDAPAARHTTAGALGTGGAAATLAPLTGEEDLVLVEVPAPAEGADVPAATHERAAQALALAQEWLADERFADTRLVFVTRGAVCARPGERVDDLPAAAVWGLVRAAQSENPTRFALLDLDDTTPVETALPQLLGPLSGGDAQFVVREGAVLVGRLDRAVTAPSLLPPADGPWRLDSPSRGSLDALTLRPCPEELAEPQERQVRVEVRAAGLNFRDVLNALGMYPGEAGLLGAEAAGFVTAVGPEVTGLSVGDRVMGMVPGGLATETLIDERFLTRVPEEWSDEDAASVPLVFLTAYYALTELAGLSAGERVLIHAGAGGVGMAAIQLARHMGAEVFATASEPKWETLRGLGLDDAHIASSRDLGFEEKFREETGGAGMDVVLNALAGDFVDASLRITASGGRFLEMGKTDIRDPHAVGDVRYRAFDLGEAGPDRTGEMLSELLGLFAEGALRPLPVRAWDVRRAREAFRFMSQARHVGKIVLTMPPRWNPEGTVLVTGGTGGLGREVARHLVSARGVRRLLLVSRRGPAAEGVDAFREELAGLGAHVDVVACDVADRAAVAGLLASVPVGHPLTAVVHTAGVLDDGVVTGLSPERLSGVLRPKVDAAWHLHELTRDMGLAGFVMFSSVSGVMGSAGQGNYAAANVFMDALAQYRRAEGLAGLSLAWGAWEQTSGMTGTLTDAGVRRMSASAAPALTVEQGLALLDAAVVSDEPHLVPLGASGSTRMPGEVPPLLRNLVRGTRRAAATAVGGAGTADELTRRLLDLREDERLRFAVNLIRAEAASVLGHSSAQAIDAERDFHDLGFDSLTAVELRNRLTGATGLRLPATLVFDHPTPGVLAEHLIAALLDEQRATGATAPTPVAAALAEDPVVIVGMACRMPGGVSSPEELWQLVLDGQEGISAFPTDRGWDLDTLQRGGESGHGRSATSEGGFLYDVADFDAGFFGISPREALAMDPQQRLLLETTWEAFERAGITPTEVRGSRTGVFVGTSGQDYTTLVMNSRQDAEGHAPTGLATSVISGRLSYTFGLEGPAVTIDTACSSSLVALHWAAHALRSGEADLALAGGVTVMSTAMGYAGFTRQGGLATDGRCKAFADAADGTGWSEGVGMLVVERLSDARRNGHPVLAVLRGSAVNQDGASNGLTAPNGPSQQRVIRQALASAGLSTDEVDAVEAHGTGTTLGDPIEAQALLATYGQDRPGDRPLLLGSIKSNIGHAQAAAGVAGVIKTVMAIRHGVLPRSLHIDRPSTHVDWTEGDVRLLTETTEWPETGRPRRAAVSSFGISGTNAHTIIEQAPEIVEATPAAASAPAPAAVPWPVSAKSPEALDAQLARIATVTGATPLDIGHSLATGRASFEYRAVLLAGTGAEDEPVEVARGRAVERRLAVLFPGQGSQRAGMGRELYERYPVFAKALDEITALLDPELDRPLREVLFAEEGSETAALLDTTGYTQPALFAVEVALHRLLESQGVSPEYVAGHSVGEIAAAHVAGVFSLEDACRLVAARARLMQELPAGGAMAAVQATEAEIAPRLTEGLSLAAVNGPDSVVVSGPESEVTALAAEFVAEGRKTQRLQVSHAFHSALTEPMLDAFREVARSLAYAEPRLPVVSNVTGALAAPGQLTDPEYWVRHVRETVRFADGVRALAEAGADAYLEAGPGGVLTALARQTLGTDSEAVTAPALRKDRAEEPALLTALATLHVTGVPVDWAACFEGTGARRVDLPTYAFQRVRHWPDTRRPGTGGGSSDPLDGAFWTAVEGEDLTRLATDLAVDTEALGAVLPALSTWRRRRRDQAMVDSNRHHETWKPLSLPPGAPAPAGTWLAVVPAAYGEDPWTAAVLDAVGTDVVRLTVDTVERHALADRLRALSADGAALAGVVSLLALADTPEAAVSGDPAGAPAAPTAVLFQALLDAGVDAPLWCLTRGAVAVAGSEAVTAPAQAAVWGLGRVAALEHPAVWGGLVDLPSAWDERAARRFAAVLAGHDGEDQVAVRSSAAFARRLVPAPAAEPGDGWQPRGTVLVTGGTGGRGAHVARWLAGAGAAHLVLLGRRGPDAPGADALRAELEAAGARVTLVACDAADRDALAAVLDGIPADTPLSAVVHAAAVVDDGVLDDLTPERFAAPHHARTAPALHLDELTRGLDLDVFALCSSVAGTVGTAGRANLAAATAVLDALARSRRSEGLPATSMAWGAWIGDADETGGDDAPAAPRAGAGHPAVHPDLALAALRQAVTRPEAAPVLFDPRQPQVLDGLIGMRGNALLRDLPDARQALADAETTRDRARTAASGLAERLRGLPADERTDSVTELVRTHAAAVLGHPGPEAVAADRNFRDLGFDSLTAIELPNRIALATGLRLPATTVYDYPTAQALAEHLLAELLGEQDTPGSGRATPAALAEDPVVIVGMACRLPGGVRSPQDLWAMVSEGRDGIEAFPEDRGWDLATLTTGGADGRGRSATLRGGFLSGAADFDAAFFGISPREALAMDPQQRLLLETTWEAFERSGIDADQLRGSRTGVFVGTNGQDYSTLVMNSREDLEGHAGTGLAASVVSGRLAYTFGLEGPAVTVDTACSSSLVALHWAMQALRAGECDLAVAGGITMMSTPSAFSGFTLQNGLAVDGRCKAYADAADGTGWSEGVGLIVVERLSDARRNGHEVLAVVRGSAINQDGASNGLTAPNGPSQQRVIRQALAGGGLTPSDIDAVEGHGTGTPLGDPIEAQALLATYGQDRPADRPLLLGSIKSNIGHTQAAAGVAGIIKTVMAMRHGVLPRTLHVDRPSTHVDWESGAIRLLTEESAWPDSGRPWRAGISSFGISGTNAHTIIEQAPAPEPAEPGAALLPGPTPTVVPWPVSAKSEEALDGQIAAVTALDGAAPLDVGHSLATGRARFDHRAVLLARPGTTPWEAARGRAAVRSLALLFSGQGSQRAGMGRELYDRFPVFAEALDAVLARLDTGLTPSLREVLFAEEGSGTAALLDTTGYTQPALFAVEVALYRLVESWGVRPGHVAGHSVGEIAAAHVAGVFSLEDACRLVAARARLMQELPSGGAMVAVRATEAEVVPRLTEGLSLAAVNGPDSVVIAGTEDEALALAEAFAAEGRKTQRLPVSHAFHSPLMEPMLDAFRQVAESLEYAEPRIPVVSDVTGALAEPGQLTRAAYWVEHVRATVRFADGVRALAGAGANAFLEIGPGGVLTALAQSVLEADDRDEAVVLPALRKDRDEETALLTAVAGLHVSGVRVDWSAWFTGTGARRTELPTYAFQRERYWPRPAALTGDISTAGLISAEHPLLGAAVPLADSEGVLFTSQISMQVHPWLLDHRVGGTVIMPGTGYLEMAIRAADQVGCARVEELVLAAPMVLDEKHPVSVQVVVGAPDDTGTRPVTFYSRPSDAVDAPWSRHADGFLAVQERTDSFEAPVWPPADAVSVEFDGDYSRTGYGPSFQGLRQVWLRGEEAFVEVALPEEVAGDAQYFGMHPALLDAVQHANGYLGVGSEENPLLPFAWNGVSLHARGATTLRVRITRLGDESVRLTAVDAEGVPVLCAESLVLRAPTVPSAPVATGGQEPVFRLDWTAAPAVKPTEGLTAATLGEDVFGVGTALASLTELTGPDADPSAAPDFVLVPLAGAGDAAGAGDPDAHGADVPAAVHALTTRTLDLLQQWQAAERLGHSRLVFVTTGAVAAHDTETVRDLAAGAAWGLVRSAQSENPDRFVLLDLDGADAPDTLRALLPDLPGLLGSGDAQFAVREGTALVGRLERLTTAPGLLAPTGTPWRLDTTGKGSLDNLVLAPCPEVLQPLGAHEVRIDVEAAGLNFRDVLNALGMYPGESGPMGTEAAGVVTAVGEAVTGLAPGDRVLGTVPGGFGPVVVADQHYVTQVPEGWTMRDAASVPLVFLTALYAFRDLASVQAGERVLIHAGAGGVGMAAIQLARHVGAEVFATASEPKWETLRSLGLDDAHIASSRDLGFEEKFREVTGGAGMDVVLNALAGDFVDASLRITAPGGRFLEMGKTDIRDPQTTGEVRYQAFDLGEAGPERNKALLGELLDLFAEGALRPLPVRTWDVRRAREAFRFMSQAKHTGKIVLTMPPRWNPEGTVLITGGTGALGGHLARRFARAGMRHLLLTSRRGADAPGAAELAAELRELGAEVTVAACDTADREATAALLDAVPAAHPLTAVVHTAGILDDGVIASLTPERLAAVLRPKVDAAWHLHELTRDLDLAAFLPFSSVAGVMGSPGQGNYAAANSFLDALTRHRRHLGLAGTSLAWGPWAHDGGMTSTLSDTDMRRMQSGGLPPLAVDQGLELFDIARGSDESFLVLVGLAAGAMRGAAPEDLPPLFRSMVRSGRRTAASTDAAGASAALGAKLAGLGAAERVRYVTDLVREQAARVLGHASPKSVDVSQEFRELGVDSLTALELRNHLATATGLRLPATLVFDYPTPTALAEHFVAELAGDDAVPQGPSLLAELDRFETLLSAGDPDEITRAGLALRLGQMLDQVRGNAPEQAGSSLDDDFESASTDEVFAFIDNELGRLGDL

SEQ ID NO: 49457 - protein, 263 aa, Gibberella zeae PH-1
MSSSAMSFFSRVWSRLGDRAPLRPRVFNNPNFIRIPAINKVEEETLPDYLPARYYPVNIGEVFADRYQVVGKLGYGAGSTVWLANDLRKKSYVSLKQRASSHPGRSAVRTLLDSFQIKGPDGDHLVLAHPPLWKSIEAAIRRSSPRRLPPFGTRYVLKDLFMALEYLHDECQIIHTDIKADNIMFSITDTSVFAEFEEGEIHDPRPRKEVEGKIIYTSHTMKSTGMVGPPVLCDFGSAVLGDSENVECVQPSVYRSPEVTLEA

SEQ ID NO: 49458 - protein, 182 aa, Bacillus cereus ATCC 10987
MWVTIVDMWISYVDNMFVRWGIRVNISIISIGKLKEKYLKQGIAEYLKRLSAYAKVEVIELPDEKAPENLSEAEMLIVKEKEGIRILDKISDDTHVIALAIEGKQKSSEEFAVSLDRLATYGKSKVAFVIGGSLGLSSEVIKRSNESLSFSKMTLPHQLMRLVLLEQVYRAFRINRGEPYHK

SEQ ID NO: 49459 - protein, 308 aa, Oryza sativa Japonica Group
MAAGAGAGGLSGDYYRRSCPQLELVVDMALAPVFAVDQTSPAALLRLFFHDCQVQGCDGSILLNSDERRNITSELGSDKNFGIRDVSTIGLVKAAVERACPGQVSCADIVVLAARSAVAHAGGPRIRGVPLGRRDATAASAERADAMLPDSFLGIDGALAMFQSKGMTVEETVAILGGHTLGGGHCATVDTARRGRGRSDAAFEAALRLACPAAAPRAVAAAVPVLSDATPSWFDNLYYWNAASGRGIFAVDAEEAADARTAGHVRRFAADGRRFFRAFSSAFVKLAMSGVLTGDEGEIRRRCDVVNH

SEQ ID NO: 49460 - protein, 486 aa, Pseudomonas fluorescens Pf-5
MIKHWINGREVESREVFTNYNPATGEAIGEVASGGAEEIAQAVAAAKDAFPKWANTPASVRARLMRRLGALIEENVPHLAELETLDTGLPIHQTRNVLIPRASHNFDFFAEVCTRMDGHSYPVDDQMLNYTLYQPVGVCALVSPWNVPFMTATWKTAPCLALGNTAVLKMSELSPLTANELGRLAVEAGIPAGVLNIVQGYGATAGDALVRHPDVRAISFTGGTATGKKIMQTAGLKKYSMELGGKSPVLIFEDADLERALDAALFTIFSLNGERCTAGSRIFIQESVYPQFVKEFAARARRLIVGDPQDPKTQVGSMITQAHYDKVTGYIRIGLEEGATLLAGGLERPANLPAHLARGQFIQPTVFADVDNQMRIAQEEIFGPVVCLIPFKDEAQALQLANDTEYGLASYIWTQDIGKAHRLARGIEAGMVFINSQNVRDLRQPFGGIKGSGTGREGGEYSFEVFAEIKNVCLSMGSHHIPRWGV

SEQ ID NO: 49461 - protein, 478 aa, Rickettsia akari str. Hartford
MKFMNLLKNITGKNYINGEFVEFGKQISIINPSTLKEIATVPNLELSEINSAINNTVQTFASWSQSSFEERIAILRKWYNLVIENIDELSHILTLEQGKVLSESKKEILYGASFIDWYTYVIHNIHGTIKPGSSKAHKIVTQYEPVGPSAAITPWNFPNAMITRKVIPAIAAGCSVILKPSSLTPLSALILTKFASDAGLPAGVFNVITGDSDIIGQSFCEDFRLRKLSFTGSTNVGKILYQNAANTLKRLSLELGGNAPFIITADNKLEKVARDLVVAKTRNSGQSCTSPNRIFIEESIYEKFIEILKAKFTQLKAGDGFDKESDVGPLISSAAIEKIQKLLTDAQSKEAQLICGGKAVDNFIEPTIIIDCLDNMDIFRTEIFGPVVACYKFKDLDEVIERANNTEYGLQGYVYSNNISTAQMIATRLDFGMVSINNPLPGNAKAPFAGRKASGFGVVGSFEGIFEYLNTKYINLQN

SEQ ID NO: 49462 - protein, 40 aa, Pisum sativum
ATYNIKLITPEGTKEITCSDSEYILDAAEEKGLDLPYSCR

SEQ ID NO: 49463 - protein, 450 aa, Oryza sativa Japonica Group
MAPPESSHHHLLESGLLEVSKAPSAAVAAEEEEKKEAAAWTPSSSSSMTGRKIKSEASPLLRRLLGGPAAQLQEVLLGTKLYPLFSAVPLAVAAESLRLGRVWVFAFSLIGLAPLAERVSFLSEHIANTVGPTAGGIMNATCGNVPELIIALFALHKNKMEILKWSLLGSILSNLLLVLGSSLLFGGIVNIGKERPLDKRQADVSIGLLLLGVLCHIATLVSKYTSSTGDSINSSSVMQLSRSCAIVMLIAYFGSLMFQLKTHRQIFELEEDSSDSSSSEDDATDKSVIGFASAMVWLIGMAVVTAMLSSYVVTTIEEASESMGIPVRFISIILLPIVGNAAEHAGAIIFAFKNKIDISLGITLGSATQISMLVVPVILIVSWVNAIPMDLDFNLLETGSLAMAVITTAFTLQDDKWHYLKGLNLVFSYIVIAVCFFVMKALPTLKKEDD

SEQ ID NO: 49464 - protein, 487 aa, Bacillus licheniformis ATCC 14580
MAEIRKLRNYINGEWVESKTDKYEDVVNPATKEVLCQVPISTREDIEYAAQTAAEAFKTWSKVAVPRRARILFNFQQLLTQHKEELAHLITIENGKNTKEALGEVGRGIENVEFAAGAPSLMMGDSLATIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSENLKRVQSLTGAKNHTIVLNDANLEDTVTNIIGAAFGSAGERCMACAVVTVEEGIADEFMEKLVQKASEVKIGNGLDDGVFLGPVIREDNKKRTLGYIQKGIEEGARLVCDGRENVTDEGYFVGPTIFDNVTTDMTIWKDEIFAPVLSVIRVKNLKEAVEIANQSEFANGACLFTSNSNAIRYFRENIDAGMLGINLGVPAPMAFFPFSGWKSSFFGTLHANGKDSVDFYTRKKVVTARYPAPDFN

SEQ ID NO: 49465 - protein, 335 aa, Chlamydophila caviae GPIC
MKVVINGFGRIGRLVLRQVLKRNSSVDVVAVNDLVPGEALTYLFKYDSTHGRFPADVSYDNGYLVVDGRRIQLLDQRDVQKLPWKDLGVDVVIESTGLFTKKEDAAKHLDSGAKRVLITAPAKGDVPTFVMGVNENAFDPEKDTIISNASCTTNCLAPLAKVLLDNFGIEEGLMTTVHAATATQSVVDGPSKKDWRGGRGAFQNIVPASTGAAKAVALCLPELKNKLTGMAFRVPVADVSVVDLTVRLQKSTTYEEICKAIKNASETNLRGILGYTDQEVVSSDFIGCEYSSIFDAGAGIALTDRFFKLVAWYDNEIGYATRIVDLLEYVAKNSK

SEQ ID NO: 49466 - protein, 502 aa, Ashbya gossypii ATCC 10895
MRLSGVQYKLRPGHIRSVAVVGAGPYGAGVTKALVKEGSFDQIHVFERREQFGGLWNYTKPLLKHHGVTCAAAVPCENARLQMRPQLTKDGRPAFQTAAYRYLDTNVPRDLMQYRSISFPEGTPLFPTREQVLEHILQFCRPIKKYVQFNTEVTKVSYDDARAKYSVLTTNLLDNTTRAIEVDAVAVATGYYNMPFIPDRPGLKSWHETYPCSISHSIDFDAPEDFLDVKGEIIVVGNNASGSDISYELARCLKRPIYKSKRSESLLPGGSDSNIKDVADIKRLDPASKTVELVDGQVIQNVEKLLFCTGYLKSVPFLPSSAKEGEHGNRVMSQLITEGDKVTDLYNHMLSIRLPTLAFLGLPRYVLPIRLSETQGSWLARVWSGRISLPSEEVQWKYHEWTLENNGRGIKYHDLLFPHDIQHSQRLNMEIRHAGAGGHFGVEWTGNHIKLRAALKPLKEAYIEYLKQTNKRAVSVEELIDNGYFTWPEDATTCVQVPHFAP

SEQ ID NO: 49467 - protein, 263 aa, Idiomarina baltica OS145
MIPQFGMGTFRLEGQELTDLVSAAIDMGYEHIDTAQFYGNEADVGKALAQHTNKDVFVTTKVWYEKLAYQDVLDSLQVSRDKLQRDTIDLALIHWPSPNDEVPVEETLDALQKAQQDGLIKHLGVSNFTIDLLNRAAAHVGKDEILTNQIEVHPFFQNHAITDACKQMGVKVTAYLPLAKGAVMDNSVMQNIAEKHNVSPAQVAIAWQLANDYIAIPSTTKVDHLKSNFDAQSLKLDQDDMKAIADIDKDDRLIDPDFSPDWD

SEQ ID NO: 49468 - protein, 312 aa, unidentified eubacterium SCB49
MATGPTPKIFACKQSQDLAKDIAKEYGIPLGNIITSTYSDGEFQPSFEESVRGCRVFLIGSTHPSSDHLMELLLMCDAAKRASARHITAVMPYFGWARQDRKDKPRVPIAAKMIAKMLETAGATRIITMDLHADQIQGFFEKPVDHLFASTIFLPYLKTLNLPNLTIASPDMGGSKRAYAYSKAMESDVVICYKQREKANIISHMELIGDVKGKNVVLVDDMVDTAGTLTKAADLMMERGALSVRAICTHPILSGAAYDRLEASKLEELIVTDSIPLRQESPKLRVLSCAKLFADVMKSVQVNQSISSKFIM

SEQ ID NO: 49469 - protein, 122 aa, Oryza alta
PIGENKRGGEVYRLYDVGGQRNERRKWIHLFEGVNAVIFCAATSEYDQMLFEDETKNRMMETKELFDWVLKQRCFEKTSFMLFLNKFDIFEKKIQKVPLSVCEWFKDYQPIAPGKQEVEHAY

SEQ ID NO: 49470 - protein, 355 aa, Solanum tuberosum
MASEDVKASESAVEKIVSLAEEANLARQEIRPTSHAVISICKSLVAGGVAGGVSRTAVAPLERLKILLQVQNSHSIKYNGTISGLKYIWRTEGFKGLFKGNGTNCARIVPNSAVKFFSYEQASKGILYLYQQQTGNEDAQLTPLLRLGAGACAGIIAMSATYPMDMVRGRITVQTEKSPYQYRGMVHALSTILREEGPRALYKGWLPSVIGVIPYVGLNFAVYESLKEWLVKTKPLGLVDDSTEPGVVTRLACGAVAGTLGQTVAYPLDVVRRRMQMVGWKDAASIVTGDGRSKASLEYSGMIDTFRKTVRYEGFSALYKGLVPNSVKVVPSIAIAFVTYEQVKDLLGVEIRISD

SEQ ID NO: 49471 - protein, 1071 aa, Ashbya gossypii ATCC 10895
MPSSTQDYHVNSQFRMGGSPQAAVAPATPRMMGKAGEEERRMPKPFHRKSLGDWDFLETVGAGSMGKVKLAKHRYTNELCAIKIVNRATKSFMHKQQLQGLPPPATEEELLERRKKLEKEVSRDKRTIREASLGQILYHPHICRLFEMCTMSNHFYMLFEYVSGGQLLDYIIQHGSLRERHARKFARGIASALQYLHLNNIVHRDLKIENIMISSSGEIRIIDFGLSNMYDPKKQLHTFCGSLYFAAPELLKAHPYTGPEVDIWSFGVVLYVLVCGKVPFDDENASVLHEKIKQGKVEYPQHLSIDVISLLSKMLVVDPYKRATLKQVVHHQWMQKGYDFPPPSYLPPCVPLTPDRINMDIITEMYRLELIHDVAETAQWLEKIITSPEYLELSRQYWENAANMKPEDAPIRGYSPLLSMYHLVDEMLKRKRSKMQKRGQASAQTPATAGANSGLPSSAALISADTTSAGSYASTAAGPQKLAAAVTPENSDRMSGPHVLVSQLDSEKSRTLQPAVSPHDETSSTYITVTTPSKQKQNVLVPPRLAIPEQAHTTTPRKAINVDGEIDQKVLSPTPQSHDFETSNKYSTTSNATHSAAVSAGSTEKHIFGTLFRRFSQRHRHTTSQGGSQCAYHPEVNTLQSSAQYQTSKTSTQAAKTKTHTRTVSEYTPASKYANMGPPAAADSTRSTTNYLEARSPLPALPVNAESLVKEQQRLQDNLQGLDISGGGQSSHANNNRNSTSSYNNNGPEVIDEDKPLRQLSVPKGRKLHPSARAKSVGHARRESLKFMRPAIASQLSPQDINDEGFLEQGSDTESENIFGGSSSGAVASVDEELTDKQILELAARAPPGSMPSIDYPRSLFLKGFFSVQTTSSKPLPIVRYKIISTLKKLNIEFKEVKGGFVCVHRQSYMTNRASPTQPNIFVTDSTSITSSTNGTASSTHRRQLSVPSRHNSLRRQQQAGANNLGTSMHERTSSTASHSIAGSGCITEELSTASLESLHGDDILTTSKAQHMNTKDLEMQLQKERPPLKFEIHIVKVRIVGLAGVHFKKVSGNTWMYKELASHILKELNL

SEQ ID NO: 49472 - protein, 119 aa, Campylobacter jejuni subsp. jejuni NCTC 11168
MKELNEEEKKVILNKGTEAPFSGKYNDFYEKGIYQCKQCGASLYKSEDKFKSGCGWPSFDDEIKGAIKRIPDKDGIRTEIVCANCNGHLGHVFEGEGFSAKNVRHCVNSISLEFVKTKD

SEQ ID NO: 49473 - protein, 826 aa, delta proteobacterium MLMS-1
MNDITLQINDQSVNASAGMTILEAASRAGIRISTLCQVDGKNSEVPCELCLVEVEGQTAPVKACATPVADGLKVITENKELVEHRRERLAVLAETHFGDCKAPCNLTCPGQINVQGYIAHVAKGQYEEAVRLVMERNPFPFSVGRVCPRFCETRCRRLLVDEAVSINHLKRFVADWCMTNKVDLRLTTAAATGQRVAVVGGGPAGLTAAYYLAQRGHEVTVLEAAPKLGGMLRYGLPRYKVPENVLDYEIGTILRMGISVRLNQRWGRDFTLQGLQEQGFAAILLAVGACYDESLDIEGGSLPGVVPALKLLRRANEGDKTDYGRRAMVVGGGNTAMEAARTLLRRGVEQVTVLYPRAQTEMPANQRNIGEAKEEGVQFLLMASPVTIQEGEQGLDVDLIRMKLGEPNDKGLRFPEAIPGSNIAMNVDTVVVASGQSATGDGVLGGELEEKLELTPKNNIKANPRNFQTNLPTIYAAGDATSGPRSVIQAVVAARRAADNIHAQLLGLGKEAPASRFNFSRGKSFEQVDLRNFEGIRVNLREKMPSRPPERAIQDFNEVRLGFTEQMAKSEAERCLSCGCTAFDRCDLKEQAIAHGVDPNKTGMGTTPRYARQEEHPTISVDLNKCIYCHKCANSCEYRALEITAGSFDEQGRAQDLSLTFMEHCVSCGKCVDNCSTGALNKKDQIVPITDEEIRLVPTTCPYCGAGCQMNLKVKGDTIIEVTADPELAPNYGALCVKGRFGFHFVQDRRRLTRPLIRRGGQLVECSWDEALNYTAKRFFDIKAMYGSDAVAGFSCARATNEENFLMQKFMRTAIGTNNIDHCARL

SEQ ID NO: 49474 - protein, 141 aa, Chlamydophila caviae GPIC
MEQTLSIIKPDSVGKAHIGEIVAIFEKSGFRIAAMKMVHLSVKEAEGFYAVHKSRPFFQELVDFMISGPVVVMVLEGDNAVVRNREIMGATNPQEAAQGTIRAQFGESIGINAVHGSDSLENAAIEINYFFSKIEIVNSAK

SEQ ID NO: 49475 - protein, 303 aa, Solanum tuberosum
MAAANGSSDLYSEMEVDAFRRLFPLRYHEQHLLKSVRPDARKLGSARDTTLALGAVASAEGSALAKIGSTTMLAAIKMEIMTPTVECPDEGSIAIEFHMPPICSPLVRPGRPAEVASVISKQLSDTILSSGMIDLKELCLVGGKAAWMAYLDIYCLDADGSLFDAALLSTVAAFSHLNIPVVSLNEDGRIVLVSEDNIQLKLEKQPVNTEKRKLKLNSPPFSLTCLLHKNYILADPTAEEESIMETAVTVVLDSSYQLVSLYKPGGPVHAHTSVIQDCVALAKRRVKELQSVLNEAISDMEVE

SEQ ID NO: 49476 - protein, 86 aa, Glycine max
MDSFSNPSSGSSHQLSAHDLKNQLKNQLAIEYAQQFLETVGRKCFEKCVTKPGSSLGGSESSCISRCVDRYIEATGIISKALFSSQ

SEQ ID NO: 49477 - protein, 184 aa, Ceratodon purpureus
MSATKHGDPRIQYISDSIRAIPDFPHKGIMFRDVTTLLLDHKAFKDTIDIFVERYRDQKIDVIVGIEARGFIFGPPIALAIGAKFVPMRKPRKLPGPVIRQEYSLEYGTDCIEMHVGAIEKDERVVLIDDLIATGGTLGAAIKLLDQVGAEIVECGCLIELVDLKGREKLSGKPLYILVEYEGE

SEQ ID NO: 49478 - protein, 585 aa, Mycobacterium leprae TN
MTDLIQAPESEQTWPASALGPQQRAAAWERFGTEQFDVVVIGGGVVGSGCALDAATRGLKVALVEARDLASGTSSRSSKMFHGGLRYLEQLEFGLVREALYERELSLTTLAPHLVKPLPFLFPLTKRWWERPYIAAGIFLYDRLGGAKSVPAQKHLTRAGALRLSPGLKRSSLIGGIRYYDTVVDDARHTLTVARTAAHYGAVVRCSTQVVALLREGDRVIGVRVRDSEDGAVTEIRGHVVVNATGVWTDEIQALSKQRGRFQVRVSKGVHVVVPRDRIVSDVAMILRTKKSVMFIIPWGNHWIIGTTDTDWNLDLAHPAATKADIDYILQTVNTVLATPLTHADIDGVYAGLRPLLAGESDDTSKLTREHAVAVPVAGLVAIAGGKYTTYRVMAADAIDAAVAFVPARVAPSITEKVGLLGADGYFALINQVEHVAALQGLHPYRVRHLLDRYGALIGDVLALAAEAPDLLSPIQEAPGYLKVEARYAVTAEGALHLEDILARRMRVSIEYPHRGVACAREVADVVAPVLGWTAEDIDREVATYNARVEAEVLSQAQPDDVSADMLRASAPEARTKIIEPVSLT

SEQ ID NO: 49479 - protein, 386 aa, Desulfotalea psychrophila LSv54
MKIHEYQAKQLFRKYSIPVPEGLLCTNLQEVKTALKSLQLPIAVKAQIHAGGRGKGGGVKLGKTATEVVQYADDILGMSLVTAQTGPSGRTVSKILLEEGVSIARELYLSILVDRERACITIIACQDGGMNIEEVAASTPERIGKIHINPLIGPRSYHINQAREWLNIAQEQARAFSLFIHALYKLFLDYDCSMVEINPLIITEDNQLIALDAKVDTDSNALFRQRELQKMHDPAEDDPAEAEAAKFNLNYIKLSGNVGNMVNGAGLAMATMDIIKRAGAEPANFLDVGGSADAERIENGFRIILADTNVKAILINIFGGILRCDILAQGVVQAAAKVSLQVPVVIRMEGTNVKEGREILAKSGLSLINATDLNDAAEKISTLLTD

SEQ ID NO: 49480 - protein, 158 aa, Zea mays
MAWVSPLARIGASTLLKARSQSLPAALYHEKVIDHYENPRNVGTLDKKKSSVGTGLVGAPACGDVMKLQVEVDENGKIVDAKFKTFGCGSAIASSSLATEWVKGKTVDEALKLKNTDIAKELCLPPVKLHCSMLAEDAIKAALADYRIKQESLKNQSA

SEQ ID NO: 49481 - protein, 336 aa, Zea mays
MGSGEEPSQMRRALVDSLAGAISGGISRTVTSPLDVIKIRFQVQLEPTTSWGILRRDVYGPSKYTGLLQATKDILREEGLPGFWRGNVPALFMYMPYTAIQFTVLHKLKTFASGSSRTEDHLDLSPYLSYVSGAIAGCTATIGSYPFDLLRTILASQGEPKVYPNMRSAFIDIIKTRGVQGLYSGLSPTLVEIIPYAGLQFGSYDTFKRSMMTWNRYKYSHLSFGSEDDSVSSFQLFLCGFAAGTFSKAACHPLDVVKKRFQIEGLKRHPRYGAPIESSTYKGMYHALKEIVVKEGFGGLYKGLFPSLVKSAPAGAVTFVVYEYISDWIGCKAGVE

SEQ ID NO: 49482 - protein, 549 aa, Mycobacterium leprae TN
MTSVTDHSAHSMERAAEHTINIHTTAGKLAELHKRTEEALHPVGAAAFEKVHAKGKFTARERIYALLDDDSFVELDALARHRSTNFGLGENRPVGDGVVTGYGTIDGRDVCIFSQDVTVFGGSLGEVYGEKIVKVQELAIKTGRPLIGINDGAGARIQEGVVSLGLYSRIFRNNILASGVIPQISLIMGAAAGGHVYSPALTDFVVMVDQTSQMFITGPDVIKTVTGEDVTMEELGGAHTHMAKSGTAHYVASGEQDAFDWVRDVLSYLPSNNFTDAPRYSKPVPHGSIEDNLTAKDLELDTLIPDSPNQPYDMHEVVTRLLDEEEFLEVQAGYATNIVVGLGRIDDRPVGIVANQPIQFAGCLDINASEKAARFVRVCDCFNIPIVMLVDVPGFLPGTEQEYDGIIRRGAKLLFAYGEATVPKITVITRKAYGGAYCVMGSKNMGCDVNLAWPTAQIAVMGASGAVGFVYRKELAQAAKNGANVDELRLQLQQEYEDTLVNPYIAAERGYVDAVIPPSHTRGYIATALHLLERKIAHLPPKKHGNIPL

SEQ ID NO: 49483 - protein, 514 aa, Mycobacterium tuberculosis CDC1551
MPHSAALNAARRSADLTALADGGALDVIVIGGGITGVGIALDAATRGLTVALVEKHDLAFGTSRWSSKLVHGGLRYLASGNVGIARRSAVERGILMTRNAPHLVHAMPQLVPLLPSMGHTKRALVRAGFLAGDALRVLAGTPAATLPRSRRIPASRVVEIAPTVRRDGLDGGLLAYDGQLIDDARLVMAVARTAAQHGARILTYVGASNVTGTSVELTDRRTRQSFALSARAVINAAGVWAGEIDPSLRLRPSRGTHLVFDAKSFANPTAALTIPIPGELNRFVFAMPEQLGRIYLGLTDEDAPGPIPDVPQPSSEEITFLLDTVNTALGTAVGTKDVIGAYAGLRPLIDTGGAGVQGRTADVSRDHAVFESPSGVISVVGGKLTEYRYMAEDVLNRAITLRHLRAAKCRTRNLPLIGAPANPGPAPGSGAGLPESLVARYGAEAANVAAAATCERPTEPVADGIDVTRAEFEYAVTHEGALDVDDILDRRTRIGLVPRDRERVVAVAKEFLSR

SEQ ID NO: 49484 - protein, 333 aa, Rickettsia akari str. Hartford
MTLLLQSSQNVATAHTRIKQYLHLTPIVHSESLNEMLGHEIFFKVESLQKTGAFKVRGVLNHLLELKEQGKLPDKIVCYSTGNHGVGLAYASKLFGLKTRIYLPLNTSKVKQQAALYYGGEVIYTYTRQEAEEKAKEDEKQGFYYIHPSDSDSTIAGAGTLCYEALQQLGFSPDAIFASCGGGGLISGSYLAKELISPISLLIGSEPLTANDAYLSVKNNKIYKFDKAPTTIADGLKTLSVSARTFEYLKKLDHFYLAEEYEIYYWTAWLTNLLKVICEPSSSINMVSVVNWLKIQSKPQKLLVLISGGNIDPILYNELWKEEYLTVPPSITN

SEQ ID NO: 49485 - protein, 153 aa, Escherichia coli
MRIFVTVGTTSFDSMIENIDQYFNENKKYNVNFQIANGNYIPKSGAFFSFRDDVDVFYNDADVIITHAGAGTLYQLLEKGKKIIAVPNLERIDKHQVDIATYMERNHYLLVCWDYNEIGDLLKSIHNFKPNPYYKIEFDKGKEIADYIRSLYS

SEQ ID NO: 49486 - protein, 276 aa, Debaryomyces hansenii CBS767
MTKFRGCIDIHSGQVKQIVGGTLTQDDTTELNHKSTTTENFVSTKPSSYYAELYKNAGINGCHVIKLGSNPENDEAAKLACQLWPNNLQVGGGINGDNALEWLDVHKASHVILTSWLFSDSDEGKEFDWVKLKRVSELVGKSRLIVDLSCRELRVDDKIEWVVAMNKWQTLTNNKLSAEFLGEVSQYCDEFLIHAADVEGLCNGIDVNLVAKLGEWCPEGFEGKIVYAGGARLVKDLDTVSKLSDDKVDLTYGSALDVFGGKLVKFDDLVSWNELH

SEQ ID NO: 49487 - protein, 682 aa, Candida albicans SC5314
MNPSNNSDEEDQADYDDKEDDDISDEEPVNPADEEDLKDYVPGGYHPCYIGEEYKNGKYTLVRKLGWGHFSTVWLARDNDKHCHVAMKVVRSAKHYTETAIDEIKLLDKVTTSDIHHPGHQHVIQLLDTFTHKGPNGVHVVMVFEVLGENLLGLIRRYKHRGIPVVFVKQIAKQLLSALDFLHRQCGVIHTDLKPENILIEIGDVEQIVKLVEEENLQRKLQRKLSRTASKTSTPISATPNSSFSNHANTTTTTTTTTAKKISINDSIISPNTSSTALTSSNSFINHSPSLGRSGRRTRRTTLITGSQPLPSPLRSFNKSFTNVYGLSSSTTNTPVRNISINSNNFSFINNSNTTANTTTNGLATTTEDHEEDGENQTLNNSLSSMSITNSHSNSNSYQPTATTNVDPVQIPQESNYSLDDSSANVVEDIINDNELISVKIADLGNACWTNHHFTDEIQTRQYRAPEILIGYYWGASSDLWSFACLIFELLTGDYLFDPRDGKSYKKDDDHIAQIIELIGPFPNQMLKESYYAREFFNSRYELRRIMKLKPWGLQDVLIEKYKFPLNDAIEISEFLLPMLKLKPEERADAGGMLNHPWLRDALGLENVVLERPVGGSGEDIPGWSREISTTTQQSMCSNNHNHNNTHNNNYNHQADQELQSQQSRKYSNASSFGHKSQPFYH

SEQ ID NO: 49488 - protein, 208 aa, Oryza sativa
MGRAKSKGPKFAAVKKIITKKTIQKYKEDVLNPKKKDNEKEKLGRNVPQVSSALFFSYNTALGPPYRVIVDTNFINFSIQNKLNASLTPMQLDLEKGMMDCLYAKCTPCITDCVMAELEKLGQKYRVALRIAKDPRFQRLACTHKGTYADDCIVERVTQHKCYIVATCDRDLKRRIRKVPGVPIMYITRHRYSIERLPEATIGGAPRI

SEQ ID NO: 49489 - protein, 70 aa, Triticum aestivum
MVNAIKGLFISCDIPMAQFIVNMNASMPASEKFIVHILDPTHMFIQPNMGDYIKSKMAEFRDQNNYEKPT

SEQ ID NO: 49490 - protein, 546 aa, Chlamydophila caviae GPIC
MQSSEMKPFSRLRAYFCPIYRSEFPKFIPLFWLAFFVGFNYCLLKSMKDTLVVVGSDAGAEVIPFLKVWGIVPGAVIVTMIYGWLSSRCPRDTVFYSFIGTFLGFFFLFAVVIYPMGDALHLHSLADRLQELLPKGLRGFIVMIRYWSYSLYYVMSELWSSVVLSTLFWGLANEVTSVREAGRFYALINTGLNLSSVFAGEISYWMGKHSFFIYPFVKDKWHEVMMNLTILIVLAGLCMIWLYRKVHFLTQHTYNFSTAFAPSEAPPQVEESVASVKAKKKTKTKAKSLFLYLIRSRYLLGLAIIVLSYNLVIHLFEVVWKDQVSQIYSSHVEFNSYMSRITTLIGIVSVCAAIFLTGQSIRKWGWTVGALTTPIVMLVTGVLFFAAVFAVKRDVMIFGGFFNMAPLAIAAWIGGMQNVFSRAAKFTFFDQTKEMAFIPLPNDQKNYGKAAIDGVVSRIGKSGGSLIYQGLLIIFSSVAASLNVIAVVLLLIMVVWIAVVAFIGREYNIKEASAVAESSKADAIASNATISRTTVENSNKEEVATL

SEQ ID NO: 49491 - protein, 320 aa, Debaryomyces hansenii CBS767
MSPRHLVSIQDLLVQELESLVEQATNFKAQYKSNENAQENHNKLLGKVIALLFSKRSTRTRISTEGAAAFFGAHAMFLGKDDIQLGVNESLYDTTRVISSMTSCIFARVNKHQEILDLCKDSSVPIINSLCDRYHPLQAITDILSIKESFNGNIKGLKLAWIGDANNVINDLSIAALKLGMNVSIAIPGSISFDSLIADKANQIAKELNVSFEIVNEPAKALNGANVIVTDTWISMGEEAEKQNKLKQFNDFQITKDLISRGNVNSDWRFMHCLPRHQEEVDDEIFYSDNSIVFEEAENRLYAAMAVIDEFVVGNKTVSK

SEQ ID NO: 49492 - protein, 500 aa, Oryza sativa Japonica Group
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNRHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 49493 - protein, 211 aa, Listeria innocua Clip11262
MAEGLRTIYFVRHGKTEWNMTGQMQGWGDSPLVAEGIDGAKAVGEVLKDTPIDAVYTSTSKRTQDTAAYILGDREIEIQPLEELKEMSFGTWEGIRVTEIDEQHPEERAKILHSPETYKAEVNGGETYYELAERLLEGVEKIIAENPSGNILVVSHGMSLTLLLYLLQGGTIEDHRKEAPRILNTSISIVEYQNGEFSLKKLNEVGHLDLK

SEQ ID NO: 49494 - protein, 171 aa, Acidianus ambivalens
MPRYAIIDSDTASDDTIAILLASKFFKLLGITIVAGNVKFENEIKNALFTVEYFNLDVPVFIGSSRPIMGKWSTVEEVHGNNGIGDWKIEEPKISPEKEHAIDAIIRLSKEYEGELEILAVSPLTNLALAYLKDPTIVKRIKKVWIMGGAFSRGNTTPIAEFNFWVDPEAA

SEQ ID NO: 49495 - protein, 322 aa, Arabidopsis thaliana
MASRIAKDVTELIGNTPLVYLNNVAEGCVGRVAAKLEMMEPCSSVADRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 49496 - protein, 338 aa, Arabidopsis thaliana
MRETKKEEEEVEEEEAMNALAATNRNFKLAARLLGLDSKLEKSLLIPFREIKVECTIPKDDGTLASFVGFRVQHDNARGPMKGGIRYHPEVDPDEVNALAQLMTWKTAVAKIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFGTEALLNEHGKTISGQRFVIQGFGNVGSWAAKLISEKGGKIVAVSDITGAIKNKDGIDIPALLKHTKEHRGVKGFDGADPIDPNSILVEDCDILVPAALGGVINRENANEIKAKFIIEAEIIQLIRTRMRS

SEQ ID NO: 49497 - protein, 358 aa, Solanum tuberosum
MSCYKGKYADELIKNAAYIGTPGKGILAADESTGTIGKRLSSINVENVESNRRALRELLFCTPGCLQYLSGVILFEETLYQKTAAGKPFVEVMKEAGVLPGIKVDKGTVELPGTDGETTTQGLDGLAERCQKYYEAGARFAKWRAVLKIGANEPSQLAINDNANGLARYAIICQQNGLVPIVEPEILVDGAHDIQKCADVTERVLAACYKALNDHHVLLEGTLLKPNMVTPGSESPKVAPEVIAEYTIRALQRTMPPAVPAVVFLSGGQSEEQATVNLNAMNKLQTKKPWSLSFSFGRALQQSTLKAWGGKEENVQKAQAAFLTRCKANSDATLGKYAGASNLSEGASESLHVKDYKY

SEQ ID NO: 49498 - protein, 164 aa, Acidianus ambivalens
MATKVSQIATTKVYVVKPNVTIAEAAKEMKEHNLGSLVVIDSQNRVVGIITERDIVKAASNRDIDSPVEKYMTKDVKGVTEDTEVTDALDIMLNNGFRHLPIIKSNGKLYGIVSIRDLARALLDVHTMQFGKPAEEVKGTGVICPVCGMEIDEYGYCGCGTGSG

SEQ ID NO: 49499 - protein, 535 aa, Rhodospirillum rubrum ATCC 11170
MSVIRSAIDPHGADFRANHLKMTALVDDLKRQVATIKAGGGAAARERHEGRGKLLPRERVRALLDIGSPFLEIGQFAAHGVYDDAVPAAGLIAGIGRIEGVDCVVVANDATVKGGTYYPLTVKKHLRAQEIAGENNLPCVYLVDSGGAFLPRQDEVFPDRDHFGRIFYNQAMLSAAGIPQIAVVMGSCTAGGAYVPAMCDEAIIVRDQGTIFLGGPPLVRAATGEVVSAEDLGGADVHCRISGVTDHYAEDDRHALALARRVVATLNRTKRVGLALRPPEEPLYDPAELYGIIPTDTRKPYDVREVIARLVDGSRLDAFKALYGPTLVCGFAHVFGYPVGVVANNGILFGDAARKGAHFVELCAKRAIPLIFLQNISGFMVGRKAESAGIARDGAKMVTAVACARVPKFTVLIGGSFGAGNYAMCGRGYGPRLLWSWPNSRISVMGGEQAATVLAQVRRDALESQGTPWSEVEEEAFKQPLRAQYETQGHPYYASARLWDDGIVDPVDTRMVLGLSISAALNAPVAETTFGVFRM

SEQ ID NO: 49500 - protein, 366 aa, Bacillus cereus ATCC 10987
MGLTAGIVGLPNVGKSTLFNAITQAGAESANYPFCTIDPNVGIVEVPDERLNKLTELVEPKKTVPTVFEFTDIAGIVKGASKGEGLGNKFLSHIRQVDAICQVVRCFEDENITHVSGKVDPIDDIETINLELILADLESVDKRIERVAKLARQKDKEAVYEHEILVRLKEAFEEGKPARTVEFTEEQMKIVKGLHLLTTKEMLYVANVSEDDVIDPSENKYVQMVKEFAANENSEVIVVCAKIESEIAELDEEEKKVFLEELGIEESGLDQLIRAAYDLLGLATYFTAGVQEVRAWTFKQGMKAPQCAGVIHTDFERGFIRAETVSYEDLMTNGSMTAAKEAGKVRLEGKEYIVKDGDVMHFRFNV

SEQ ID NO: 49501 - protein, 388 aa, Solanum lycopersicum
MKPKPTPTPYYYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPSPKYVYKSPPPPPYYYKSPPPPSPSPPPPYYYKSPPPPSPSPPPPYYYKSPPPPSPSPPPPYYYKSPPPPSPSPPPPYYYKCPPPPSPSPPPPYYYKSPPPPSPSPPPPYYYHSPPPPVNSPPPPYYYSSPPPPVKSPPPPVYIYGSPPPPVHY

SEQ ID NO: 49502 - protein, 550 aa, Treponema denticola ATCC 35405
MITVSDLSLKFGDRPLFKDVNLKFTKGNCYGIIGANGAGKSTFLKVLSGELEHDSGEFSITPGERMAVLRQDHFAFDEYSVKDTVFMGYPKLYNVRNEREAIYAKENFSEEDGIRASELEAEFADLNGWEAENQIEQILSGLGLDENYHDRMMSELDEGQKVRVLLAQAIFGTPDILLLDEPTNGLDLESIAWLEEFLIDFPNIIIVVSHDRHFLNAVCTHVCDIDYGKIRMYSGNYDFWYQMSRIMQRQAKDQQKKREEKMKDLREFILRFASNAAKSRQATSRKKVYDKLALEEIEVTSRKFPYVHFKPNREIGNNVVRTEKIFYKTPDTAEEKGIQLLSDFSFTVNRTDKIAFVGQEHNSKTALFDILTGKLNPDSGDVYWGQTVSHAYLNKDNAEYFNNDLNITEWLKQYSPDQDDAYVRGFLGRMLFSGDESLKPVNVLSGGEKVRCMLSKLMLSGANVLILDEPTNHLDLEAITSLNDALVEFPGVILFNSHDHEFISSIANRIIEITPNGVIDRMMNFDDYIKDEHVKKLREELYGNTKKMQI

SEQ ID NO: 49503 - protein, 204 aa, Oryza sativa Japonica Group
KVINRRKMQLLGVACLLIASKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKYKFVAKKYSPPSIPAEFFEDPSSYKPD

SEQ ID NO: 49504 - protein, 609 aa, Treponema denticola ATCC 35405
MSRLEIFSQNRSQIIIEELYENLQHRIEASPPGLCPVYITRAFIEMCHAQTCGKCAPCRIGLLQLKHILTDVLNGKSTMKTLDLIEETAKSIRETADCALGYEAADMVYKSIIYCRDDFEEHIKHGRCGCITTQPVPCVALCPANVDIPGYIALVRDERYADAVRLIRKDNPFPSTCAFICEHPCEHRCRRNMVDTAINIRGLKRVAVEFAGKVPPPPCAPSTGKSIAIVGGGPAGLTAAYYLQLMGHQTTVYEMLPKLGGMLRYGIPNYRLPKDRLDEDIDAILETGVKVVYGKKIGTDIELNELIKDNDAAIIAIGASTDKKLGLEGEDSEGVISAVQFLRDVGMDKGMDLTGKKTAIIGGGNVAMDAVRTAVRLKSEKVTCLYRRRVADMTALPAEIEGALAEGVEMMTLKAPSKLEVKNGKLTGVWVTPQMISKIKDGRASVVSTGEPDIFIPCEVLVVAIGQDIETQHYEDSGIPVDRGKLFTMPSASFQGMPGLFSGGDCASGPATVIKAIAAGKVMAANIDEYLGYSHTISCDIEIPIPNIDDRLACGRVELGEREASERIKDFEGVEFCMSKKEACQESNRCLKCDHFGFGIFKGGRERLW

SEQ ID NO: 49505 - protein, 169 aa, Nostoc sp. PCC 7120
MDAIFIPQLTKAPERTEEVQVKEFLPGLETLTPVRGLVRIQHQGNYLQVSAQAEAIITCTCNRCLQQYNQRLAVNTQEVIWLDEAVEQEQNLPLEREVAMEDLLETVSPNGYFYPSEWLYEQMCLALPQRQLCDINCPGILTDNSGESSEQGIDNRWSGLKALKKQLPG

SEQ ID NO: 49506 - protein, 251 aa, Pseudomonas syringae pv. phaseolicola 1448A
MRRPMVAGNWKMHGTRASVAELIEGLGKQVLPGSVDIAVMPASLFTNQVIEGLRATSIIVGAQDAAIQAEQGALTGEIASSQLADAGCKLVLVGHSERRQLIGEQDDVLNKKFAAIQASGLTPVLCIGETLEERKAGQTLEVVGRQLDSVIAEFGVSALINAVIAYEPVWAIGTGLTASPQEAQEVHAAIRAHLAKENAEVAQGVRLLYGGSVKAANAVELFSMPDIDGGLIGGASLNADEFGAICRAAGN

SEQ ID NO: 49507 - protein, 144 aa, Candida albicans SC5314
MFRTTLLKSLRASVSKPSMVKTIQSSSRSLFTITTITNNKNVTPLTSSMNFIRCYSAFPELTRDIAKERIIELLEGYDKVDQSKGEITEQNSFTSDLGLDSLDVVEVIMELEHEFNIQIPDNEADSLKTVGQTIDYILAQPDSC

SEQ ID NO: 49508 - protein, 197 aa, Pseudomonas fluorescens Pf-5
MFSTTDGESTMPIINSQVKPFKATAFKNGAFVEVSDADLKGKWSVVFFYPADFTFVCPTELEDLADNYAEFQKLGVEIYSVSTDTHFAHAAWHNTSPAIGKIQYTMIGDPTLAISRNFDVLIEEAGLADRGTFVINPEGQIKIVEINDGGVGRDASELLRKIKAAQYVAAHPGEVCPAKWKEGEATLAPSLDLVGKI

SEQ ID NO: 49509 - protein, 522 aa, Oryza sativa Indica Group
MAISLITSLLFSLPQQWQPVVLTGLLPVIVSLVLLARKGRLKMPPGPEQVPLLGNLHQLAGPQPHRALRDLARVHGPVMRLRLGKASAVVLTSAEAAWEALRGHDLDCCTRPVSAGTRRVTYGMKNVAFAPYGAYWREVRKLLMVELLSARRVKAAWYARHEQVEKLLSTLRRAEGKPVALDEHILSLSDGIIGRVAFGNIYGSDKFSQNKNFQHALDDVMEMLSGEGSSAEDLQLPAAVGRLVDRLTGFAARRERIFRQLDSFFEMVIEQHLDPNRAPPENGGDLVDVLIDHWKKNEPRGTFSFTKDNVKAIIFSTFVAGIDTNAATILWAMSELARKPRVLKKVQAEIRAAVGVNGRVQPDDITKLSYLRKVVKETLRLHPPTPLLLPRETMRHIQISGYDVPAKTRIYVNAWAIGRDPASWPDEPEEFNPERFEANEIDFKGEHPELMPFGTGRRICPGMAMAMANVEFTLANLLFAFQWSLPEGTTPDNVCMEEEGRLVCHRKTPLVLVPTVYRHGLE

SEQ ID NO: 49510 - protein, 288 aa, Candida albicans SC5314
MFKDLTDSKDIYKSLITVPTANYTLLNNSFEFNPLILEKKQWPNIPNNEDLHEFKLPVVLQDILTEMTNQYQTLDVKYKNRQLDWTNYKLHQITMSAQFDQGEKEITGNLLQIVLLLLFTAEDDNGYTIEQLSSMTGINNTQFLTKIVNSITNDKYAILRYDGNRYYYNSSFKDKSTRIKLPMIKELSRSEQQQQQQQEKQVKGMNDIDSVESTVQANRDDEIKSCVVKIMKQERQLTIIELLNKSISVLQNRRPVTMTNLKTIIENLIELEYLKRDDHNKNIIIYIP

SEQ ID NO: 49511 - protein, 283 aa, Arabidopsis thaliana
MKGIARLVTSLSRIGGRKVVSGTSTVTSSSSSSLLLSRRSLFISATNLLNSRTKDSALPSLNSSLLAQKWNFLGGQRRTMFIQTQSTPNPSSLMFYPGKPVMEVGSADFPNVRSALGSPLAKSIYSIDGVVRVFFGSDFVTVTKSDDVSWDILKPEIFAAVMDFYSSGQPLFLDSQAAAAKDTAISEDDSETVAMIKELLETRIRPAVQDDGGDIEYCGFDPESGIVKLRMQGACSGCPSSSVTLKSGIENMLMHYVSEVKGVEQEFDGEDEEGTLSGEMRVE

SEQ ID NO: 49512 - protein, 272 aa, Arabidopsis thaliana
  misc_feature (87)..(87): Xaa can be any naturally occurring amino acid
RGSSSCIKREAKVISLGDEVDDISQVFHCDGLLLCISITQAKTRLVVWNPYWGHTRSIEPTHQFNKFDSYSYALGYDKSSKSHKILXDWQLGTINSGVSLKGNAFWVAEEKYYETSETNEEFFLLSFDFTRETFGPLLPLPFQFVESEDALSVSNVRDEQLAVLYQPWDTLMMEIWVTSKIEPNAVSWNSKVFLSVSIRKLIGPQFQFCLGSFFIDEEKKVAVVFDKGYRIQRYIAYIIGVDGSMKEVDLGESDRGCYPIVWSYVPSLVQLN

SEQ ID NO: 49513 - protein, 251 aa, Vitis amurensis
MDSDHEEFSASSSSSSSRTNPNSSDSLLPLQCIGHKRKAGRKKFRETRHPIYRGVRQRNGNKWVCEVREPLKKSRIWLGTFPTPEMAARAHDVAALALRGRFATLNFPDSAWRLPRPKSSSAEDIQVAALEATKAFNPTAPPSSSLASALDNMSGVADSKKVLETSPNVESPKLKSQRMVLEVSPVDTKRSEKVGDGSTTVFMDEEAMFNMQGLINSMAVGLLLTPPAMCKGFSWDDATDSHIDLSLWNDD

SEQ ID NO: 49514 - protein, 231 aa, Idiomarina baltica OS145
MVTKVAENIVKSLGQIRQNINAMAEQTTYRESVRLLAVSKKHSAEAIRVAYEAGQREFAENYVQEGVAKVQQLQALDITWHFIGPLQSNKTKLVAEHFDWVQSIDREKIARRLNDQRSGALPPLNVLLQVNIDNDPNKSGVKKSDINALAKFVSKCPHLKLRGIMTILEADTDEKQQLDSFTSMRELYQQLQQLHPSVDTLSMGMSGDMRQAIHAGANMVRIGSAIFGQRE

SEQ ID NO: 49515 - protein, 253 aa, Vitis amurensis
MDLDRESSASSSSSTSSPSRANPVSSDSRCPSRCISHKRKTGRKKLRKTRHPIYRGVRQRNENKWVSEVREPSKKSRIWLGTFPTPEMAARAHDVAALALRGHFASLNFPDSAWRLPRARSSSAGDVQFAAIQAAKAFQQPPSSSSSTPFVMDNMSAGSRKILETSSIVDTPQLKSQKKVEGVSSVDSKSWEKAGDGFPTAFVDEEAVFNMPGLIDSMAEGLLLTPPAMCKGFSWDDAVSHIDLSLWIHDFLP

SEQ ID NO: 49516 - protein, 273 aa, Idiomarina baltica OS145
MNDIRKIAFIGAGNMTQSIVGGMCKSGYPADHVFVSNPSPEKLEKMKSNLGVNTSQDNIEVIEQADVIVLSVKPQLMEQVCADIKSKVSNLADKLIITIAAGIRMPKYRTYLGDDITIIRVMPNTPSLVGQGMSGLVTDSADDKDKAYVTDVFDGVGDTLWVADEDQLDILGAVAGSGPAYFFEFMDSLAKGATELGFDPEKARAMVQQTCLGAAQMAKESDLTLEDLRKQVTSKGGSTAKGVEVYQQRDLHNISADAVKAAVKRNQEMADLF

SEQ ID NO: 49517 - protein, 239 aa, Vitis amurensis
MESERDQSSPSSSSSSSQTKCSISSSPVHKRKAGRKKFRETRHPVYRGVRQRNGNRWVCEVRDPKNKSRIWLGTFPTPEMAARAHDVAALAFRGDFAALNFPDSTSRLPRAKSSSARDIQVAALAAAMAFRPAAPSSSSSYISHVTACSEELETSCSEDSPQLESRKKVVGVTLEDSESSQSAPHGSSTVFMDEEALFNMPGLINSMAEGLLLAPPTMLGGFSWDDTTSYTDLSLWNDD

SEQ ID NO: 49518 - protein, 848 aa, Ashbya gossypii ATCC 10895
MSRQVHTGRSSSDDTGAPQWPSRNSVLNDDIEALQAEYDQLKAGEVHSAQGATHGDIGSRQYSGSGKPAAQYLGLNVNSREAVPEYEETVVSVKDYYNYKLRGFISLNTARDYALSVFPLHRWIHHYNVAWMYADMVAGITVGCVLVPQSMSYAQLASLSPQYGLYSSFVGAFIYSFFATSKDVCIGPVAVMSLETAKVIARVTENLPEDTNITGPIIATALTLLCGAIAMVIGILRLGFLVEFISITAVTGFMTGSALSIISGQVPSLMGYSKKVNTRATTYKVIIESLKHLKDTNMNAAFGLVPLVLLFLWKWICGSLGPRLVDRYLQFKPSRASRWNAAFFYLQALRNAVIIVVFTAISWGISRHKLEKPPISLLGKVPSGLKNVGPLELPEGLVEKLLPELPAATIILLLEHIAIAKSFGRINNYKVVPDQELIAIGVTNLFATFFNAYPATGSFSRSALKAKCNVKTPLSGLFTGACVLLALYCLTEAFYFIPKATLSAVIIHAVADLIASYKVTWMFWRTNPLDFFAFIVTVIITVFSSIEHGIYFSISWSCAVLLCKVAFPDGKFLGYIDVAEVIEPAGPPSINSEADLASIDNSATFQQIDKDGGKLNTVESVLPDPHTRFHRRWIPLDHAYSRELNPEAVVNPPPPGVIVYRPTDSWTYLNCSRHFDIILDHVKEHTRPGQLVNHLSNKERLWCDPGPWRPPRIFRRFIADKRTGSAVADARPVLRVLAMDWSQVSQVDSTGIQNLVDLRNALNKYADRPVEFHFAGIVSPWIKRALVNTGFGIADPPLISSRVSYHLVRLPADPPHIVHGHSVVFALGTNTPFFHLDMPDFETWRHDA

SEQ ID NO: 49519 - protein, 328 aa, Campylobacter jejuni subsp. jejuni NCTC 11168
MKILISGGAGYIGSHTLRQFLKTDHEICVLDNLSKGSKIAIEDLQKTRAFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAGKRDKLFIFGDDYDTKDGTCIRDFIHVDDISSAHLAALDYLKENESNVFNVGYGHGFSVKEVIEAMKKVSGVDFKVELAPRRAGDPSVLISDASKIRNLTSWQPKYDDLELICKSAFDWEKQC

SEQ ID NO: 49520 - protein, 413 aa, Oryza sativa Japonica Group
MDTEPLLSPLSPSPHLLHPLPEHAEVSTFSPPLSPCPSPASSYKERIIFGAHPPPPPPPPPPPPPPPRGRRYYRRVSGDDLDVPSCSSSPSPPSDEENPPPNPPSLFDFIGGRTNLHRSRTAPAMAPLNAAAIAAAAASGDSRNPPPPPRRPAIVLHAFLFLLAYLAMGVTFYAALPGNFTSSAGPTHPVADALYFCIVTLCTIGYGDITPATPAAKLFSISFVLIGFGFVDILLSGMVSYVLDLQEHLLITALKNPRSVRKHRHNYIFDLKKGRMRVRMKVALALTVVAICVGVGAAVLKRVENLGWLDAVYLAVMSVTTVGYGDHAFRTLAGRLFASAWLLVSTLAVARAFLYLAEMRIDKRHRAMANWVLSRDMTVSEFLAADIDNNGYVTKYVHRYFLVLADDDLAIYN

SEQ ID NO: 49521 - protein, 323 aa, Gibberella zeae PH-1
MLDQMANEIKLISGSSHPEISAKVASRLGIEIANTMSLNYSNRETSVSIGESVRDEDVFILQSTAPGDVNDGLMELLIMIHACRTASARRITAVIPSFPYARQDKKDKSRAPISAKLIANMLQVSGCNHVITMDLHASQIQGFFNVPVDNLYAEPSVLRWIRENLNVENCVIVSPDAGGAKRATSLADRLNTGFALIHKERPRPNVVGRMVLVGDVQDKVAILVDDMADTCGTLAKAAETVHKHGASEVYAIVTHGILSGKAIDTINSSVLSGLVVTNTVPLGDKIERCPKLKVIDVSGTLAEAIRRTHNGESVSYLFNNAPV

SEQ ID NO: 49522 - protein, 206 aa, Triticum aestivum
ARGPSPPPTLGSQPRRAAMADSGDSSPHSAADDAHHHHLPDPTTNASPETIASQAAAAPAVSAPPPVPAVPAKVRLMVSYGGRIQPRPHDNQLSYVNGDTKILSIDRPLRYPDFYARLAGLAAARADLCVKYQLPGEDLDALVSVTNDEDLDHLVIEYDRLHLFRAPAAPGSGGSSRGGSTPRLRVFLFPVAPPPRPASPPKQQHQ

SEQ ID NO: 49523 - protein, 89 aa, Zea mays
MAQPVFLSSLRSRLCSAPPSPHHHLQPSRGYHVELGAREKALLEEDVALKRFKSYKNSVKQVSKIGNVLTLAVVFVCSYELGVLAASMK

SEQ ID NO: 49524 - protein, 543 aa, Hordeum brevisubulatum
MGWGLGDPPADYGSIMAVGLIVALMCICIIVGHPLEENRWMNESTTALLLGLGAGTVILFASSGKNSRLMVFSEDLFFIYLLPPIIFNAGFQVRKKQFFRNFMTITLFAVVGTLISFSIISLGAMGLISRLNIGALELGDYLALGAIFSATDSVCTLQVLSQDETPFLYSLVFGEGVVNDATSVVLFNAIQTFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSIALSSIILALVLVARAAFVFPLSYLSNLTKKTAGEKISIRQQVIIWWAGLMRGAVSIALAYNKFAKSGHTQLPSNAIMITSTIIIVLFSTIVFGLLTKPLIRLLIPARHLTREVSALSEPSSPKSFLEQLTVNGPETDVENGVSIRRPTSLRMLLASPTRSVHHYWRKFDNAFMRPVFGGRGFVPFVPGSPTESSVPLLAHGSENQNH

SEQ ID NO: 49525 - protein, 174 aa, Triticum aestivum
  misc_feature (157)..(157): Xaa can be any naturally occurring amino acid
MAPAVMASSATTVAPFQGLKSTAGLPVSRRSSGRLGRVSNGGRIRCMQVWPIEGIKKFETLSYLPPLSTEALLKQVDYLIRSRWVPCLEFSKVGFVFREHKSSPGYYEGRYCTMWKLPMFGCTDATHVLNKLEEVKKEYPDAYVRVIGSDNLRQVNXASLIASRPPGCEESGKA

SEQ ID NO: 49526 - protein, 479 aa, Desulfotalea psychrophila LSv54
MGTTEMKVKIVVLGAGPGGYVAAIRAAQLGGDVTVIEKENVGGTCLNWGCIPSKIYKQSADTLNSIKDSASFCIDGISEGKLNLERLQERTKGIIASQSKGIHGLLAKNSISYIGGEAKMSGSHSLSVTRKDGETEEVQFDKLIIATGSTPMALPFLPFDGDRILSSDHIFSLKEIPESITIIGGGVIGCEFACILQSFGVEVTLVEGLERLLPLPSVEEECSKLLLREMKKKKIKVELKTTLASASQKNGMVQLNLVSQGKNGTEKAKQIESEKVLVCIGRRASSASLDLDQAGVETTKRGWISTGANLQTTVPHIYAIGDVLGPERIMLAHTASTEAEIAAENCFGGAEEMNWQVMPSAIFTMPEIGCVGLSEAQAAELYGKENIRAESSLFRTLGKAQVIGELAGVTKIVCAKEDGKILGIHIAGAHATDLLGEATLAVSNGITAKQLTKTIHAHPTLAEILLETAFKIEDMPLHG

SEQ ID NO: 49527 - protein, 426 aa, Herminiimonas arsenicoxydans
MEAVGLKLAVGSACTIPLANGARIEAEVVGFEDDRLFLMPQSDVEGIVPGTRVFPVEVVQSLPKPGAVSHPRRRPSDRTRHLPVGMELLGRVLDGAGRPLDSLGPLHATHSGPLNVRAANPLTRAPITDVLDVGVRAINSMLTVGRGQRMGLFAGSGVGKSVLLGMMARYTTADVIVVGLIGERGREVKEFIEQILGPEGLARSVVVAAPADTPPLMRLQGAAYTTAIAEHFRDEGKDVLLIMDSLTRYAMAQREIALAIGEPPATKGYPPSVFAKLPALVERAGNGKEGGGSITAFYTVLTEGDDQQDPIADAARAILDGHIVLNRSLAEAGHYPAIDIEQSISRAMHNITTPEHQKQTRKLKQLTSRYQRNRDLISVGAYSAGSDPVLDEAIALNTKIESFLQQDITERSGINESLGQLASLFE

SEQ ID NO: 49528 - protein, 452 aa, Pseudomonas fluorescens Pf-5
MAYDFDLYVIGAGSGGVRCARFAAGFGAKVAVAESRYLGGTCVNVGCVPKKLLVYGAHFAEDFEQASGFGWSLGEANFDWATLIANKDREINRLNGIYRNLLVNSGVTLHEGHAKLIDPHQVEVNGQRYSAKHILIATGGWPQIPDIPGREHAISSNEAFFLNELPKRVLVVGGGYIAVEFAGIFHGLGADTQLLYRGELFLRGFDGAVRKHLQEELTKRGLGLQFNADIERIDKQADGSLEVTLKDGRKLVADCVFYATGRRPMLDNLGLENTGVKLDKRGFIEVDEQYQSSEPSILAIGDVIGRVQLTPVALAEGMAVARRLFKPEQYRPVDYQMIPTAVFSLPNIGTVGLTEEQAREAGHKVQIFESRFRPMKLTLTDCQERTLMKLVVDADSDKVLGCHMVGPDAGEIVQGLAIALKAGATKRDFDETIGVHPTAAEEFVTMRTPVAG

SEQ ID NO: 49529 - protein, 530 aa, Debaryomyces hansenii CBS767
MEDYERELLADLGSDFSDEEESENLNENNVELNTLQPIERISSQYTELKFEDKLRQLLNDEYNYSLQDRLDQVDITNVSDITQISKIFPIIPELQSHIEVYSRDDNCDYLDLLSSVNNENQSEEYSFILMVNELSQVINQEISLVHSFIKLQFKVVFSELETLVLNPVDYANIILLIKQDLSNIKRYESELMRIVSNEKVLVIIMSAMQHVKDQFVLNDQDFEMISKACRLVIDLNNVLNQLSEFISSKLSKFAPNVSAIVGPITTSQLLIASGSLRQLSLTASCNLPSLGVRDLSSQKTNKNVRQTGYLYHCELIKYLPPSIIRSAMRVLSGKVILAARIDLSQSCPSGSLGQKYLEEVTNKIEKLLTPPEAQGDKALPAPTEHKSKKRGGRRFRKMKERFQMSELRKAQNKMEFGKQEESVTDSFGEEVGLGMSRGGAGRLNIQANANTNAKMSKSLTNRLQLQKVSNNTFNDDFDSILLTNNANNSPTIVDNHTPNGSNKSKWFTGMVKRKREEDSTEPSDSKKLKF

SEQ ID NO: 49530 - protein, 279 aa, Pseudomonas fluorescens Pf-5
MIKKCLFPAAGYGTRFLPATKAMPKEMLPVVNKPLIQYGVEEALDAGLNEISIVTGRGKRALEDHFDISYELENQIKGTDKEKYLVGIRKLLDECSFSYTRQTEMKGLGHAILTGRPLIGDEPFAVVLADDLCVNLEGDGVLTQMVKLYKQFRCSIVAIQEVDPQETNKYGVIAGEMIRDDIYRVHSMVEKPKPEDAPSNLAIIGRYILTPDIFDLIEQTEPGKGGEIQITDALMKQAQNGCVMAYKFKGKRFDCGGAEGYIDATNFCFENFYKTGKAY

SEQ ID NO: 49531 - protein, 509 aa, Mycobacterium avium subsp. paratuberculosis K-10
MTLPTAAELRARAADALRSLGAHVELGAPDAHGLPASTPITGEVLFTVAPTTSDQAEHTITQATQAFSEWRRTPAPVRGALVARLGELLRAHRDELAALVTLEVGKITSEAAGEVQEMIDICQFAVGLSRQLYGRTIASERPGHRLSETWHPLGVVGVITAFNFPVAVWAWNAALALVCGDTVVWKPSELTPLTALATQALIARAAADVGAPPGVSAVVLGDRELGELLVDDERVALVSATGSVRMGRAVGPRVAARFGRVLLELGGNNAAVVTPSADLDLAVRAVVFAAAGTAGQRCTTLRRLIVHRSVADEVVARVVSALRRLPIGDPFEPGTLVGPLIHETAYRDMVGALESARADGGEVIDGDRRHPFAVEHPSSYYVAPAVVRMPAQTPIVATETFAPILYVLTYDRLDDAIALNNAVPQGLSSAIFTTDLREAERFLDESDCGIANVNIGTSGAEIGGAFGGEKQTGGGRESGSDSWKAYMRQSTNTVNYSGALPLAQGVEFG

SEQ ID NO: 49532 - protein, 414 aa, Oryza sativa
GRVMMALAVDVSRFEGVPMAPPDPILGVSEAFKADQNDLKLNLGVGAYRTEELQPYVLNVVKKAETLMLEKGENKEYLPIEGLAAFNKATAELLFGADNPVLKQGRVATLQSLSGTGSLRLAAAFIQRYFPEAKVLISSPTWGNHKNIFNDAKVPWSEYRYYDPKTVGLDFEGMIADIQAAPDGSFVLLHGCAHNPTGIDPTPEQWEKIADVIQEKKHMPFFDVAYQGFASGSLDEDASSVRLFVQRGLEVFVAQSYSKNLGLYAERIGAINVVCSTPEVANRVKSQLKRLARPMYSNPPIHGARIVANVVGDPTMFGEWKQEMEEMAGRIKNVRQKLYDSLSAKDDSGKDWSFILRQIGMFSYTGLNKTQSDNMTDKWHIYMTKDGRISLAGLSLAKCEYLADAIIDSFHNVS

SEQ ID NO: 49533 - protein, 384 aa, Glycine max
MAKEGPNWDGLLKWSIAHSDGTSPTRNLSEEDRKWFMEAMQAQTIDVVKRMKEITLVMQTPEQVLKDQGVTPADIEDMLEELQEHVESIDMANDLHSIGGLVPLLGYLKNSHANIRAMAADVVTTIVQNNPRSQQLVMEANGFEPLISNFSSDPDVTVRTKALGAISSLIRHNKPGITAFRLANGYAALKDALASENVRFQRKALNLIHYLLHENNSDCNIVNELGFPRMLMHLASSEDSDVREAALRGLLQLAHNAKDGKDGNEKDSAKIKQLLQERINNISLMSAEDLGVVREERQLVDSLWSTCFNEPSSLREKGLLVLPGEDVPPPDVASKYFEPPLRSSTANPSSKKDPEKNEIPLLLGSGPSPTYTNNQGSNKGDASS

SEQ ID NO: 49534 - protein, 140 aa, Francisella tularensis subsp. holarctica
MTKQRTLSIIKPDAVEKNVIGEIYSRFEKAGLRIIAAKMKHLSKAEAEGFYAVHKDRPFFSALVEFMISGPVMIQVLEGENAIAKNRELMGATNPKEAKAGTIRADFADSIDANAVHGSDAEDTAAQEIRYFFSDTEIFG

SEQ ID NO: 49535 - protein, 287 aa, Yarrowia lipolytica CLIB122
MSRQELVQWVNELLQTEISKVEECGKGAIYCQIMDSIYGDVPMSKVKFNVKAEYEFLNNYKVLQGVFNRHKIDRQIPVEKLVKCRFQDNLEFLQYCKKHWDANWSGQEYDAVGRRAGRVATVPSTAPGSTPNATSGRTSVQSQTSGRSSVVRSRPSVASGAAGSVGVGAGAGAGTGAGSLSGASGRASVSRRPGASGSSQASSAALAKAQQQIATLEADAVEYQQVLEGLETERNFYFNKLREIEVLVQENAEQMDTVQVEGMIREIQTILYSTEEGFQVPEEEEVF

SEQ ID NO: 49536 - protein, 434 aa, Pseudomonas syringae pv. phaseolicola 1448A
MNSKVDEPPHLLRQRDQFVPRGIVTAHPLVIDRAQGSELWDVDGKRYLDFVGGIGVLNIGHNHPNVVAAIQAQLTKVTHACFQVASYQPYLDLAKRLSHLIAGQSGIDHKAVLFTSGAEAVENAVKIARAHTNRPAIISFRGGFHGRTLLGTTLTGMSQPYKQNFGPMAPEVFHTPYPNEYRGVTSEVALAALHELLATQVAPERVAAILIEPMQGDGGFLTAPVEFMKALRALTEQHGIVLIVDEIQSGFGRTGKWFGFEHSGIQPDLVTVAKSLAGGMPLSGVVGRAEIMDAPLPGGLGGTYGGNALSCAAALAVIDTYEQDNLLARGEQLGQHLRAGLLKLKDRYTCIGDVRGTGFMLAMELVKNDAARSPDADLNQKIIDQARIGGLLVIKCGVYRNVLRFLAPLVTTEQQIDEALTILDAALARVLKSS

SEQ ID NO: 49537 - protein, 576 aa, Debaryomyces hansenii CBS767
MIDTEKNAGSEVTSVLSRHTDEYNLLIARSNPTSQFTDHGHQLKKGLDARHVTMIAIGGALGTGLLIGTGSALRTAGPASILIAYSAIGMVVYMVMCGLGEVATFVPLADGFTGYCNRYVDPALGFACGYVYLIKYLILPANQLVAGSLTVQYWISKDTVNPGVWITILLVVIVAVNVLGVRFFGEIEFWLSSIKVVTCLGLIILLLVIALGGGPTHDRLGFRYWKDPGAFIHYVNEDKNLNITGDKGRFVAFIAVLVSAVFAYTGTELCGITFAECARPRKAIPNAIKMTLYRIVLFYILSILFLGMCVAANDPLLMSASGSNASASPFVIAIKNAKIPGLDHVINACILLFVLSAANSDMYICSRTIYGLSVAGYAPKFFSKTNKMGVPYFGVMLSFLFCLLAFMAVSSSSQEVFTYFVNVVSITGLITWACILVIHIRFMKACKAQGLNRKKDLAYRSPLQPYGSYVALFVCVLVIFIKNFTAFLGDSFTYKEFITGYIALPVFVIMYIGFKLYHRTKTIKPEEVDLDTYRDVVDTEEQQFADAAAEKEALRQAQGNPKDKEWYYDTFIGWLF

SEQ ID NO: 49538 - protein, 594 aa, Solanum lycopersicum
EFLCLAPTRSFSTNPKLTKSIPSDHTSTTSRIFTYQNMRGSTMRPLALPLKMSPIVSVPDITAPVENVPAILPKVVPGELIVNKPTGGDSDELFQYLVDILASPVYDVAIESPLELAEKLSDRLGVNFYIKREDKQRVFSFKLRGAYNMMSNLSREELDKGVITASAGNHAQGVALAGQRLNCVAKIVMPTTTPQIKIDAVRALGGDVVLYGKTFDEAQTHALELSEKDGLKYIPPFDDPGVIKGQGTIGTEINRQLKDIHAVFIPVGGGGLIAGVATFFKQIAPNTKIIGVEPYGAASMTLSLHEGHRVKLSNVDTFADGVAVALVGEYTFAKCQELIDGMVLVANDGISAAIKDVYDEGRNILETSGAVAIAGAAAYCEFYKIKNENIVAIASGANMDFSKLHKVTELAGLGSGKEALLATFMVEQQGSFKTFVGLVGSLNFTELTYRFTSERKNALILYRVNVDKESDLEKMIEDMKSSNMTTLNLSHNELVVDHLKHLVGGSANISDEIFGEFIVPEKAETLKTFLDAFSPRWNITLCRYRNQGDINASLLMGFQVPQAEMDEFKNQADKLGYPYELDNYNEAFNLVVSE

SEQ ID NO: 49539 - protein, 577 aa, Idiomarina baltica OS145
MHLDAANTLILVCGFLLVVSILAGIISNRLGAPILLVFLVVGMLAGTDGVLGLSFDSPNIAFFIGSIALVIILFDGGMRTNPERFRVALWPAISLATIGVALTCTLVATTAVYLFDLPWTAALLIGAILSSTDAAAVFGIFQSQGLQIKERVGATLEIESGSNDPMAVILTLTMTSAAASGEFSAWYHMVGNVAWQLAGGLAMGWLAGRAFIIAARKLPLSFSFLPLLAIASAVMIYALTAFLGASGFLAVYLMGFVIGNSRLPQLVHILHVQDGLAWLSQISMFLILGLLVTPSHVVQYLPVAVGVAFTLIFVARPIAVLVSLLPFSFPWREQVFISWVGLRGAVPIILALFPWLSGVEQQELYFDVAFVVVLISLIIQGWTIAPVARWLQLEVPKRPEPAQRMPLASVSSREALEVWSYPIDKDSPACDHAWKELKLTAPATFVGVIRDGDWLQPETQPIVREGDVLLVTATVKDIDEVSRILASGGKGMQMSDKGFFGDFTLRGDLTIAELASVYPAGDVDESILSMTLNDHFKDKFHRRVVIGDSLVIGALTVTVRSLNKTGDIEAVGVKAKE

SEQ ID NO: 49540 - protein, 329 aa, Oryza sativa Japonica Group
MAACCSSLATAVSSSSAKPLAGIPPAAPHSLSLPRAPAARPLRLSASSSRSARASSFVARAGGVDDAPLVGNKAPDFDAEAVFDQEFINVKLSDYIGKKYVILFFYPLDFTFVCPTEITAFSDRYDEFEKLNTEILGVSIDSVWSRAFTSYFIALYSYDMSIPLIQKTFHFCSIFITIQLWGHIYHKRHLLNLMLIHYSKYYGQSDTLKTTFSHLAWVQTDRKSGGLGDLKYPLISDVTKSISKSFGVLIPDQGIALRGLFIIDKEGVIQHSTINNLAIGRSVDETMRTLQALQYVQDNPDEVCPAGWKPGDKSMKPDPKGSKEYFAAI

SEQ ID NO: 49541 - protein, 518 aa, Hyphomonas neptunium ATCC 15444
MIFDRVKPLDAILATAEKKGLQRTLGAFQLTMLGIGAIIGTGIFVLTSEAAQKAGPGMMISFLIAAAVCAVAALCYAELASMVPVSGSAYTYTYAVMGELLAWMVGWALILEYAVAASAVSVGWSGYFVGLLASWGIVLPDALVMGPYAGGIMNLPALLIALLITCLLMIGTTESARVNAVLVAIKVTALTVFIVLTLPVIKGANFEPFTPNGWFGAGHGAGLGIVGAAASIFFAYVGFDAVSTAAEETKNPQKNVPIGLIGSLGICTIFYLLVAAGAIGAMGSQPVNGPAGEILAPGTPALAAQCQSLLAMGQEPLVCSREALAHVLREIGHERLGDMIGIAAFLALPSVILIMLFGQTRIFFVMARDGLLPEFLSKIHPKWKTPHIVTMITGSVVAVFAAFLPVGQLADISNSGTLFAFFMVAIAVLILRRKQPERHRPFRTPMVWIVAPLAIFGTLGLYLNLPTEAKLVLPVWGSIGLVVYFLYSRGKSHVGRGIIDVHEDDPDAPPQPVPPIRD

SEQ ID NO: 49542 - protein, 163 aa, Stenotrophomonas maltophilia
MSLIATFDTTQGPIKVELFADKAPLTVANFVNLVKHGFYDGLIFHRVIADFMIQGGCPQGRGTGGPGYKFEDEKNGVKHEVGSLSMANAGPNTNGSQFFITHIKTDWLDGRHTVFGKVLEGQAIVDSVKQGDVIHSITLEGDVDAVLAAQAERVAEWNKHLAA

SEQ ID NO: 49543 - protein, 341 aa, Schizosaccharomyces pombe 972h-
MKNLVVFGTESHPKLTESICEHLCLDIGRVELSKFSNGETSVRIKQSVRGCDVYIVSPASGQVNDHLMELLIMISACKTASAKKVTAVLPVFPYSRQPDQKFSFSGAPLSDLQDAVVPCKKQTGYHPWIAQSGTLVADLLMCSGADHIITMDLHDPQFQGFFDIPVDNLFGRPLLKHYISLNIPNYHNAVIVSPDAGGAKRATAIADALGLDFALIHKNRRHEYGTSLMLVGDVQNKVAILIDDLIDTAYTLVRAAEFVKEHGASKIYALVTHCVLSGDAIERVKLSCIDKLIVTNTAPQTITPSGCFDIIDVAPTFAEAIRRIHNGESISILYDHNQVWV

SEQ ID NO: 49544 - protein, 310 aa, Hyphomonas neptunium ATCC 15444
MRNSTLPEHWTAAYIPDQRGRFAVITGTGGLGFEGAVALARSGASVVLAGRNAHKGADAVAAIRQAAPASDIRYERLDLACLASVADFAARLRGQMDRLDLLINNAAVMNPPARQETEDGFELQLGTNYLGHFALTGHLLPLLRKGANARVISVSSIAARNGLINLEDLQAEQSYRPGSAYAQSKLACLMFALELHRRSQLGGWGVASIAAHPGVSRTELLHNAPGRGSPASLARSLLWFLFQPADQGALPTLFAATWPEAKSGAYYGPHGLSETRGFPAAAQIPPQALDAALSARLWEVSENLTGVTLR

SEQ ID NO: 49545 - protein, 428 aa, Debaryomyces hansenii CBS767
MAQTNSSIIVGVHYKVGKKIGEGSFGIIFEGINLLNNQQVAIKFEPRKCEAPQLRDEYRSYRILNGSIGIPQAYFFGQEGVHNILVIDLLGPSLEDLFDWCGRKFSFKTVIQVAKQMIGRVQIIHENNLIYRDIKPDNFLIGKPGTLQANQVYVVDFGMAKQFRDPKSKCHIPYREKKALSGTARYMSINTHLGREQLRRDDLESLGHVFLYFLKGALPWQGLKAPTNKQKYEKIGQKEQNTSVNELCYGLPIQFAQYLSYVRGLRFDETPDYDYLISLMERALISIDSTEDGHYDWMDLNNGRGWDAALNKKANLHGYGNPHPPQNSSQNAQLYNKHRKSTNTPPQKSQRTNRNIPPQDRNPRSKSLTYGNYNSITQDRNGQPATRNEYQDGMIPVRDDGDLHSDTSSFNERRQKEKGWFRKLCCCF

SEQ ID NO: 49546 - protein, 333 aa, Bacillus licheniformis ATCC 14580
MSVLVLGGAGYIGSHAVYQLIDRGENVVVVDNLETGQRQAVHPDAIFYEGDVRDRDFLRTVFEKERIEEVIHFAASSLVGESMKDPLKYYDNNVSGTQVLLQAMLEHDVKKIVFSSTAAVYGEPESLPITEDMPTMPTSTYGETKLIMEKLMKRTEEAHGISFVSLRYFNVAGARETGEIGEDHRPETHLVPLILQTALGQRPHITIFGDDYDTPDGTCIRDYVHVEDLIDAHLSALDYLRKGGKSDIFNLGSSEGFSVKEMIDAARKATGKDITAEIGKRRAGDPSILIAGSHKAKQVLGWRPSRTSVAKIIEDAWKWHSSHPNGYRKEVST

SEQ ID NO: 49547 - protein, 194 aa, Glycine max
  misc_feature (49)..(49): Xaa can be any naturally occurring amino acid
  misc_feature (70)..(70): Xaa can be any naturally occurring amino acid
  misc_feature (141)..(141): Xaa can be any naturally occurring amino acid
  misc_feature (163)..(163): Xaa can be any naturally occurring amino acid
MGRIKPQALLQQSKRKKGPSRISATIVTFYALILVMLVFILFVTYRHWXHRTRLQPERYISVSEDENTSXNPKKSDLPGYAVVITSKGSIIVELYKESAPEVVDEFIDLCQKGHFKGMLFHQVIKHYVIQGPGATEDWNLXEKKYASMRHEAFMLGTSKGKYXNKVFDLFITTAPIPDLNEKLIVFGRVIKGQD

SEQ ID NO: 49548 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 49549 - protein, 393 aa, Listeria innocua Clip11262
MKISKRLQNLPDQFFSSLVEKVGKKVAEGHDVINLGQGNPDQPTPKHIVEAMKTASENPMNHKYSLFRGKQELKQAVADFYAREYNVTIDPNTEVAILFGTKTGLVELPMCLMDPGDVMLLPDPGYPDYLSGAVLGEVQFETMPLIAENDFLPDFNKIPEEIAKKAELMYLNYPNNPTGAVATTHFFEETVAFAKENNITIAHDFAYGGIGFDGKKPISFLETPGAKEVGIELYTLSKTYNMAGWRVGFAVGNKDVVEAINLIQDHMYVSLFPGIQDAAIEALTGDQTCVQELNARYESRRNAFIAACDKIGWEAIAPAGSFFAWMPVPKEFTSSEFADYLLNEVSVAVADGSGFGTFGEGYVRVGLLMDEKRLEEAVARISKLHLFDKVAQN

SEQ ID NO: 49550 - protein, 429 aa, Opitutaceae bacterium TAV2
MTTQKNVLAVVMGGGRGTRLYPLTMERCKPAVPLAGKYRLVDIPISNCINSDINRVFLLTQFHTASLHRHIQNTYHFDPFGGGFVDILSAEQTEKTNDWYQGTADAVRRNLQHFRSFSHEFVLILSGDQLYRMDFRKIIQQHIATVAEVTIAAIPFPVSKVEGLGLMGVGDDLAIQQFAEKPKDPAVINSLTMSAALESRLQARTSKEKHCLASMGIYVFNRRVLAEALANDMTDFGKEIIPGLLGKKRLYAHVFEGYWEDIGTVKAFFDANLALAQPLPPFNFFDPGAPIYTQDRYLPPSKVNRCTFDYVVFGDGSIVEDATLRRCVIGIRSFVRGGCVLEDVVMMGADSYEGEDDIRVNQTKNLPNLGVGYGCKIRHAIIDKNARIGDNVTLNPEGKADGTYAHGVVIRDGVLVVPKGMTVPGGTVI

SEQ ID NO: 49551 - protein, 304 aa, Triticum aestivum
  misc_feature (297)..(297): Xaa can be any naturally occurring amino acid
VTLSNKFVQKSRLPPVRNSRVFGDPRVRAVYRGDLSDGRQIAVKMLKDFKTDGEDFINELASISRTSHVNVVTLLGFCLEGSKRALIYDYMPNGSLERYAFKDGSQGGNTLGWEKLFEIAVGIARGLEYLHRGCNTRIVHFDIKPHNILLDQNFCPKISDFGLAKLCLNKESVISIGGARGTIGYIAPEVYSKQFGAVSSKSDVYSYGMMVLEMVGARDKNISPNTESSSQYFPQWIYEHLDEYCISASEINGEITEVVRKMIVVGLWCIQLSSADRPTMTRVVEMLEGSTTGLELXPPKVLLS

SEQ ID NO: 49552 - protein, 472 aa, Oryza sativa Japonica Group
MEPRVGNKYRLGRKLGSGSFGEIYLGTNVQTNEEVAIKLENVKTKHPQLLYESKLYRILQGGTGIPNVKWFGVEGDYNVLVMDLLGPSLEDLFSFCNRKLSLKTVLMLADQMINRVEFVHSKSFLHRDIKPDNFLMGLGKRANQVYMIDFGLAKKYRDTSTHQHIPYRENKNLTGTARYASVNTHLGIEQSRRDDLESLGYVLMYFLRGSLPWQGLKAGTKKQKYEKISERKIATSIEALCRGYPCEFQSYFHYCRSLRFEDLPDYQYLKRLFRDLFIREGFQFDYVFDWTILKYQQSQITSVPPRAIAAAAGQSSGMSPIANNNRLSATEEGRRSGWSDDPTRRQVPPTGINAGSLSKQKSPVRPDMSTSKDALFSSSTMLGRSSGSLRRPVVSSSRELQSSEAEPSRSRTPDASPGTFQRSAPPRRSSQMLDYSDPRHSSSGRHAANKNYESTIRGIQGLNFDANDRIHY

SEQ ID NO: 49553 - protein, 231 aa, Arabidopsis thaliana
MIHMCDTHLVVLPYQDHILIRIMAIHTLLFVSLLIFSLIESSSGGKKDRLFTDLQNSIEVTAKPVKDSGVLEAGKDMVTITWKLKSSSAKVDTDTAFKTIQVKLCYAPISQVDRPWRKTDNKLFKDRSCPHEIVSKAYDKTPQSLDWTIGLDIPTGTYFVRAYGIDGDGHEVAYGQSTDEGRTTNLFSVHAISGHHVGLDIASTFFSVFSVVSLFVFFVMEKRKAKLEQRE

SEQ ID NO: 49554 - protein, 595 aa, Glycine max
MVSDASKKKAAQKKAAAAAKRGGKAAAAAVMAATSSKAADKVANGIADIQISDRTCTGVLCSHPLSRDIRIESLSVTFHGHDLIVDSELELNYGRRYGLLGLNGCGKSTLLTAIGCRELPIPDHMDIYHLTREIDASDMSALEAVISCDEERLKLEKEAEALAAQDDGGGESLERIYERLDALDAATAEKRAAEILHGLGFDKQMQAKKTRDFSGGWRMRIALARALFMNPTILLLDEPTNHLDLEACVWLEESLKKFERILVVISHSQDFLNGVCTNIIHMQSKKLKLYTGNYDQYVQTRSELEENQMKQYKWEQEQIASMKEYIARFGHGSAKLARQAQSKEKTLAKMERGGLAEKVVRDKVLVFRFTDVGKLPPPVLQFVEVSFGYTPDNLIYKNIDFGVDLDSRVALVGPNGAGKSTLLKLMTGDLMPSDGMVRRHNHLRIAQYHQHLAEKLDMEMSALQFMIKEYPGNEEEKMRAAIGKFGLSGKAQVMPMKNLSDGQRSRVIFAWLAWRQPQMLLLDEPTNHLDIETIDSLAEALNEWDGGLVLVSHDFRLINQVAHEIWVCANQSVTRWEGDIMEFKAHLKSKAGLSD

SEQ ID NO: 49555 - protein, 159 aa, Listeria innocua Clip11262
MNIQIVTVGKLKEKYLVQGIAEYLKRLSAYAKVSIVEVPDEKAPEVLSDAEMKQVKDKEGVRILAKIPDDAHVIALAIDGKMKSSEEFAADLDKLATYGKSKVAFVIGGSLGLSEAVLKRSNEQISFGRLTLPHQLMRLVLVEQVYRAFRIVRGEPYHK

SEQ ID NO: 49556 - protein, 1096 aa, Pinus radiata
MEARTNTAAGSNKRNVRVSVRDDGELGPKPPQHINSHICQICGEDVGLAADGEFFVACNECAFPVCRPCYEYEWKDGNQSCPQCKTRYKWHKGSPQVDGDKEDECADDLDHDFNSTQGNRNEKQQIAEAMLHWQMAYGRGEDVGPSRSESQELPQLQVPLITNGQAISGELPAGSSEYRRIAAPPTGGGSGKRVHPLPFPDSTQTGQVRAEDPAKDFNSYGFGNVAWKERVESWKNKQDKNTLQVTSDTYYASEGKDGDIDGCVADEEDLQMSDEARQPLSRKVPIASSKINPYRMVIVLRLVILCFFFRYRILNPVRNAYGLWFTSVICEIWFAISWILDQFPKWLPINRETYLDRLCLRYDREGEPSQLAAVDIFVSTVDPMKEPPLVTANTVLSILSVDYPVDKVSCYVSDDGAAMLTFEALSETSEFARKWVPFVKKFDIEPRAPEWYFAQKIDYLKDKVQPSFVKERRAMKREYEEFKVRINALVAKAQKVPEEGWIMQDGTPWPGNNTRDHPGMIQVFLGHSGGLDTDGNELPRLVYVSREKRPGFEHHKKAGAMNSLVRVSAVLTNGPYMLNLDCDHYINNSRALREAMCFMMDPTLGKKVCYVQFPQRFDGIDRNDRYANHNTVFFDINLKGLDGIQGPVYVGTGCVFNRQALYGYEPPHKGKIHFSSCCGPRKKSRKSNKKYNDTKKLDRPTDSTVPIFSSLEDIEGGVEGFDDEKSPLVFQKSLEKKFGQSLVFVASTQMENGGVPQSATPADLLKEAIHVISCGYEDKSDWGKEIGWIYGSVTEDILTGFKMHARGWRSIYCMPPRPAFKGSAPINLSDRLNQVLRWALGSVEILLSRHCPIWYGYTGRLKWLERLAYINTTVYPITSIPLLAYCTLPAICLLTGKFIIPEISTLASLWFISLFLSIFATGILEMRWSGVGIDEWWRNEQFWVIGGVSAHLFAVIQGLLKVLAGVDTNFTVTSKASDEGGDFAELYIIKWTALLIPPTTLLIINIVGVVAGISYAISTGYRSWGPLFGKLFFAFWVIVHLYPFLKGLMGRQNRTPTIVIVWSILLASIFSLLWVRIDPFTTRIKGPDLQQCGINC

SEQ ID NO: 49557 - protein, 584 aa, Mycobacterium avium subsp. paratuberculosis K-10
MSDPIHALGEPGSPASALGPRQRAAAWDRLGAEQFDVVVIGGGVVGSGCALDAATRGLKVALVEARDFASGTSSRSSKMFHGGLRYLEQLEFGLVREALYERELSLTTLAPHLVKPMPFLFPLTNRLWERPYIAAGIFLYDRLGGAKSVPAQKHLTRAGALRLCPGLKRSALIGGIRYYDTIVDDARHTLTVARTAAHYGVVVRNSTQVVALLREGDRVTGVRVRDSEDGSVTEVRGHVVVNATGVWTDEIQALSKQRGRFQVRASKGVHVVVPRDRIVSDVAIILRTEKSVMFVIPWGSHWIIGTTDTDWDLDLAHPAATKADIDYILSTVNTVLAIPLTHADIDGVYAGLRPLLAGESEETSKLSREHAVAVPAPGLVAIAGGKYTTYRVMAADAIDAAAQFIPARVAPSITEKVSLLGADGYCALINQAEHVAQLRGLHPYRVRHLLDRYGSLIGDVLALAADRPDLLNPITEAPGYLRVEALYAVTAEGALHLEDILARRMRISIEYSHRGVDCAREVADVVAPVLGWTAGDVEREVANYTARVQAEILSQAQPDDVSADELRASAPEARAEILEPVPLN

SEQ ID NO: 49558 - protein, 511 aa, Rickettsia akari str. Hartford
MTINPSSIGDSSSKINIRFSKLTDYIWPIKCHEVSKFLFITLLMFCILFIQNLIRALKDSIVTTMIGAETISFLKFWGVMPSAFLITAVYVKLVNRIKAENIFYLIISIFLTFFALFAYVIFPNHEILHLSPVTVQNLMVSLPNLKWFILLLSKWSFSLFYIIAELWPNVVFALLFWQFVNNITTVEESKRFYPLFGLLSQTGIYLAGQFLENLSNINDYITNKFALQSSFHTLSIQIILTMVLILGIIAIKTFWLLNHKVLDKEHMALLKFKAKKKSMTIAESFQMILLSRHIRLIATLLICYGIAINLVEGPWKAAATKIYKTPTEYAAFIGGYLSYTGVFTILFVVLGSNIVRRLGWFTAAVITPLIVFITGILFFAVNNFEGFVGLIIANFILTDPTLVAITIGAIQNVLSKSSKYTLFDSTKEMAYVPLDPEIKSKGKAAADVIGIKLGKSGSAFLQSLVFMILPSASYQSISICLMIIFIITCLTWLWATTKLNKEYKNSIKFFQ

SEQ ID NO: 49559 - protein, 1066 aa, Pinus radiata
GQVCQICGDDVGLTADGDLFVACNVCAFPVCRPCYDYERKDGNQSCPQCKTRYKMHKGSPRVEGDEGEDGADDVGNEYHYPPPGSRNEKQKIAEAMLRWQMSYGRGEDVGAPTSTRQEVSESQIPRLTNGQSISGELPALSPEHSVGAPPSSGGGSKRVHPLPYTDASRPAQVRIVDHSRDFNSYGFGNVAWKERVESWKNKQEKNMLQVTNSGDYASEGKGGDVDFGGGENEDLQMNDEARQPLSRKVSIPSSKINPYRMVIVIRLFVLCVFFRYRIMHPVNNAYGLWFTSVICEVWFAISWILDQFPKWLPINRETYLDRLALRYDREGEPSQLAAIDIFVSTVDPLKEPPLVTANTVLSILSVDYPVDKVSCYVSDDGAAMLTFESLSETSEFARKWVPFCKKFNIEPRAPEWYFSLKMDYLKDKVQPTFVKERRAMKREYEEFKVRINALVAKAQKVPEEGWVMQDGTPWPGNNTRDHPGMIQVFLGHSGGMDTEGNELPRLVYVSREKRPGFQHHKKAGAMNSLVRVSAVLTNGSYLLNLDCDHYINNSKALREAMCFMMDPNLGKSVCYVQFPQRFDGIDRNDRYANHNTVFFDINLKGLDGIQGPVYVGTGCCFNRTALYSYDPPTKKKFRVPNCFSMCCGGTRKNKKVDKKIMDDTKTLKQTDNTIPIFNLEDIEEGVEGAGFDDEKSLLMSQKSLEKRFGQSSVFVASTLMENGGVHQSASPAELLKEAIHVISCGYEDKTDWGREIGWIYGSVTEDILTGFKMHARGWRSIYCMPPRPAFKGSAPINLSDRLNQVLRWALGSVEILLSRHCPIWYGYGGRLKWLERLAYINTTVYPITSIPLVVYCTLPAICLLTGKFIIPQISTFASLFFIALFLSIFATGILEMRWSGVGIDEWWRNEQFWVIGGVSAHLFAVVQGLLKVLAGIDTNFTVTSKASDEDGDFAELYLFKWTALLIPPTTLLVINIVGVVAGISQAISSGYAAWGPLFGKLFFAFWVIVHLYPFLKGLMGRQNRTPTIVVVWSVLLASIFSLLWVRIDPFTTQIKGPDLQQCGINC

SEQ ID NO: 49560 - protein, 492 aa, Mycobacterium avium subsp. paratuberculosis K-10
MARLLLPPRCGGHRRRARLGVVVTRIVILGGGPAGYEAALVAASSHPDSTHVTVIDSEGIGGAAVLDDCVPSKTFIASTWLRTELRRAPRLGFEIDIDDAKISLPQIHARVKQLATEQSADITEQLLGVGVHVVAGRGELIDPTPGLARHRIKATAPDGSSSEYEADVVLIATGASPRILPSAQPDGERILTWRQLYNLDALPDHLIVVGSGVTGAEFVHAYTELGVPVTVVASRDRVLPYEDADAALVLEEAFSERGVQLVKNARAQSVTRTPDGVLVTLTDGRTVAGSHALMTIGSVPNTAGLGLERVGIELGRGGYLTVDRVSRTSVPGIYAAGDCTGLLPLASVAAMQGRIAMYHALGEGVSPIRLRTVAATVFTRPEIAAVGVPQTMIDDGSVSARTIMLPLRTNARAKMSGLRQGFVKVFCRKSTGVVIGGVVVAPIASELILPIAVAVQNRITVNELAQTLAVYPSLSGSITEAARRLMAHDDLD

SEQ ID NO: 49561 - protein, 639 aa, Arabidopsis thaliana
MSNLSIFFSILLLSLPLPSIGDLAADKSALLSFRSAVGGRTLLWDVKQTSPCNWTGVLCDGGRVTALRLPGETLSGHIPEGIFGNLTQLRTLSLRLNGLTGSLPLDLGRCSDLRRLYLQGNRFSGEIPEVLFSLSNLVRLNLAENEFSGEISSGFKNLTRLKTLYLENNKLSGSLLDLDLSLDQFNVSNNLLNGSIPKSLQKFDSDSFVGTSLCGKPLVVCSNEGTVPSQPISVGNIPGTVEGREEKKKRKKLSGGAIAGIVIGCVVGLSLIVMILMVLFRKKGNERTRAIDLATIKHHEVEIPGEKAAVEAPENRSYVNEYSPSAVKAVEVNSSGMKKLVFFGNATKVFDLEDLLRASAEVLGKGTFGTAYKAVLDAVTLVAVKRLKDVTMADREFKEKIEVVGAMDHENLVPLRAYYYSGDEKLLVYDFMPMGSLSALLHGNKGAGRPPLNWEVRSGIALGAARGLDYLHSQDPLSSHGNVKSSNILLTNSHDARVSDFGLAQLVSASSTTPNRATGYRAPEVTDPRRVSQKADVYSFGVVLLELLTGKAPSNSVMNEEGMDLARWVHSVAREEWRNEVFDSELMSIETVVSVEEEMAEMLQLGIDCTEQHPDKRPVMVEVVRRIQELRQSGADRVG

SEQ ID NO: 49562 - protein, 323 aa, Paulinella chromatophora
MTIPPYIVNSVRQACRWQWKQLMTGLGPADAYGNYCRPKSNFILVPELPKESAEVHQFVLIVGRSCPWAHRTWLVWSLRKLKEKIKLIIVVPDRKQGRWRFETPFQGLKSVSDLYKQCGAPPHQRATVPLLIDQKKMTILCNESSQLVELLSNWPASSDSPELMPFRHHTSIDQWANILQYSVNDGVYRCGFARQQTAYNHAEEGLFSTLQKLEKTLRKGGPWICGNQLTLADVLLFPTLIRWEIVYAPLFGCSRQFLWQFPAIWNWRQRLFSLPGVAESCDGQAIVSDYFGSLFPLNPSGIIPASPCLTRLVLNPILRINYD

SEQ ID NO: 49563 - protein, 467 aa, Bacillus licheniformis ATCC 14580
MCNTIGVIGLGVMGSNIALNMASKGEQVAVYNYTRDLTDQLVQKTGGQTVKPYYELEDFVQSLEKPRKIFLMVTAGKPVDSVIDSLVPLLEEGDVIMDGGNSHYEDTERRYDSLKVKGIGYLGIGISGGEIGALKGPSIMPGGDRDVYEKAAPILTKIAAQVDGDPCCVYIGPKGAGHFVKMVHNGIEYADMQLIAEAYTFLREKLLLPIDEIADIFDTWNQGELNSYLIEITAEILRKKDEKTGAPLIDVILDKTGQKGTGKWTSLQAVDNGIPSSIITESLFARYLSSLKDERTAAEKVLAGPATEERRLDQNVWIDRVRQALYMGKICAYAQGFAQYKMTSDLNGWNLPLKDIALIFRGGCIIRAQFLNLISEAFDKQPDLSNLLVAPDFAEKLKEYQSGLRKVVCEGISSGISFPCLSTALSYYDGYRTGRSNANLLQAQRDYFGAHTYERTDMEGVFHTDWY

SEQ ID NO: 49564 - protein, 1432 aa, Shewanella sp. ANA-3
MIELKIDNHSVTAEPNDNLLQAARKAGIAIPSLCDPTDATRQLGTAPNADKQDCNLCLVQIENTDASLRCVKACETPAEAGLKVITQSAYLTKQRQAALSTILSDHFADCEAPCQQACPAGVDVQSYLYHIAQGDHTQAIKVIKDTLPLPLSIGRVCPAFCESECRRGLVDDPIAIRQLKRHAADLDLADDEQGNSYQPPRLADTGKKIAIIGAGPAGLSAGYYLSNQGHNVEIFEAMPKAGGWLRYGIPEYRLPKAILDKEIELLCRNGLTIHTDTRLGHEIHLAQLVADFDVVCLAIGAQKAVPMNYKGSALAGCYLGVDFLKDHCLDKQLKLGKKVAVIGGGNTAIDCARTAVREGCDVTLIYRRTRAEMPAEAYEVHEAEVEGVKFHFLTNPIENHSDDNGRVQSVTFSKMTLGEADTSGRRAPVDTGETFTEAFDTVIAAVSQAPDLSFMQDPMGQLSQGELALSRWNTLIGCEQTMSSGVEKLFVMGDARRGPATAVAAIGDGRKAAIAIDKMLKIGLSCDLHAHAFNSVKTIPSALIPSALKQTETSSKAGSTLYPHTPRQLRLKMPELTALQRLLNYSEVELGFPADAAMQEAARCLECACQANTDCKLRDYATDYGVEAKSLATENARHFSVDKSAPFIQFDANRCISCGKCVDVCQQQSGHCAIQFSQDSYQALPQEMTQHMERRAPRVGFSASMADSHCVQCGNCVQVCPTGALVDARDKRQGDCTELKTASTICTYCGVGCRLDLKIDPNANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRHDWQDKAYIAERTEGIEALYAELAKDDYSLENAALITGVKAEDIARLARTIGTAEKTAVYYAMGITQHTTGHDNVTAISNLQLLCGNIGVSGAGINPLRGQSNVQGACDMGALPNYFTGYQKVTDLHARMRFENHWQTRLSGEIGVTATHMMHDIAKGKIKALYVMGENPVLSDPDQAHVLNALSQIEFLVVQDIFLTETAELAHVVLPAAAFVEKRGHFTNTERRVQRLEQALASPGEALPDWQIVQAVANAMGANWDYTNEEAIWREINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGAPKVMISVYDAEQLGINNGDKLRLTTRRGEIEIDAFVTKRAQAGVLFLPFHFVEAAANKLTINALDPVAYIPEYKVCAVRAEKVTARVSEPA

SEQ ID NO: 49565 - protein, 480 aa, Idiomarina baltica OS145
MSSLTKQDCFIEGHWVPTEKRFAVTNPANGEVITEVADADGDLTKRAINAAEVALAKWRATSTQERAALLRKWYQAIMDNKQALGELMSAEQGKPVPEAVGEVEYGASFVDWFAGEAERINGDILPITDNSKRVMVIKQPVGVCAAITPWNFPNAMITRKVAPALAAGCTIVVKPPQLTPLSSLALAQLASEVGIPDGVINILPTTDSKTVGEILATSKQVRKLSFTGSTGVGKILMKQCAENVKKISLELGGNAPFIVFDDADLDAAAEQLMACKFRNGGQTCISANRVLVQDSVKEEFIKKVVSKVKALNVGPGDKEDVDLGPLIDQDAVDKVQRLVISAKSDGAEIEEGGSVMTDLGDLFYAPTVISGVTQDMEITQEEIFGPVIAISSFETEEEAIQQANDTPFGLASYFAAKDTARIFRVSEGLEYGMVGVNTGGISHAYNPFGGIKESGIGREGSKYGIDEYLEIKTITLGGLE

SEQ ID NO: 49566 - protein, 187 aa, Bacillus licheniformis ATCC 14580
MSLIGKEVQPFAAKAYKNGEFIDVTHEDLKGQWSIFCFYPADFSFVCPTELEDLQNHYEALKELGVEVYSVSTDTHFVHKGWHDSSEKIGKITYAMIGDPSQTISRNFEVLNEEEGLADRGTFIIDPDGVIQAVEINAGGIGRDASILINKVKAAQYVRQNPGEVCPAKWEEGSETLTPSLDLVGKI

SEQ ID NO: 49567 - protein, 461 aa, Idiomarina baltica OS145
MSTTPSIAELFDSLSNTYKTGLSRPVFWRKQQLEGIKNFLTKEQSSIERALTQDLGKHPSESRLTELNYLLSHIDYTLKHLNKWVKPTRVKTPLLAWPGSSQLYPEPLGTVLILGAWNYPLQLLIAPAIAAIAAGNCVILKPSEHAPNTAEVIANKLGDYIDNHAIKVVTGDVSVANELTQQPFDHIFYTGGSNGAKAVLRNAAQHLTPTTLELGGKSPAIVSEDCDIEVTARRLVWGKYLNAGQTCIAPDYVLVQDSIRDTLISKIKEQIELFYGSDPQQSDDYGRIISANHWQRLVKLLDDTDIISGGDYQRKDNYIAPTLINLDGLDSEHPLHHEEIFGPLLPIKSVTSIQAAIDYVIAKPKPLACYAFSKNNRTLEQVKHQVSAGSYCANDTLMFMLNEELPFGGVGQSGMGRYHGKFGFDTLSHQKAVMKRSFKFDVALRYPPYTKLKDKLLAWLK

SEQ ID NO: 49568 - protein, 221 aa, Enterobacter cloacae
DLLDAEYMAYMLKYDSTHGRFNGTVEVKDGHLVVNGKTIRVTAEKDPANLKWNEIGVDVVAEATGIFLTDETARKHITAGAKKVVLTGPSKDNTPMFVKGANFEKYAGQDIVSNASCTTNCLAPLAKVINDNFGIVEGLMTTVHATTATQKTVDGPSHKDWRGGRGAAQNIIPSSTGAAKAVGVVLPELNGKLTGMAFRVPTPNVSVVDLTVRLEKAASYE

SEQ ID NO: 49569 - protein, 312 aa, Thermus thermophilus HB8
MTDLEAPLRRFEEALSELVQSDVLFIRLIHQDLVTAGGKRIRPRLVFLASRALGGAPFELELALAVELLHSATLLHDDLIDDAETRRGKEAAFRKYGNAVSVLSGDFLLSRLLHVIAKTGRMELVERFAEVAKTLSEGEVLQFQVAALEDYSLENYERIITAKTAVLMALATEGPALLLGAESGVREALYRYGLLYGQAFQMRDDYLDLMGTPEVLGKPVGGDLREGKATLIPLLLMERYPEVREVLRRRAREAGDLERVRALARESGAAEEAVRRIRERAEAAAQALEALPPSPFREALRELALKEAERVR

SEQ ID NO: 49570 - protein, 1669 aa, Shewanella sp. ANA-3
MSTLFRTGQINEINTQQAKTESTQQGVGVNIQINPQVRKFQYEEGLTGEQVYIVRLNQKPLAQVSAELLGTDTTQARSSKASKLYVAGQPANRAVQNYRAQLLNTQKQVLADIQSNVGARQARQQFTNAVNGFSIAMTQEEAQRVAQLPNVASVRLSKTYELQSDAGPQLIEADKIWTGTATPDGLPYKGEGIIMGIIDTGVNTDHRSFAAIGDDGYKHENPWTAGKYVGDCTKVGFESLCNDKLIGVRSYPIITDNFTNGNYEVTRPAVGEDYQGHGSHTASTAAGNVLLNVDYLAGVSDTEASDGRVIKAGLFPSISGVAPHANIVSYQVCYPDNHIGAGCPGEALVAGIEDAIKDGVDVINFSIGGQESNPWASDVELAFLAAREAGISVAVAAGNSGQYNGSAEYFGKIDHASPWLLSVAATTHDRVIDITTKLVNPVGGSTVPTWTEISGGVINNESVTGHVVMAANHGDQYCANKFAADTFVWKDADGNPTDENVIVACRRDSTTSTTGTARSVKADNVKAGGADGMILYNYAAGEAIVPAVSYSVPSIHITQENWGTSNSGGLYTWLRNGTDQVITITATDIERTLDPSKADWLAAFSSRGPSTSTPEALIPAVAAPGVDIFAAYADEHPFDTTSPSSDFAMISGTSMASPHVAGSMALIRQAHKDWTATEVQSALAMTTENKVQYRRLNSSTGDVELASTYRAGTGRINVKNAINAGFVMDETIDNFKAANPNNGGVLHKLNIPQLVNFECKPKCQWIRTIRATKDGSWSVTNGDVINWNVDSQKQANQNGVTIKAYPSEFTLKAGETLDIVIEASIMDTQDLFSNAEVELHSNLIFTESTESAPEAHWPIVFKYDNNNMPSYLRTTAHRNNASAVFKGIDLPEGDSIHGRIFEPAKATIKTATLPKDDENIYPWDLLQVPAGDDIKNVIDEATHVEMIDVPANSRRLIVEVLGKMQSPLEGDWNKGNIQIYVGKDYNGNGQPDPLEEIVCVSNDAIYNNFCNINNPDEGTYWAVFYNPRKGSDSNNFNAGVMETFQYTTTVLSDRVASNMGVEVPASNGTDAVDITVNWDIPEMSEGDVYYSLVDFGTSAVNAGNIGKVAFKLNRGVDDVSLDTTQTKALVGQTLPFTFEVQPNDSGADRAFSIEATIPEGLSLKAEDVYSSSSAIVKDIKVEGKKLTISGVQPNTLGDYAHYNITTNETDPLCRTPNFGNSNPGGYVDLEEFGLLPSYSGFEPTTLGANGKVVTGGTNNIRYQNGVQIPISTLFSGNTTGYHLYNNADTMNIWNNNSLQILGTGIINLYQNEKIFFPWHDIFPYNNAPWASIGVLWRAFDYKYTVQDLMSVPLIHGSEVAGITIGSTSDGWGIIEWDNARSYGQLSNDPTTNAKRWEERDDRFDFELLFNVNTRFGDGEYELIMAYDNIDYGSQDDRGSIGLQGFKGALSKLGPDGGYKGEQYAWNNLKDKIRNGLVVCYDYVGPESSQFEVTAWTKVTTNAPGKALTVDAVSQIDGMANISMSRTVTVPSNITVARIANQTIAENTSLEGLKVVFADEQNSVNKITVTGEHISAVVNGNTSGSTITITPEANFHGDVEVTVTVSDVENPADAASTSFMLTVESDGVEPTAPVTPTTPETPAKESSGGALGGLSMLLALGALIRRRKTH

SEQ ID NO: 49571 - protein, 273 aa, Erythrobacter sp. SD-21
MAAISGLIRVMEKAARKAGGRLRRDFGEIEHLQASRKGPADFVSKADLRAERTIYDELLAARPDWGFEMEEAGTIEGAEGAPRWIVDPLDGTSNFLHGIPHYAISIAVQERKLGSDEWGDVTAGVVYNPTTDETFWAEKTRGAWLHDARLRVSSRRSPSEALIATGIPFAGHGDFAEWSKIFNAIGPNVAGIRRFGAASLDLAWLAAGRYDGFWESGLSDWDTAAGCLIVREAGGFVSDFRGRSQPIHSKQVLAANDQLHSRLHKILAGALKA

SEQ ID NO: 49572 - protein, 568 aa, Triticum aestivum
MAPGRLRWSAAALVLLFLAAGAAAEAARREVVTSPRGAVAADDERCSKIGRDALRCGGTAVDAAVATSLCLGVVSPASSGIGGGAFMLVRLADGTAVVYDSRETAPLAATKDMYGGNDTLKARGALSIGVPGEIAGLYEAWKRHGKLPWKELVMPAAKLAWAFTVSPYLHMQMKATEAGILGNAGMRAVYACNGEILKVGDVCRNGKLAWTLEAVAERGPAAFYSGPVADLLVKDVKEAGGIMTKEDLEKYQVKVHRPLSQSVMGLTVLSMPPPSAGGAGLMLVLNILAQYGVSGISGSLGIHRLVESLKHYMAVKMNLGDPDFVDVGAVVSDMLSPKFAAELRRTIYDNMTFSPQHYGGRWNILQDHGTSHLSIVDGERNAVSMTSTVNAYFGSLILSPSTGVLLNNEMDDFSMPANTTANTPPPAPNNFVAPLKRPLSSMCPTIVLKDGKLKAAVGASGGSMIPAGTIEVLLNHFAKNMDPLSSVMAPRVYHQLIPNEVQYENWTTVTGDVFLLDAATRGDLLKKGHALKPLAGGTISQLVVHNVEGRGDLTAVSDPRKGGVPAGY

SEQ ID NO: 49573 - protein, 163 aa, Staphylococcus aureus
MVEKLKYEWLNQPGKNILAGIVVALALIPEAIAFSIIAGVDPMVGLYASFIIAVVTAVVGGRAAMISGATGAVALLVVPLVKDHGVEYLLAATILMGIIQLILGLLKVGRLMKFIPHSVMIGFVNALGIMIFMSQIEHIFGIPISTYICKCNITHCIYNSKIF

SEQ ID NO: 49574 - protein, 249 aa, Corynebacterium efficiens YS-314
MEIFTKRPGEPQSALAEAAGLSWLGEASDAVARVVSADETHISTVRVETTRPTPEAARIAGRELARIHLAGAPAFGSPPPGWKGPNYIGTQRQDCSPTDRWADFYVEQRVLPFAENAYRRAHLSPDGLRTVQAACAVIRQQDVEVTPARLHGDLWSGNLLFGMQGPVMIDPAAHGGHPETDLAMLALFGAPHLDQIRAGYEEINPLGDGWLARTPVHQLHPLAVHVSSHGPGYAAPLIQAAEATLELWG

SEQ ID NO: 49575 - protein, 91 aa, Vitreoscilla sp. C1
  misc_feature (16)..(17): Xaa can be any naturally occurring amino acid
NSCGHGIGFNFHCEPXXLHYGNRGTGLRLEPGMIFTIEPMLNQGKRHLRIFADGWTVVTKDPSLSAQWEHEVLVTDTGYEILTISPKTNKP

SEQ ID NO: 49576 - protein, 385 aa, Mycobacterium leprae TN
MEISGALLSQVGALLTTLAVLGAGARRYSLSPIPVYLMAGLSLGKGGIMPVSAADEFITTGAPIGIVLLLLTLGLEFSATEFASSLRRHLPSAGVDIILNATPGAVAGWLLGLDGVAVLALAGVTYISSSGVIARLLADLRRLGNRETPAVLSVLVLEDFAMAAYLPLFAVLAAGGSWLDAVVGMIVAVCALFAAFAASYHWGHHVGRLVAHPDSEQLLLRVLGVTLIVAAVAESLHASAAVGAFLVGLTLTGDTAERARKVLGPLRDLFAAIFFLAIGISVDPHKLLPMFPTALILATVTAVTKVATGILAARYDGVARRGQLRAGTALVARGEFSLIIIGLVGTSTPAVAALATAYVFIMAIAGPVLARYTPGSLPTSSGSAN

SEQ ID NO: 49577 - protein, 309 aa, marine gamma proteobacterium HTCC2143
MNHDFSAFLMQTKTRVDQLLGEHLGSFSSSYAAVDSGIYLTRLQQAMHYSLINGGKRIRPVLVYATAAAITTDVSPVVTANLDRIACSIEMIHAYSLIHDDLPAMDDDDLRRGQPTCHRAFDEATAILAGDALQARAFELLTELTECPPHIHLNLLRILTQASGQRGMVGGQLIDLESVDKPIDVQQLETIHRLKTGALIRASIAMGATLTGADRQQLEQLDCYGDAIGLAFQVHDDILDIEADTATLGKTQGADIALNKPTYPSLLGIDGAKAKAAQLHQQSLTAIEHFDANALLLRELSGYIISRSH

SEQ ID NO: 49578 - protein, 277 aa, Rickettsia akari str. Hartford
MKLPYINYNSFINTLSKRLQKNKQLEKIIAQFHQDYNLIPIIGVEIEFYLSHNVDIAKFEILSSKYLARFKIAKIKKEKGNNQFEIDLPPSVNLIQYIHNILEVKNILKKIAQQLNGYIDFSPKPFLDDYGNSMHFHINFNSAFNDYYIILAAQGLCHYMLDTILAFMPTTLDYSRINKQFMAPTHISYGGNNRSVAVRTPNSFPKRLEHRLASPETDPYIAIFTILKSILLALRSPSSLHKIEKIYGNAFDPQYNLTPLPTSSQESFMLFKPDFFK

SEQ ID NO: 49579 - protein, 632 aa, marine gamma proteobacterium HTCC2143
MITEIPHSRPETPLLDAIDQTADLRQLEEAQLLQLTDELRQYLLFSVGQTGGHFGAGLGVVELTVALHYLYNTPDDRIVWDVGHQTYPHKILTGRREKMPTMRIQDGLSGFPKRSESDYDTFGVGHSSTSISAALGMAIAARQQGLDRKCVAVIGDGAMTAGMAFEALTHASHVDANMLVILNDNLMSISHNTGGLNTYFSKIWASKTYTNFRAGSKKVFSKIPPAWGFAKRVEEHIKGMVGPGTLFEELGFNYIGPIDGHDLPMLINTIGNMRDLQGPQLLHIMTKKGKGFTPAEDDPVGYHAINKIEATPPSTPKKVTAKKKYQRIFGDWLCDMAAQDELLIGITPAMGEGSGMIEFSEKFPDRYHDVAIAEQHAVTLAAGMACDGLKPVVAIYSTFLQRAYDQLIHDVALQNLNVLFGIDRAGLVGEDGPTHAGSFDLSYLRCIPNMMVMTPSDENETRQLLYTGFQHIGPAAVRYPRGTGPGTAIEQQMTALEIGKGVIRRRGSQVAILNFGTLLANALEVANDLDATVADMRFVKPIDESLITELAKSHDLIVTLEENAIAGGAGAAVSEYLNSCGINTATLHLGLPDRYIDHGKHENQLQQCGLDAPGIRTSIAHRLTLILPSSCG

SEQ ID NO: 49580 - protein, 195 aa, marine gamma proteobacterium HTCC2143
MSIRFVESSKLPTQWAEFEMHGFEDTDADKEHVVLTLGDVGSGAPVLARIHSECLTGDALFSLRCDCGSQLKAALEAIAKEGCGALFYLRQEGRGIGLLNKIKAYKLQDHGADTVEANEQLGFGADMRDYSICNAMLKHLNIQQIRLMTNNPKKVKALTDQGIDVLERIPLHTGQNPHNEKYLATKAGKLGHLIG

SEQ ID NO: 49581 - protein, 130 aa, Pseudomonas fluorescens Pf-5
MQFGYTIIYVPEVEGSLRFFEQAFGFKRRFLHESGTYGELETGSTTLAFADHDLAEMNFPAGHVAAHSSPKPLGMELGLVTADVQAAHARALEHGARELAPPTSKPWGQTVSYVRCPDGTLVELCTPVAP

SEQ ID NO: 49582 - protein, 848 aa, Rhodobacter sphaeroides 2.4.1
MQKIEPISDFDRITPTAAISLKTHGFRAKCLQRLVRLDLPVPVTVALPATTVRAIAAGHPVDCPAILADFGPTPLVSVRPSPENPDWGGPATVLNIGMNAARHAALARIHGEEAADAIYLGFIQSYAIHVARLDPEMFETGGSSSEALRAALHAWAEEMDEPFPQDPAQQLSEVLRSMARAWEGTTARLLRQAKGAPAEARLGLVVQEMAQDLGQGISGSGVIQFVDPATGVPQVTGRFFNRSRAWHGKAETLYLTQDPRGPSLEERAPEIFAALCRHGSVCRARLREEMQIEFTIEDSHLSVLDAVKVQRSSRAGLRIAVALADDQVITRSEALLRVEPRALSELLHPQVDPRGRRDRFARGIAASPGAAVGRIVFSSQAAQASAARGEPCILVRRETSPEDIRGMNCAAGVLTERGGVTSHAAVIARGLGLPCVVGASEIRLDARERRLVAPDGRVFREGDLITVDGTAGEALAGEAAMLAPALDSCFRKLLSWADEMRDIGVRANADTPADALVARQFEAQGIGLCRTEHMFFTDDRLVVMREMIFADSATDRAAALARLLPMQRADFVQLFEIMQGHPVCIRLLDPPLHEFLPHSREGLLELAEALDRPLSEVTRRVEAMAEFNPMLGMRGVRLGVAIPEIYDMQAQAIFEATLEVAGRGDPVVPEIMIPLVSARREVELVKTRIDAVAAAVHTKYGREFAYRLGVMVETPRAALRAGEIAQHAAFLSFGTNDLTQMTYGLSRDDAGRFMNTYVQSGVFPEDPFHILDVDGVGELLLIGAERGRATRPDLVVSICGEHGGDPESIEFCRRAGFDYVSCSPYRVPLARLAAAHLAIRSREQPNAS

SEQ ID NO: 49583 - protein, 325 aa, Zea mays
MGEASPSIAKDVTELIGNTPLVYLNKVTDGCVGRSRAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 49584 - protein, 146 aa, Cryptococcus neoformans var. neoformans JEC21
MSLSRTFLRQLRPASSSRVVLRSFSSSRSTFSETPAGDAPVNPKIAPIVDSISSLSLLEVSELVTALKTKLNITEISLPAASSPASAAASSTSSEAPVEEKPKEKTIFTVKLEKFDAAAKAKIIREVKALMPNMNLVELRRVEEKE

SEQ ID NO: 49585 - protein, 332 aa, Oryza sativa Japonica Group
MSTTNHYQHIKSNKPVLGKARKLKDLMLKSDNRICADCGAPDPKWASANIGVFLCLKCGDVHRALGPDVSKVLSVTLDDWSDSDIDSMLEIGGNSYANSIYESFLPKDHPKPKMDSTMEYRTKFIRAKYETQDFLKPSLRITSKGSFDATNAVKSVTSSISSASGKHVADDTREFVGELNITVVRGIQLAVRDMLTSDPYVVLTLGEQKAQTTVKPSDLNPVWNEVLKISIPRNYGPLKLEVYDHDTFSADDIMGEAEIDLQPMITAVMAFGDPSRVGDMQIGRWFMTKDNALVKDSTVNVVSGKVKQEVHLKLQNVESGEMELELEWVPIP

SEQ ID NO: 49586 - protein, 407 aa, Francisella tularensis subsp. holarctica
MYDVNKIRQDFPFLAQKINNKSVLFFDTGASAQKPQAVIECVAEAYAYNYANVHRGVYSLSQEASEKYENVRQIVQKFLNSKSADEIVITKGTTEAINLVASSIGKGIIRSDDEIVVTEMEHHANFVPWQMLCEDKNLDFKVAAVKDNGELDVDNLLALVTAKTKILAITLCSNVLGTINPVKEIIKQVREINPNIIVLVDGAQAVIHTKVDVQDLDCDFFVFSGHKLYGPTGVGILYGKYELLKQLPPYNYGGDMVDEVTIAKTTFALPPYRFEAGTPNIVEAIGLGRAIEYVDSIGMINIEKHEQKLLEYATAELNKIDGLTIFGQAKHKVGVITFDIQGCNAGDIGELLAIKGICVRTGKHCAHPLMYRMGVTSTVRMSFGMYNTFEEIDLFIIALKKVISQLK

SEQ ID NO: 49587 - protein, 442 aa, Lotus japonicus
MRVLQLGLLLALASGFAAISIYIIGLSDPSVYPTYHLTDEDTQALLSLHNTFQKCVSANGLGLKAAMSSDYCQTTINFPSDTIPKWVNPKTGELEALSFDFNLCEAVATWEQVRNSTTILTKEFIDSLPNGWEEYAWRRINKGALLNRCENRTLCMEKLSLVLPDTPPYFPKQFGRCAVIGNSGDLLKTKFGKEIDGYDVVIRENGAPIQNYTDYVGRKSTFRLLNRGSAKALDKVVELDERRKEVLIVKTTIHDIMNKMIKELPIKNPVYLMLGASFGSAAKGTGLKALEFALSMCDSVDMYGFTVDPGYKEWTRYFSESRQGHTPLHGRAYYQMMECLGLIKIHSPMRADPNRVVKWVPSHHIMRAASIASEKLLRRVGAGSEDPLRACSITKKQIKRNSNAVSNLRKVALDHIRYVKGTTMYPLEHSPGHGVLCTVPAN

SEQ ID NO: 49588 - protein, 878 aa, Rickettsia akari str. Hartford
MKKLIYYFGSNGSDGNASMKNVLGNKGAGLAEMSNLKLPIPDGFTITTDLCNYFYTHNNNFPKNFQNDLKKAITKLEITTGKIFGSTSNPLLLSVRSGSTISMPGMMDTILNLGMNNEVCNALADSCGDKRFALDSYKRFLEMYGSTVLSIPSDLFEQIYEKHKIQADIHKDSDITVELLEKIIEDFKRLHIKYTKQLINDPYEQLESAIKAVLHSWMSNRAVIYRKINNISECFGTAINIQAMVFGNLGKTSATGVAFTRSPATGEKKLFGEFLINAQGEDIVSGTRTPMPIIANGSNSMQAMMPEVFKELSQIARKLEEHYLDVQDIEFTIENNKLYILQTRTAKRTAIAAINIAVQMVEEKLISKEQALMRIDPESLNQLLHTSIDYSKGFTSIADGLPASPGAATGIAVFSPYDAEKLSHHHKVILVRHDTSPEDINGMHVSSGIVTIRGGMTSHAAVVARGMGKPCVCGTSNLSIDEKKQILTAGDIVIKQGDIITIDGGSGKIFLGEMPLIQPTFSEESKLILDWADEISSLKVRANAETVNDALVSIKLGAQGIGLCRSEHMFFDKNKIPLVREMIIAPDIERRKLAVQKLLPLQTEDFKALFRVMKDKPVNIRLLDPPLHEFLPTTEEDKKDLANSLNLPLSMINQRLHAMHEVNPMLGHRGCRLGICSPEIYKMQIEAVFTAMFELHKKEHIECNLELMIPLISNVGEIKKLKMDIYEVIEELEQRYRYKFSFTLGTMIELPRAALDSKKIAKEVDYFSFGTNDLTQTTYGISRDDIASFLPYYLEEKIFESDPFTTLDEEGVGELIEIAIKRGKSSNANLKLGACGEHAGNPASIAFFHRMNLKYVSCSPYRIPIARIAAAQAKIKHG

SEQ ID NO: 49589 - protein, 221 aa, Escherichia sp. Souza-57
DLLDAEYMAYMLKYDSTHGRFNGTVEVKDGHLVVNGKTIRVTAERDPANLKWNEVNVDVVAEATGLFLTDETARKHIAAGAKKVVLTGPSKDNTPMFVMGVNDKTYAGQDIVSNASCTTNCLAPLAKVLNDKFGIVEALMTTVHATTATQKTVDGPSHKDWRGGRGASQNIIPSSTGAAKAVGKVIPELNGKLTGMAFRVPTPNVSVVDLTARIEKKATYK

SEQ ID NO: 49590 - protein, 800 aa, Oryza sativa Japonica Group
MSLLLCFLLFSLYPPRISAATDTVSPGHALTGSDRLVSNNSKFVLGFFKTESKNSSYASHNSYLCIWYSKLPMITPLWSANGENPVVDPASPELAISSDGNMVILDQVTKNIIWSTHVNTRTNHTIVVLLNNGNLVLQSSSNSSKVFWQSFDYPTDSLFAGAKIFRNKVTGQKNRLVSRKNSIDQAAGLYSVEFDINGTGHLLWNSTVVYWSTGDWNGHFFGLAPEMIGATIPNFTYVNNDREVYLSYTLTKEKITHAGIDVNGRGLAGIWLDSLQNWLINYRMPILHCDVYAICGPFSVCNDSNNPFCDCLKGFSIRSPKNWDLEDRSGGCMRNTPLNCGSTMNKKGFTDKFYCVQNIILPHNAMSVQTAGSKDQCSEVCLSNCSCTAYSYGKGGCSVWHDALYNVRQQSDGSADGNGETLYIRVAANEVQSVERKKKSGTVIGVTIAASMSALCLMIFVLVFWMRKQKWFSRGVENAQEGIGIRAFRYTDLQCATKNFSEKLGGGSFGSVFKGYLNDSIIIAVKRLDGACQGVKQFRAEVNSIGIIQHINLVKLIGFCCEDGKKLLVYEYMTNRSLDVHLFKDNDKVLEWNIRYQIAIGVAKGLAYLHDSCRDCIIHCDIKPENILLDASFVPKIADFGMAKVLGREFSHALTTVRGTIGYLAPEWISGTVVTSKVDVYSYGMVLFEIISGRRNSNQEYCRGHSAYFPMQVARQLINGGIENLVDAKLHGDVNLEEVERVCKVACWCIQDSEFDRPTMGEVVQFLEGLLELKMPPLPRLLNAITGGSHSTSLLPIDLQ

SEQ ID NO: 49591 - protein, 453 aa, Treponema denticola ATCC 35405
MYDLIVLGGGPGGYVAAIKAGRAGLKTALIEKNRLGGTCLNKGCIPTKYLLHTAEVFGSFAENDLGLSGENLKYDIKAIYEKKNAVVDKLVGGIEKLIENAGVDFYNGEGKITSKSSVSVNGKELEFKNLIIATGSSVFAPPIAGIETAMTSDDILGKEPVDFKSVIIIGGGVIGIEFATVYANLGKEVTIVELEKTILPPFDRDIAMQQAIVLKKRGVKIINGAMVTKIEKTGCTFTLKEKEESITADAVIVCIGRIAEIKDIGLDSAGIEYDKRGIITDACMKTNVEGIYAIGDAVKGNVMLAHNAENQGHLVVENIVNNTKHEKQDVIPSCVYSTPEIAGVGLSEKEAEAKGITVKIGKVPMGSNGKSVLSGLDVGFIKVLFNEEDRIVGCQMMCDSATDMIGAIGTLVTNKAKRENILKSMYPHPTVVEAFYEAVEDVEKSATHMIYKK

SEQ ID NO: 49592 - protein, 1706 aa, Shewanella sp. ANA-3
MKLKIVTCTVAAALYGAGAMQAAASMGQVHQLKGLQLTQEEISSLITSSANTPILDVAQAEGLNMQITPQTNKFVYEEGLTGEQIYIVRLNQKPLAQVSADLLGSTGTSVRSTAKASKLYVAGQPSNSAVQNYRSQLLTSQNKVLAEIKSTVGAREARQQFTNAVNGFSMAMTQEEAQRVSQLANVASVRLSKNYELQSDAGPQLIQADKIWTGAATQDAVPYKGEGIIMGIIDTGINSDHPSFAVMGDDGYKHINPWEPGKFIGDCTKEGFETMCNDKLIGVRSYPVITDNFTNGNYGATRPAVGEDYQGHGSHVASTAAGNVLLNVDYISPDGGKAVSDGTVIKEKLFPSISGVAPHANIIAYQVCHPDNAITAGCPGEALLAGIEDAIKDGVDVINFSIGGQDSNPWADDIELAFLAAREAGISVAVAAGNSGQPTGYKEYFGAIDHASPWLMNVAATTHDREVEITTKLVDPTGGTEAPKWTEIVGGAINKTSVTGRVVLAKTYGDEYCAKPFAEGSFDLKDADGNPTDVIVVCKRDSLSNTAGTARSVKADNVKAGGGDGMIMYNYAIGDAIVPTASYSIPSIHIIKEEYDGRYDNGMAGYGLIDWLNKGGMPTLTITATDIERTLDPARADWLAAFSSRGPSPSTPEALIPAVAAPGVNIYAAFADEHPFSGSPSSGDFSFLSGTSMASPHVAGSMALLRQAQPSWSATEIQSALAMTAENKVHYYRLDDKTSDVALAQTYRAGTGRINVANAVNVGFVMDETVENFKAANPNNGGAVHKLNIPQLVNFECKPKCQWIRTIKATKDGSWSVTNGDVINWNVDTRNQLVQNGVSIKASPSEFTLKAGETMDIVIEASIMDTQDWFSNSEVELHSNLIFTETSANASEAHWPIVFKYDKNSMPSMLNAKAHRNDASVVFKGINLPENDNVYGRMFAPVKAVVKTIELPKDDDDEYAWSKTPDLTLGDDMRIDEATYVEWIDVPAGSRRLIVESLGNIESTLKGTSYVGNLNIYVGKDYNGNGKPDPLEEVICVSNHGTYNNFCNINQPEEGTYWAVFYSSQKGTAADNFNAGVVETYKLTTAVVTDEVASNLNVDVPASNGTDPVDVTMNWNIPEMTNGDIYYSLMDFGSSAVNAGNIGKVAVKLERGIDDVNLDVTQTKALPGDQIPLTFQVQPNDSGADRAFSIVATIPEGLKLKAEDVLTSSSAIVKDVKLEDNKLTISGVQPDTRDLAPSYNVTTNAEDPMCRTPNFGNSNPGGYVNLEEFGIYPSMSGFAPIELGSNGRVLSGKDNNILYTSGIGVPVKTLFGGDYDRFHLYNNGDVVNGWIQNNLEIRGTGVLSLYQGPKFLKPDHLQFPFKSVPYSAIGMLWRGVGTGAAKNTLMSVPLINTSSERAGITLASTSTGWGILEYDNARSYTAAGTDSTTRAYKWTEADDRFDFELLFNVNTRYGDGEYEMMMAYDNIDFGTQDGRGSVGLQGFKGLLNTYGPLEGYLGEQFAYDNLDEKLTSGLVICYDYVGPEVSQFEVTAWTTVKDNTAGKVLTVDAVSQVDGMADINMSHSISVPGNISVARIANQTTPENTSLAGLKVIYADEQNSVNTISVTGDNITAVVDGHTSGSSVTITPKKNFHGDVQVTVTVTDVENPADKASTTFMLTVVSDGKGATTETPTETPVEETESSSGGALGGLSMLLALGAMIRRRTR

SEQ ID NO: 49593 - protein, 221 aa, Escherichia sp. Souza-207
DLLDAEYMAYMLKYDSTHGRFDGTVEVKDGHLVVNGKTIRVTAEKDPANLKWNEIGVDVVAEATGIFLTDETARKHITAGAKKVVLTGPSKDNTPMFVRGANFETYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYQ

SEQ ID NO: 49594 - protein, 221 aa, Escherichia sp. Souza-273
DLLDADYMAYMLKYDSTHGRFNGTVEVKDGHLVVNGKKIRVTAERDPANLKWDEVGVDIVAEATGLFLTDETARKHITAGAKKVVLTGPSKDNTPMFVKGANFDKYEGQDIVSNASCTTNCLAPLAKVINDNFGIVEALMTTVHATTATQKTVDGPSHKDWRGGRGASQNIIPSSTGAAKAVGKVLPELNGKLTGMAFRVPTPNVSVVDLTVRLEKAASYE

SEQ ID NO: 49595 - protein, 509 aa, Campylobacter jejuni subsp. jejuni NCTC 11168
MLQALAIKYRPKTFDELIGQKTVSVSLKYALNHNRLAHAYLFSGLRGSGKTSSARIFSRALVCEQGPSDTPCGTCKHCLAALEGKHIDIIEMDAASNRGLEDIQALIEQTKYTPSMARFKIFIIDEVHMLTPQAANALLKTLEEPPSYVKFILATTDPLKLPATVLSRTQHFRFKQIPQSEILNHLKEILLKENVKFEEEALKFIARSGNGSLRDTLTLLDQAIIFCQNEISISKITDMLGFLDPQKIKAFYQAILTKDKEKVFVYLEELQDYEASSVIDEMLFYLKESFFAKSTEFSTLIYERFFRILSKAKNMLCDDDGFTLCVMAFMMMEASHLKEIDAQIQEIKQENTTNIISRITPSPIIPHLEKKTEKNAYEILLDSIYDRDFDLAECFKQSTNFISFENNTLNINSNAQGQNRDTLNKGFKLIQELFKAKFGENAKINVQKALTIDENKLQSLTQELPNNENKNIDIQSSINMLKEGAKKFDPQEDLKEALKDCFGEPSIEN

SEQ ID NO: 49596 - protein, 237 aa, Synechococcus sp. RS9916
MDLQTQMKHAVAAAAVDQIKDGMVLGLGSGSTAALMIQGLGAKLASGELKDIVGVTTSFQGEVLAAELNIPLLSLNAVDRIDLAIDGADEVDPGFQLIKGGGACHVQEKLVAARAERFVVVVDSTKLVDRLNLGFLLPVEVLPGAWRQVQQQLAAMGGTAELRMAQRKAGPVVTDQGNLVLDVKMNGGIADPAALELAINNIPGVLENGLFVNLADEVLVGEVNGDVAGVRSLERRA

SEQ ID NO: 49597 - protein, 396 aa, Shewanella sp. ANA-3
MDKADMSSYDIAIIGGGISGVGIAQYAAAAGYSTLLIEKGEIGGQTSANSSKLIHGGLRYLESGQVNLVRKSLQERRHLLDFAPSLVKAVPFYIPVYQDSQRNPWTIRAGLSLYALLSEFDPLGRFVSIPAVHWHRFNGLKLQGLKAVFQYWDAQTDDKLLTQAVARSAEALGAHVYAEAEFLQLNHLSEQIDLSFRLRGEVQQIDAKLVINAAGPWVNEVIAKVSPPLAGVELDWVQGAHLLLDLPAPDGILYLESCFDKRVIFVMPWYGQMLIGTTETELTSLDSPPQVTESEINYLLGIYRHYFPLSASIDELKTKIVQTFCGVRVLPKQASSAFERPRDTLMQTSISHPRLLSLYGGKLTTFRSTSAEVLEWVEQKLGKRTPIADIDSLRLS

SEQ ID NO: 49598 - protein, 431 aa, Idiomarina baltica OS145
MSNSLQQAIQFDQQHIWHPYTSMTDPLPCYHVKSASGCEIELSSGEILVDGMSSWWAAIHGYNHPQLNAALHAQADKMSHVMFGGLTHQPAINMVERLIDLTPAPLDRVFIADSGSVSVEVAIKMALQYWFSIEQPKKNQLLTIRGGYHGDTFAAMSVCDPVNGMHHMFRHALCNQHFVERPAVEFDDEWEPSSLSSIQQELEQHHTEIAAVIIEPVVQGAGGMRFYHPEYLTQLRELCNHYDVLLIADEIATGFGRTGQLFGCDHAGIVPDIMCVGKALTGGYMTLAATVTHAKVAEAIGQGQGGGALMHGPTFMGNPLACAVANASLSIIQSGDWKTQVPRIECQLREELGPLKRHPSVADVRVLGAIGVVELNKPVNVARTQALFVELGVWIRPFGRLMYIMPPYCISAQQLSKLTHAIAVYLETTTN

SEQ ID NO: 49599 - protein, 306 aa, Zea mays
MPTANVRAAQPSADRRLSTLVRHLLPSSPRTSAATATSADSSLQPFPTMASPSVFAGIAQGPEDPILGVTVAYNKDPSPVKVNLGVGAYRTEEGKPMVLNVVRRAEQMLIQNESRVKEYLPITGLADFNKLSAKLIFGADSPAIQENRVATVQCLSGTGSLRVGGEFLARHYHERTIYIPQPTWGNHPKVFTLAGLTARSYRYYDPATCGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLY

SEQ ID NO: 49600 - protein, 398 aa, Erythrobacter sp. SD-21
MSSFRTLDDLGDVTGKVALVRVDLNLPMKDGSATDVTRVEAVKPTILELADKGAKVLLLAHFGRPKGQRHSTMSTSFVQGDVEKVLGKEIMFIPEVMGPVVEQSIGILRNGDIGLLDNVRFWPGEEANDPEFARGIAAHGDFYVNDAFSAAHRAHASTEGLAHHLPAYAGRAMEAELKALDAALGNPEQPVAAVVGGAKVSTKLDVLENLVGKVQHLIIGGGMANTFLAARGVDVGKSLCEHDLKDTANRIMDQADHAGCTVHLPYDVVVAKEFAANPHSLRVCNVHEVAEEEMILDVGPQAVEALGDVLKTCRTLVWNGPMGAFETEPFDAATVALAKTAAALTEGGSLTSVAGGGDTVAALAHAGVKDDFTFVSTAGGAFLEWMEGKDLPGVAALK

SEQ ID NO: 49601 - protein, 335 aa, Erythrobacter sp. SD-21
MATKVAINGFGRIGRLVARAILEREDHDLELVSINDLADTKSNALLFQYDSTHGRFPGTVEVGDTAIIVNGKSIAVTSEREPGKLPHGKQGVDIVLECTGFFQSDEACRPHLDAGAKRVLISAPAKGVSATIVYGVNHETLTAEDVIVSNASCTTNCLSPMAKVLHDTVGIERGFMTTIHSYTNDQRMLDQMHGDMRRARGGAQNMIPTTTGAARAVGLVLPELAGKLDGSSVRVPTPNVSLVDLVFTPGRDTSAEELNAALKAAAEGPMKGVLDYTDQPLVSSDFNHYPASSTIDSLETSVMEGKLARVVSWYDNEWGFSNRMIDTAGVMAKFL

SEQ ID NO: 49602 - protein, 159 aa, marine gamma proteobacterium HTCC2143
MKGIDTPQYDQVVLAGKKIAIVVTRWNKFIVDKLLQAATEHLIANGIAESDIVTIMCPGAYEVPLMCQHVAASKKYDAIITLGAVIRGGTPHFEYVAGECSAGVMRVSLDTGLPIAFGVLTVDDEKQALDRCGVGEKSENKGEESAACVLEMLCAISSL

SEQ ID NO: 49603 - protein, 372 aa, marine gamma proteobacterium HTCC2143
MALNTVEELIQDIRLGKMVILMDDEDRENEGDLVMASECVRPQDINFMAKNARGLICLTLTEDRCRQLDLPLMVDGANGAQFGTNFTLSIEAAVGVTTGISAADRAHTVRTAVARGAQSSDIVQPGHIFPIMAQPGGVLTRAGHTEAGCDLARMAGFEASGTIVEIMNEDGTMARRPELEKFAIEHNLKIGTIADLIHYRLVHERTIEKISHGLVNTDFGEFTLHTYKDLLAGEIHHALVKGDVAQDDATLVRVHHVSAIRDLFYTQPDTSPNWNIRRCIERVAKEGSGVVVMLAQGETVAETLASVDIAMGKKPAPISIADGSQNVYLTVGLGSQILRDVGVNKIRLMGPPIKYNAISGFDLEVVDFISPE

SEQ ID NO: 49604 - protein, 613 aa, Vitis vinifera
MHSNQLGRQPLIPTHSPRKHFSFTISTSTCPESPKSYILKKCIALLLSCASSKFKFRQIHAFSIRHGVPLTNPDMGKYLIFTLLSFCSPMSYAHQIFSQIQNPNIFTWNTMIRGYAESENPMPALELYRQMHVSCIEPDTHTYPFLLKAIAKLMDVREGEKVHSIAIRNGFESLVFVQNTLVHMYAACGHAESAHKLFELMAERNLVTWNSVINGYALNGRPNEALTLFREMGLRGVEPDGFTMVSLLSACAELGALALGRRAHVYMVKVGLDGNLHAGNALLDLYAKCGSIRQAHKVFDEMEEKSVVSWTSLIVGLAVNGFGKEALELFKELERKGLMPSEITFVGVLYACSHCGMVDEGFDYFKRMKEEYGIVPKIEHYGCMVDLLGRAGLVKQAHEFIQNMPMQPNAVVWRTLLGACTIHGHLALGEVARAQLLQLEPKHSGDYVLLSNLYASEQRWSDVHKVRRTMLREGVKKTPGHSLVELRNRLHEFVMGDRSHPQTEEIYVKLAEITKLLKLEGYVPHISNVLADIEEEEKETALSYHSEKIAIAFMLINTAAGIPIRVVKNLRVCADCHLAIKLISKVFDREIVVRDRSRFHHFKDGHCSCKDYW

SEQ ID NO: 49605 - protein, 280 aa, Francisella tularensis subsp. holarctica
MIKVSFQGEHGAYSEQAITNFLEQQNIKDFQTVPCWSFSDAIEHTISGKSNFVMIPVENSLAGSVVPAYDELIKSNLKVKAEVVLKIKHCLMGLNDVEISEIESVISHPQALSQCANSLKKLKLTPEAFVDTAGAAKYIFEKNKRNHLAIAGELAAKTYGLKIFQHELEDEQFNYTRFLLMGYDDIKVNSADNKYKTTIIFSVEDKSNALVNTLNVFGKYNINLTKIESRPSRNRAWNYLFFIDFEGSDDDFNVQQALLEVLKKSTFLKVLGSYKSYHFS

SEQ ID NO: 49606 - protein, 582 aa, Cryptococcus neoformans var. neoformans JEC21
MTMELLKVLHHEASQLFPNCIRSSPVACIVLYSFGGIAILLFSVYLWLWPFQYAKLYFRNLPGPPSDSWFWGVVPTLIKSPPSVPHSMWTDEYGPTVRYRVALGAQRFLTIDPTALNYILSHADLFPKPSRVRKALSDLLGNGLLTAEGHTHKKQRKALNPSFSPAAVRGMIPVFYDKAYELKAKLLGIIEGDETEQASPTPCKEEDEVEGGKKIDVMKYLGKTTLDVIGIVGFSYDFKALSEPRNELSEAYSKMFQAGMDANFWDFLRGAIPLVNKLPNKRATEIAARKAVTLRISKKIVEDKKREVMSAHSEGLEKREDIGDDLLSILIKANMASDVKPEQKLSDEEVLDQITTFMLAGNETSSTALTWILYSLTQHPECQTRLREEVLAVPDDRPSLETLNNLPYMDAVIREALRLHAPAPGTMREAKEDTVIPLSMPVIGRDGKQIDSVKINKGTMVFIPIITVNTSPAIWGPDARVFNPDRHLKTSSDSFGGANMHVPGVWGNMLSFLGGARNCIGYKLALAEISTILFVLIRSFEFQELKSKPEVEKKASVVMRPRIKGEESAGLQMPLMVKPLLM

SEQ ID NO: 49607 - protein, 375 aa, Rhodobacter sphaeroides 2.4.1
MPALRPDVDPDGLMEFSVVFTDRSLNHMSAKFQHVMRDISGMLREVYGAEAVAVVPGGGTFAMEAVARQFATGAQALVVRNGWFSYRWTQILEAGGFAAGQTVVMARPSGNGARAPFAPPPIEEVEAKIAEAKPDVVFAPHVETSAGIILPDDYIARMAEAAHAAGALMVLDCIASGCIWVDMAATGVDVLISAPQKGWSASPAAGLVMLSGRAVERLEATASNSFALDLKKWRAIMAAYEAGGHAYHTTMPTDALLGFRDAMAETKAMGFEAAKSAQWRLGQEVRAMLAEKGVVSVAAEGFAAPGVVVSYTDDPEVQTGRKFLAEGLQIAAGVPLQVGEGAEFRTFRLGLFGLDKLADVEGTVARLRRAVEAVL

SEQ ID NO: 49608 - protein, 728 aa, Cryptococcus neoformans var. neoformans JEC21
MPDVVLPLVQTPPFVIIALAALQGIPVTWDAQSGEQGQTTYGDIVGAENVRAELEKGVDGKEIPLPPLPTLLTSTSSFQDVSAVLDAFDDYLAYRTYFAGPKFGFGDATIWGTIRGNNSAIGSIKKPGRPHLQRWFNHVETLDVPKAALESHRQAKSEMEKGKKTKRLESIDVVLPNAIKGKVVVRFAPEPSGYLHIGHLKAAILNRYLADQYQGKFILRFDDTNPLKEEGEFEEAIQEDLKMIEISFDKIVHTSDHFDKIQAYAEQLIKQGDAFMDDTEGETVKEQRRAMIPSKNRDLSIEENLVKFKEMCEGTEEGKRWSLRAKIDYQHKNGTLRDPVIYRYVEGSHHVTGTKYKSYPMYDLACPIIDHLDGVTHALRANEYWARHEQYQWFLKTLGFANIEIFDFSRVDFVYTVLSKRKLKYLVEKNVVKGWDDPRFPTVRGIRSRGMTVQGLKNYILGQGASQQAVQLEWDGIWTVNKKVIDPVAPRYWAIAEDRMVSVNVIGRETEEPEVVSRPLHKKNPEVGEKKLVFASKLIMEQEDAKTFGENEEITAMDWGNAFVTSKITTPSGDVSSLTITLHLAGDFKKTSKKVTWLAAPTDANPLIPVVLIEYDYLITKKKLEEDDSLPEVLNPKTEYRTYALASKEVEGLKKWDIIQFERKGFYICQGTRDNQGRMEFGFIPDGRAATVALKAKPAKEKTKVPGTAKGSWGKPGPKAVSTAAAAP

SEQ ID NO: 49609 - protein, 181 aa, Sinorhizobium meliloti 1021
MAARILPVDNFRSAPAGTDRVMRIGLFAVGRLKAGPEKDLAGRYLDRFAKAGPAVGLELARVVETAESRAANAETRKREEAGQLEKALADGSLLVLLDERGKALDSEAFARLLGTLRDSGKRDLMIAIGGADGLDPALHARADAVLNLGKMTWPHQLVRILIAEQLYRAVTILSGHPYHRA

SEQ ID NO: 49610 - protein, 420 aa, marine gamma proteobacterium HTCC2143
MSTDFKQAALDYHSQPKPGKISVELSTAAATQSDLALAYSPGVAEPVLAIAENPERAYDYTVKGNLVAVISNGTAILGLGDLGALASKPVMEGKALLFKRFAGINSIDIEVDTADPTEFIDTVARIADTFGGINLEDIKAPECFGIEAALIERCNVPVFHDDQHGTAIVTAAGMLNALDIQGKKLETARIVCLGAGSAAVACMRLLRGMGAAKDNITMLDRRGVIYTGREGLNEFKEEFAHSTKNRTLADAMKDADVFVGLSGANLLSPDLLKTMAPNPVVFACSNPDPEISPEIANATRDDLIMATGRSDYPNQVNNVLGFPFIFRGALDVRATCINEAMKVAAVNALRELAKEPVPQVVLDACGVESLEYGSGYIIPKPVDERLLGKVSAAVAKAAIDSGVAKLGYPSNYPLKTPADV

SEQ ID NO: 49611 - protein, 332 aa, Ralstonia metallidurans CH34
MTIKIGINGFGRIGRMVFRAAAANFKDIEVVAINDLLEPDYLAYMLKYDSVHGRFDGEVSVEGNTLVVNGKKIRLTAVKDPSELKWGEVGADVVIESTGIFLTKEGAQKHIDAGAKKVIMSAPSKDDTPMFVFGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELENPAKYEEICAEMKAQSQGALKGVLGYTEDKVVATDFRGDARTSIFDAEAGIALDGTFIKVVSWYDNEWGYSNKCLEMARVVAK

SEQ ID NO: 49612 - protein, 219 aa, Agrobacterium vitis
MTIEERLDEVRTRIAAAAEDADRNPEAVTLVAVSKTFDADAIRPVILHGQRVFGENRVQESQGKWPELKAETPGIELYLIGPLQSNKASEAVALFDVIETVDREKIARALAEEMAKQGRLLRLYVQVNTGLEPQKAGIAPQETKAFVVLCRSELGLEIEGLMCIPPAEENPGPHFALLAKLAGECGVSRLSMGMSGDYETAIAFGATSVRVGSAIFGHR

SEQ ID NO: 49613 - protein, 402 aa, Arabidopsis thaliana
MKKKGTNNNNFSLLSLSLFLNCLILTNGYSIGVGVGIGGGDGDDGGVWIGGGNPNSNPGSAPNQQQTTNAAYNALQSWKSAITEDPSGVLKTWVGEDVCSYRGVFCSGSSITSIDLNKANLKGTIVKDLSLLSDLTILHLNSNRFSGQIPDSFKNLDSLQELDLSNNRFSGSFPQVTLYIPNLVYLDLRFNNFTGSIPENLFNKQLDAILLNNNQFTGEIPGNLGYSTASVINLANNKLSGEIPTSFGITGSKLKEVLFLNNQLTGCIPESVGLFSDIEVFDVSFNSLMGHVPDTISCLSEIEVLNLGHNKFSGDLPDLVCTLRNLINLTVSFNFFSGFSSQCSSLSVGFDFTGNCIPGKGYQRPQPDCSAIPGGQLSCFRIPAQPLTCAAISLGLKVASSP

SEQ ID NO: 49614 - protein, 437 aa, Mycobacterium avium subsp. paratuberculosis K-10
MHFARHGPDITPPIITRGHGVTIYDDRGNSYLDGLSGLFTVQVGHGRAELAEAAARQAGTLAFFPLWGYATPPAIELAERLAGYAPGDLNRVFFTTGGTEAVETAWKLAKQYFKLTGKPGKHKVISRAVAYHGTTQGALAITGLPRYKAPFEPVTPGGFRVPNTNFYRAPEAFANDPKGFGLWAADRIAEAIEFEGPDTVAAVFVEPVQNAGGSIPPPPGYFERVREICDRYDVLLVSDEVICAFGRIGSMFACADFGYVPDMITCAKGMTSGYSPIGAMIASERLFEPFDDGDTMFPHGYTFGGHPVSAAVGLVNLDIFEREGLNDRVRTLAPTFRATLEKLYDLPIVGDVRGEGFFYGVELVKDRATKQTFTDSERRALLGRVGAALFEAGLYCRTDDRGDSVIQLAPPLISGQAEFDTIEAALRGVLSDECRRL

SEQ ID NO: 49615 - protein, 450 aa, Mycobacterium avium subsp. paratuberculosis K-10
MARGSRRGLLVGLTAASVGVIYGYDLSIIAGAQLFVTEDFGLSTRQQELLTTMAVIGQIGGALFAGVLANAIGRQRSVLLILSGYAVFALLAAFSVGLPMLLTARLLLGLTIGVTVVVVPVYVAESAPTAVRGALLTAYQLAIVSGLIVGYLSGYLLADTHSWRWMLGLACVPAVLLLPLVFRMPDTARWYLLKGRVDDARRALLRVEPVARVDDELAEIDRAVSEEAASLPAMLAEMVRSPYRRATVFVVVLGFLIQITGINAIIYYSPRIFEAMGFTGNFALLALPALVQVAGLVAVGTALLLVDRVGRRPILLCGTAMMIVADVVLVAVFGRGPGGVIAGFAGVLLFIFGYTMGFGSLGWVYASESFPSRLRSIGSSTMLTSNLVANAIVAAVFLTLLHSLGGAGTFAVFAVLAVVAFAFVHRYAPETKGRQLEDIRHFWENGGRWD

SEQ ID NO: 49616 - protein, 515 aa, Yarrowia lipolytica CLIB122
SRRNPPEKKYSSVVIRHKHRPSSHIQLHTMSKLTVNTDLSDSEDEVLQKNEESLDDYCPGGYHPVKIGEKFANGRYVIVRKLGWGHFSTVWLARDTQNNDRHVAMKVVRSASHYTETAIDEIKMLERVSSKNPDHPGKAHVVGLYDSFKHVGPNGTHYCMVFEVLGENLLGLIRRHQFAGIPVKLVKQITKQVLLGLDYLHRECGIVHTDLKPENVLIEIGDVEKMLKLAEEEDRAAVETKKTKPGSRTGRRSRRQSLITGSQPLPSPLRSNASFFNDLTMTKMVEEVRLDDDHEKKTSNQLSKSPTSVSPTKPRTALAEELISVKIVDLGNACWVEHHFTNDIQTRQYRSPEVLLGSFWGASSDIWSMSCLVFELLTGDYLFEPQTGSKYSKDDDHIAQIIELLGKIPTSVLQTGKWTSEYFNDKGELKKISKLKDWPLEAVLHEKYNHSKEEAKLLASFLLPMLQMDPQQRADAGGMSNHRYLDDASGLSDIKVDRKCGRSGIDIVGWASEAK

SEQ ID NO: 49617 - protein, 560 aa, Arabidopsis halleri subsp. gemmifera
MASSTASISDTEAWKDLKGHVEDIKKTHLRDLMTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGRVLATHVRKQLHSSRTQGTTLEGFNYSTTTLLIRYLETSSEPQM

SEQ ID NO: 49618 - protein, 560 aa, Arabidopsis halleri subsp. gemmifera
MASSTALISDTEAWKDLKGHVEDIKKTHLRDLVTDANRCQSMMMEFDGLLLDYSRQRATVETVDKLLNLAKAAQLTEKISRMFNGEHINSTENRSVLHVALRAPKDAVIKADGKNVVPEVWNVLDKIKEFSEKIRSGSWVGATGKPLKDVIAIGIGGSFLGPLFVHTALQTDPEALESAKGRQLRFLANIDPVDVARNINGLNPETTLVVVVSKTFTTAETMLNARTLREWITAALGASAVAKHMVAVSTNLALVEKFGIDPNNAFAFWDWVGGRYSVCSAVGVLPLSLQYGFSVVEKFLKGASSIDQHFQSTPIEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATHVRKQLHSSRTQGTTLEGFNYSTTTLLKRYLETSSEPQM

SEQ ID NO: 49619 - protein, 150 aa, Brassica napus
ITVDAKEGITTGVSAKDRAKTVMTLASPYSKPEDFNRPGHIFPLKYRDGGVLKRAGHTEASVDLAVLAGLPPVGVLCEIVDEDGSMARLPKLRLFAEKNNLKIVSIADLIRYRRKRDRLIERASVARIPLRWGNVRAYCYRSVIDGIEHI

SEQ ID NO: 49620 - protein, 239 aa, Treponema denticola ATCC 35405
MDTSQLKERVAYHAIDTLFSEGKIFDGMKIGLGTGSTAMPAVHRLAQLLSSGKLKKIYAVPTSFQTSIECEKLGIPIYSLSSQQIGGSLDLAIDGADEIDPDKNLIKGGGAALLKEKIIAYNSKEFVVIADERKKVKSMGKGFALPIEIIPEARLSITKALEAQGIEVFLREGVKKMGPVVTDNGNFIIDVKWPKAADVDPKALEESLNKITGVVENGFFTKNTPRVFIVHQDGNIEDL

SEQ ID NO: 49621 - protein, 265 aa, Idiomarina baltica OS145
MSQHVEQLFERLWQDYISRTPSAPKVHEVLGKGHPIVNDHVAFRTFDIAPVRLEALAQHFLDLGYKEGGDYHFEAKKLRAKHFEHEDPTLPKVFISELMTEEFSDSLQAKVKEMVSHINPEDVKKDDFLYSGTHWQVSHEDYQALLEESEYAAWMAAFGFCANHFTVSVNQLPGYTDLEEVNQTLKDNGFKLNTSGGEIKGSPEVYLEQSSTMANHHPVEFSDKTVEIPSCFYEFAKRYEIEPGKLYSGFVAASADKIFESTNAS

SEQ ID NO: 49622 - protein, 181 aa, Pseudomonas syringae pv. syringae B728a
MAIRKFQEHTPALGERAFVDHSAVVIGDVEIGADSSVWPLTVVRGDMHRIRIGARTSVQDGSVLHITHAGPFNPDGFPLLIGDEVTIGHKAMLHGCTIGNRILVGMGTTIMDGAVVEDEVIIGAGSLVPPGKVLESGFLYVGRPVKQVRALTEKEIAFFPYSATNYVKLKDQHLAEGFDKG

SEQ ID NO: 49623 - protein, 587 aa, Oryza sativa
MDRTSPALIWHFGTHMVDDLLPVLCCVVIRGATAIGYLSVGPSLIQLQAELAEIFRDVRCETKGQDQNSEADSTDLPCQCRSTVGALAAAWKTSDKNLRSCAILQASLADSFLADLDELSDNEAYPEEENAEAVGTEEIGDDDMPDLESLNYDDLDSVSKLQKTQRYNDIMQKVENALQKGTDFSNQRSILEEDPEYQLIVDCNALSVDIENEIIIIHNFIRDKYRLKFPELESLVHHPIDYARVVQKIGNEMDLTLVDLEGLLPSAIIMVISVTASTTSGKPLSEENLVKTIEACERALTLDAAKKKVLEFVESRMGYIAPNLSAIVGSAVASKLMGTAGGLGALAKMPACNVQLLGAKRKNLAGFSTATSQFRVGYLEQTDVFQSTPPALRTRACRLIAAKSTLAARIDSIRGDPTGKAGRNLLEEIRKKIEKWQEPPPAKLPKPLPVPDFEPKKKRGGDGLGEGYGMLGQAGSGKLRVSTAPSKLSAKITKKFKEKSYGSSGATSGLTSSLAFTPVQVYSAMLLVIAQLRGFYVAILVRLISELICACIGIELSNPQAHGNLLGSGTQSTYFSETGTFSKIKRT

SEQ ID NO: 49624 - protein, 478 aa, Penicillium paxilli
MDAMSTNQDGENYEVKKDAIVTGKETSDEPKGSYRPKKWQSNVTIFSCYVANFSDGFQNSLANPTNVIFKKLLGSAGYSADMKTRISDSLIVGAILGVVVLGYTSDMFSRRSGLLFTSSLVAIGTLMSTVALSVHPSKNMLWYFVIARGIAGFGVGGEYPPSAAAGIEESDTIMRSYRGPLFVSFTTLMATLAGPILQIIYLICLIASDNNLTITFHAIYSIATILPLIIIVLRIFMIDSALFHDSNLTKQRRSLKLYLVLARRYWWRILTTSVAFFLYDFINFPNSIMSSTIIASLVQDSDIRKTAIWQVILAVLPVPGVMIGAWLTNAIGRRNTGILGFAGYMVLGFIIGGTYDKLSKNIAAFVVLYGLLQAFGHMGPGATIGLISSEAFPTAMRGMGYGIATAFGRTGAAVGTECFTPLQTAAGNSSTFYLAGGVAILGILAYCLLPESSKLNLEEEDRALESFLAEKGYTISQK

SEQ ID NO: 49625 - protein, 98 aa, Glycine max
AATHPPFSEEMEAQSCDARPHLKATFRLGSESYSVQANKGSLSEQLVSLKEESMTILKDFITKHNVPHDVPDEPLEASSDDDDIPEKPQGKSKKTKLT

SEQ ID NO: 49626 - protein, 788 aa, Idiomarina baltica OS145
MQENVLWYQQLGMQDVNRVGGKNASLGEMISNLAGAGVEVPGGFATTADAYNEFLEQSGLNDKIYELLDGLDVNDVNKLTEAGRTIRQWIIDTPFQPAFEADIKQAFSQLSEDNDEFSFAVRSSATAEDMPDASFAGQQETFLNVRGLDAVMEAIKHVFASLFNDRAISYRVHQGYDHRGVALSAGVQRMVRSDIASSGVMFTIDTESGFDQVVFVTSSYGLGEMVVQGAVNPDEFYVHKPTLNAGRPAVLRRNLGSKKIQMVFSEDRAHGKQTLIEDIDSAKSQTFSITDAEAEELARQALIIEKHYGRPMDIEWAKDGIDGKLYIVQARPETVQSNQKGQAIERFALQDTSAVVCEGRAIGQRIGKGVARVLDSIEEMDKVQPGDVLVTDMTDPDWEPIMKRAAAIVTNRGGRTCHAAIIARELGIPAVVGCGNATQLISNGQAVTVSCAEGDTGYIYEGELDFEVTESRVDAMPDLPLKIMMNVGNPDRAFDFAGLPHAGVGLARLEFIINRMIGVHPKALLNFDDQPDALKATISTMIAGYESPREYYVARLAEGISTLAAAFAPERVIVRMSDFKSNEYANLVGGSQYEPDEENPMLGFRGASRYISEEFRDCFALECEAIKRVRNEMGLSNIEIMIPFVRTLEEGRQVIDLLEEQGLKQGENGLRVIMMCELPSNALLADKFLDMFDGFSIGSNDLTQLTLGLDRDSGLIAHLFDERNDAVKALLEMAIKAAKARGKYVGICGQGPSDHPDFAQWLVEQGIDSVSLNPDTVIETWMYLSEQL

SEQ ID NO: 49627 - protein, 436 aa, Erythrobacter sp. SD-21
MAKFIFNMPDIGEGIAEAEIVQWHKKVGDRIQEDEEFVDMMTDKATVPMESPVDGKILEIAGEEGDMVSIGSMLVVIEVEGEVPDDVAEEAASPAPAPAPAPAPKAETVEERIEVETSDASDADDAMAADPSPPPAPAPTPAPEPAPSAKVLATPAVRKRAKDLGVDLSQVKPSEEGRVRHGDLDQFLSYNSGYGAAAKTREDEEKKVIGMRRRIAENMAASKRNIPHFSYVEECDVTDLEILRTQLNSNRGDKPKLTILPMLITAICKTLPDFPMINARYDDEAGVVTRHGAVNLGMAAQTDAGLMVPVIKNAQAKNLWQLANEISRLADAARGGTAKKEEMEGGTLTVTSLGPLGGVATTPVINRPEVAIIGPNRIIERPMYVTGSDGVERIEKRKLMNISISCDHRVVDGWDAASFIQALKRLLETPALILVD

SEQ ID NO: 49628 - protein, 534 aa, Saccharomyces cerevisiae
ETHTFNWTTGWDYRNVDGLKSRPVITCNGQFPWPDITVNKGDRVQIYLTNGMNNTNTSMHFHGLFQNGTASMDGVPFLTQCPIAPGSTMLYNFTVDYNVGTYWYHSHTDGQYEDGMKGLFIIKDDSFPYDYDEELSLSLSEWYHDLVTDLTKSFMSVYNPTGAEPIPQNLIVNNTMNLTWEVQPDTTYLLRIVNVGGFVSQYFWIEDHEMTVVEIDGITTEKNVTDMLYITVAQRYTVLVHTKNDTDKNFAIMQKFDDTMLDVIPSDLQLNATSYMVYNKTAALPTQNYVDSIDNFLDDFYLQPYEKEAIYGEPDHVITVDVVMDNLKNGVNYAFFNNITYTAPKVPTLMTVLSSGDQANNSEIYGSNTHTFILEKDEIVEIVLNNQDTGTHPFHLHGHAFQTIQRDRTYDDALGEVPHSFDPDNHPAFPEYPMRRDTLYVRPQSNFVIRFKADNPGVWFFHCHIEWHLLQGLGLVLVEDPFGIQDAHSQQLSENHLEVCQSCSVATEGNAAANTLDLTDLTGENVQHAFIPTG

SEQ ID NO: 49629 - protein, 282 aa, Oryza sativa
  misc_feature (253)..(253): Xaa can be any naturally occurring amino acid
  misc_feature (268)..(268): Xaa can be any naturally occurring amino acid
MAAGSGSGSNPKDYQDPPPAPLVDTGELGKWSLYRAAIAEFTATLLLVCISVSTVIGEKRQSGEGGAGVLGIAWAFGGLIFVLVYCTAGISGGHMNPAVTFAMVLARRVSLPRAALYTMAQCVGAVCGAGLARAMHGGGQYARHGGGANELAAGYSAGAGVVAEMVGTFVLVYTVFSATDPKRKARDSHVPVLAPLPIGLAVLVVHLATIPITGTGINPARSLGPALVLGLGTTKAWSHLWIFWVGPFAGAAXAAMIYHHYILRGACXPRAFASSSYRSPHF

SEQ ID NO: 49630 - protein, 416 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKGQRSCSCK

SEQ ID NO: 49631 - protein, 387 aa, Rhodobacter sphaeroides 2.4.1
MAAASPTDKPTACLALADGTIFYGRGFGARGETVAELVFNTAMTGYQEIMTDPSYAGQIVTFTFPHVGNVGVTPEDDETAEPVAAGMVVKWDPTEPSNWRATSELTQWLEAKGRIGVGGIDTRRLTRAIRQQGAPHVALAHDPEGRFDIGALVAKARGWRGLVGLDLAKDVTCAQSYRWDEMRWAWPEGYRSRSEPGLKVVAIHYGAKPHILRWLASGDCHVTELPATATAEDVLALNPDGVFLSNGPGDPAATGAYAVPMIQGVLARDMPLFGICLGHQMLALALGAKTVKMNHGHHGANHPVKDLETGKVEITSMNHGFTVDSQTLPAGVKETHVSLFDGSNCGIRVEDRPVFSVQYHPEASPGPQDSYYLFDRFAAAMRARRAA

SEQ ID NO: 49632 - protein, 236 aa, Aspergillus oryzae
MSRVKFNVNAEYGYLQNFKVLQNVFARHQVDKPIPVQQLTKCRMQDNLEFLQWTKKYWDQHFPGGDYDAVARRKASGAPPAAAGSRAGAASAGATRRGATPTGAVARPRVAAASGPNVSALQQEIATQKEAIGGLEKERDFYFAKLRDIELLLQSAIEADPELEKDDDSLVKHIQGILYSTECGSETELVTFTKINSTSYRRMLIIHGFPGSHRRLRELCTLQHDRCDELGAETKH

SEQ ID NO: 49633 - protein, 227 aa, Mycobacterium leprae TN
MFAAIRRDIQAARQRDPAQPTVLEVICCYPGVHAVWGHRISHWLWNRRARLAARAFAELTRILTGVDIHPGAVLGAGLFIDHATGVVIGETAEVGDDVTIFHGVTLGGTGRETGKRHPTIGDRVTIGAGAKVLGAIKIGEDSRIGANAVVVKEVPASAVAVGVPGQIISSDSPANGDDSVLPDFVGVSLQSLLTRVAKLEAEDGGSQTYRVIRLPEAGVWHGEDFSI

SEQ ID NO: 49634 - protein, 693 aa, Oryza sativa Indica Group
MGSMDHGLCQMDFQCFLRFAFLFGGVDTHDYDVVKLEEGDEEDWGQEDVGNAAVKVMCRICFSGENEGSTKAAKMLPCKLCNKKYHRSCLKNWGEHRDLFHWSSWVCPSCRSCEVLLDWSLGFDVNLAKTLVCGVTGPTSGSSVCRRPGDPNKLMFCKRCDGAYHCYCQQPSHKNVTHGPYLCPKHTRCHSCGSGVPGSGHSTRWFLGYTCCDACGRLFVKGNYCPVCLKVYRDSEVIPMVCCDVCEKWVHIECDGISEEKYQQFQSDQNLQYTCGACRGECSQIRDTEDAVRELWKRRDVVDHDLMASLRAAAALPSLEDVSPSHPNSDDEKLGAYVMKNDGRNTLKFSFKSNSTKPALDSSEQEKNAIKSSGSNKKHSKKKGNQNNKTVSEQDEIFLEKRNETKSLGSLGDQIADVTRDKSSFKNDADAFVLSSAQSAEKALKLQSAKAAAHNADMIPKVKIKGTKVPSLHFKDVGEENAAKSDTGKERARAGFNTWNASFSVNNSPDSLKPSLLKLKFKRPIFEQPSTQSSQPEEPGTWASPQEELNVAKGQRSKRKRPSLDKMDGSESKAPAAKRHEQSTGEEAMDANWILRKLGKDAIGKRIEVQLASDGKWHQGVVSNVINGTLCLQLDNGRSENIELGKRAIRLIAQSQLPATRVVSRPLQAPAFGLSQSLIHGRLGGLKFTQNSL

SEQ ID NO: 49635 - protein, 313 aa, Synechococcus sp. RS9916
MIAVALSLGLAFIMFTLGITLRPEDFRLAVVQPRALVAGAIAQVLLLPCVAFSLVLLFGLKGELAVGVMILSGCPGGVTSNLFTRLARGDVALSISYTALASVITAVTLPLLLIGSAQVLMPGLDVSISTLGLSLKMIAIATLPVLIGVSLNVRAPGLCRRLRPWCDKGSNVLITLVILAAVLSQWSLLTANLLVLAPLLLVLNLLMLAIGLGVGQLLALPRTQVTTLAIESGFQNGSIGIVVGTLLAGDAVTAQLSTYSLPSAIYGVLMLFTVVPMVLWRRATAVSPASLLEDSLPLRSRSTLPRPALRRLK

SEQ ID NO: 49636 - protein, 328 aa, Salmonella enterica subsp. enterica serovar Typhi str. CT18
MGQLIDGVWHDTWYDTKSSGGKFQRSASAFRNWLTADGAPGPSGEGGFAAEKDRYHLYVSLACPWAHRTLIFRKLKGLEPFIPVSVVNPLMLENGWTFDDTFPAATGDTLYQHEFLYQLYLHADPHYSGRVTVPVLWDKKNHTIVSNESAEIIRMFNSAFDGLGAKAGDYYPPALQSKIDELNGWIYDNVNNGVYKAGFATSQQAYDEAVEKVFTALARLEQILGQHRYLTGNQLTEADIRLWTTLVRFDPVYVTHFKCDKYRISDYLNLYGFLRDIYQIPGIAETVNMDHIRHHYFRSHKTINPTGIISVGPWQDLLEPHGHDVRFG

SEQ ID NO: 49637 - protein, 189 aa, Shewanella sp. ANA-3
MTQSIINSTIKPFKATAYHNGEFVPVTEQDLLGKWSVVFFYPADFTFVCPTELGDMADHYAKLQSMGVEVYSVSTDTHFTHKAWHDTSDTIKKINFPMLADPTGVISRNFGVMIEEEGLALRGTFVINPEGQVKVAEIHDLGIGRSASELVRKIQAAQYVATHDGEVCPAKWQPGDETLAPSLDLVGKI

SEQ ID NO: 49638 - protein, 87 aa, Triticum aestivum
MDSFSSPSMSSSGSSPNPEALMEQIKAQLAQAYAQELLETVGNKCFAKCVTKPGSSLSGSESSCVSRCVDRYIEATGIVGRALFSHR

SEQ ID NO: 49639 - protein, 636 aa, Pseudomonas syringae pv. syringae B728a
MIRLQSLTLQRGPQRLLEDAELTLHAGHKAGLIGANGAGKSSLFALLRGELTPDAGDCLLPADWRIAHMRQEVDTLERLAVDYVLDGDERLREVQSSLAEAEAAQDGAAQARLHSELDSADGYTADARARKLLAGLGFTNEQMERQVGSFSGGWRMRLNLAQALMCPSDLLLLDEPTNHLDLDAILWLEDWLKSYPGTLLLISHDRDFLDAVVDHIAHVEQRRITLYRGGYSAFERARAERLAQQQQAYEKQQAQRAHMEKYIARFKAQATKARQAQSRIKALERMEELSAAHVDSPFNFVFRESDKISSPLLDLSDARLGYGDKTILEKVKLQLTPGARIGLLGPNGAGKSTLIKNLAGELEPQSGRLVRGENLTVGYFAQHQLDSLDAKATPLLHLQRLAPTEREQTLRDFLGGFDFRGARLDEPVLNFSGGEKARLALALIAWEKPNLLLLDEPTNHLDLEMRLALTMALQEFGGAVLVVSHDRHLLKSTTDDFLLVADGRVQAFDGDLDDYTRWLADYRLRNAPVSNTPVNADKTDKKAQRQQAAALRQQLAPHKREADKLERDLGLVNEKLAKVEEALADSTNYEAANKDKLRDLLAEQAKLKVREAELEDAWMQALELLESMQAELEALS

SEQ ID NO: 49640 - protein, 96 aa, Zea mays
MASTNGQTEAPAPSVPKNPAMASCRKKKTDDVTFLEDLKDHMDEFIHASMDEHKTCFKKTIQKMFGMSKAVAERSAVEANKAEVESALPLQTSVSQ

SEQ ID NO: 49641 - protein, 393 aa, Oryza sativa Japonica Group
MDYNPVDSSGTDDDLPPTYQNRGVRGSGRVSGNGRDIVSAVPYNRTKPQTDMETQIHQLEQDAYCSVLRAFKAQSDAISWEKEGLITELRKELRVSDKEHRELLNRVNGDDIIQRIRHFYSREWRETKGGLQADMVNNAQRSHDRVPSPTTSARKRQKTSQSIPSASVPVPSPAVHSQTLTAPMQPLSSATKKVAPPGTKGKKTKPDRYALVYDINTADETWEWVDFKEMAPEDIRWEGGDPGIIQQGRGATVHGGKKSSSRNGPMSGPGRGSRGPQKNTSRKEFPPSQNGVGKKSSDCIEILHTESLIKEVERVFSASNPDPLEMEKAKKVLKEHEQSLIDAIARLAEASDGESEERAQPLQHNRGWRNHHGGNYANDMTIDGHMVGDADAL

SEQ ID NO: 49642 - protein, 300 aa, Saccharophagus degradans 2-40
MQTQDQALEVAKVLTEALPYIQRFTGKTIVVKFGGNAMTDTELQNSFARDIVLMKLVGMNPIVVHGGGPQIGDLLKKLNIESSFVDGMRVTDSATMDVVEMVLGGTVNKQIVSLINRNGGQAIGVTGKDGNLIHAKKLTVNRKSPEVQASEIIDIGHVGEVKTINRSVIDVLVNSDFIPVIAPIGVGDDGASYNINADLVAGKVAEVLQAEKLMLLTNVAGLQDKSGQVLTGLTTGRVDELIADGTIYGGMLPKISCALDAVKCGVKSAHIIDGRVPHAVLLEIFTDSGVGTLITNEYSA

SEQ ID NO: 49643 - protein, 327 aa, Synechococcus sp. RS9916
MAVPPLVVATAREGWRWQWRQLMQGLGPADTEGRYVRPPSDRLEVTVPDAAALDRRSVLQRPRLVIGRSCPWAHRTWLMHRLRQLEGSLELLMATADHRAGRWTLEPTWMDCSTLVELYRHCGTPPNHRATVPALVDPGDHGHCAAELLGNDSAALSEALNRWPGGDGAPDLAPQGTQEAIERWQTLLQPAVNDGVYRCGFARTQKAYDEASDALFAALDQVEAALQQKGPWLCGAQLTIADVRLFPTLIRWELVYAPLFGCSARPLWMFPALWRWRQRFYALPGVAATCDGEAWRRDYFGALFPLNPGGLVPAGPDLNTLISAAPQ

SEQ ID NO: 49644 - protein, 273 aa, Solanum lycopersicum
MARNGSLEEFLGVAVDAAKRAGEIIRKGFHETKHVVHKGQVDLVTETDKACEDLIFNHLKQHFPSHKFIGEETSAATGDFDLTDEPTWIVDPVDGTTNFVHGFPSVCVSIGLTIGKIPTVGVVYDPIIDELFTGINGKGAYLNGKPIKVSSQSELVKSLLGTEVGTTRDNLTVETTTRRINNLLFKVRSLRMCGSCALDLCWVACGRLELFYLIGYGGPWDVAGGAVIVKEAGGVLFDPSGSEFDITSQRVAATNPHLKEAFVEALQLSEYVS

SEQ ID NO: 49645 - protein, 265 aa, Solanum lycopersicum
MEEFVDVAIEAAKKAGEIIRHGFYKSKHIEHKGVVDLVTETDKACEVLIFNHLKQCFPSHKFIGEETTAAASGNFELTDEPTWIVDPLDGTTNFVHGFPFVCVSIGLTIEKKPVVGVVYNPIIDELFTAIYGRGAFLNGKSIRVSSESQLVKALVATEVGTNRDKAIVDATTGRINRVIFKVRSLRMSGSCALNLCGVACGRLDLFYEIEFGGPWDVAAGALIVIEAGGLVLDPSGSEFDLTARRVAATNAHLKDAFINALNESE

SEQ ID NO: 49646 - protein, 407 aa, Glycine max
GNLSGKDDYMEIDGQGSRSETSGYHSDTDLEDDCRETSEPPVPPQRVVNMLQGCRSVDEFERLNKIDEGTYGVVFRAKDKKTGEIVALKKVKMEKEKEGFPLTSLREINILLSFHHPCIVDVKEVVVGSNLDSIFMVMEYMEHDLKGLMEGMKQPFSQSEVKCLMLQLLEGVKYLHDNWVLHRDLKTSNLLLNNRGELKICDFGLARQYGSPLKPYTHLVVTLWYRAPELLLGTKQYSTAIDMWSLGCIMAELLSKEPLFNGKTEFEQLDKIFRILGTPNETIWPGFSELPRVKVNFNVPFRYNLLRKKFPATSFTGSPVLSDSGFDLLNKLLTYDPEKRITAEEALNHEWFREVPLPKSKEFMPTFPAQNAQDRRMRRILKSPDPLAEQHWKEMQQGESGTGGIFG

SEQ ID NO: 49647 - protein, 268 aa, Solanum lycopersicum
MAQNGSVEQFLDVAVEAAKKAGEIIREGFYKTKHVEHKGMVDLVTETDKACEDFIFNHLKQRFPSHKFIGEETTAACGNFELTDEPTWIVDPLDGTTNFVHGFPFVCVSIGLTIEKKPTVGVVYNPIIDELFTGIDGKGAFLNGKPIKVSSQSELVKALLATEAGTNRDKLVVDATTGRINSLLFKVRSLRMCGSCALNLCGVACGRLDLFYELEFGGPWDVAGGAVIVKEAGGFVFDPSGSEFDLTARRVAATNAHLKDAFIKALNE

SEQ ID NO: 49648 - protein, 215 aa, Glycine max
  misc_feature (6)..(6): Xaa can be any naturally occurring amino acid
VVVRGXARLFLAGPPLLKAATGEVATDEELGGAQMHAQVAGTAEYLAQNDADGVRIAREIIAQLPWNDRLPITAARTWAEPLYPIDELLGLIPDDPKKPYDVREIVARLADGSNFLEFKAEFDTQTICGHLQIQGRPCGLIGNNGPITPKGASKAAQFIQLCDQSRTPLVFLHNTTGFMVGTEAEQQGVIKHGAKMIQAVAKGRVPKITLVGGGF

SEQ ID NO: 49649 - protein, 181 aa, Pfiesteria piscicida
MGLAFTKIWQRMVGKTEMRILMVGLDAAGKTTILYKLKLGEVVTTIPTIGFNVETVEYKNLSFTVWDVGGQDKIRPLWRHYYQGTNGLIYVVDSNDRDRIEDAREELNKMLNEDEMRDAVLLVFANKQDLPNAMTAAEVTEKLGLHNLRQRQWFIQSACATTGDGLYEGLDWLSRTLSSKK

SEQ ID NO: 49650 - protein, 338 aa, Haemophilus influenzae R2866
MAILVTGGAGYIGSHTVVELLNAGKEVVVLDNLCNSSPKSLERVKQITGKEAKFYEGDILDRALLQKIFAENEISSVIHFAGLKAVGESVQKPTEYYMNNVAGTLVLIQEMKKAGVWNFVFSSSATVYGDPKIIPITEDCEVGGTTNPYGTSKYMVEQILRDTAKAEPKFSMTILRYFNPVGAHESGLIGEDPNGIPNNLLPYISQVAIGKLAQLSVFGSDYDTHDGTGVRDYIHVVDLAVGHLKALQRHENDAGLHIYNLGTGHGYSVLDMVKAFEKANNITIAYKLVERRSGDIATCYSDPSLAAKELGWVAERGLEKMMQDTWNWQKNNPKGYRD

SEQ ID NO: 49651 - protein, 224 aa, Brassica napus
MSASTMSLTATPSKRTPIVAGDKKSNFDFPPSESLANGEAKDPILAEAVTDRSKGQDLGPVTRRVSSTTNTTSATQRRTRKVSAPKTEKARWKRVARIFAKQLVALLIIVGLIQAARKVLSPSSSSSPTSSFETEMAFSGLESRIAEVDGLVKATTSTMQVQVELLDKKIEKEAKALRQELEAKASAFRNEVKKIESKTESLEKSVEEVKAKPLVSRDEFERVT

SEQ ID NO: 49652 - protein, 356 aa, Mucor circinelloides
MGCCASVEESDSVGKLRNEEIDGQLRMEKLNNKNEVKLLLLGAGESGKSTILKQMKLIHDGGFTPEEKEAYKEIIFSNSVQSIHVLLEAMEILDIPLDDASNQGYFDYIMEQYQKMDYFSMPPELVKAIKQLWQDKGVQEAHSRRNEFQLNDSASYYFDSIDRIGDPNYLPTDQDVLRSRVKTTGIAESKFTFGTLTYRMFDVGGQRSERKKWIHCFEDVTAIIFLVAISEYDQVLIEDESVNRMQEALTLFDSICNSRWFERTSTILFLNKTDLFKQKLPTSPLVDYFPDYKGANDDYEEASNYIMQRFISLNSSAEKQVYTHLTCATDTEQVKFVMAAVNDIVLQTNLRDVGLI

SEQ ID NO: 49653 - protein, 310 aa, Mycobacterium leprae TN
MSIAEDVTQLVGNTPLVRLRRVTEGALADVVAKLESFNPANSVKDRIGVAMIDTAEEAGLIKPDTVILEPTSGNTGIALAMVCAARGYHCVLTMPETMSIERRMLLRAYGAELILTPGADGMSGAIAKAEELAKSDKRYFIPQQFENPANPAIHAATTAEEVWRDTDGKVDIFVSGIGTGGTITGVARIIKERRPATQFVAVEPAASPVLSGGQKGPHPIQGIGAGFVPSVLVLDLVDEIVTVGNEEALDLARRLAKEEGLLVGISAGAAVCAALHVARRPENTGKLIVVVLPDFGERYLSTMLFADLAN

SEQ ID NO: 49654 - protein, 181 aa, Pfiesteria piscicida
MGAALSHVWSRLVSTQEQRLLMLGLDAAGKTTILYKLKLGEVVTTIPTVGFNVETLEYKNLRFTVWDIGGQDKIRRLWRHYFLGTSGLIFVVDSNDRERVDVAREELQHMLREDEMRDVAVLVFANKQDLPNSMTTPEVAEKLGLQELRRQQWFIQAACAATGEGLYEGLDWLSRTLSKRR

SEQ ID NO: 49655 - protein, 411 aa, Mycobacterium leprae TN
MVDVFDIQAVRADFPILQETVNGKPLIWFDNAATTQKPQVVIDRLSYFYAHENSNIHRAAHELAARATDAYEEARETARRFIGAAKAQEIIFVRGTTEAINLVAYAWGGKHLQPGDEVVITHLEHHANIVPWQLLSSQTGAILKVAPVDDAGNLLMSEFEDLLGPRTKLVAATQVSNALGTVTQGEKIVELGHRYGARVLIDGAQSIPHLPINVSELGADFFVFSGHKIYGPTGIGVLYGCEDVLTEMPPWQGGGNMIVDVTLERSLYQGPPNKFEAGTGNIADAVGLGEALRYVERVGVQRIASHEQALLDYATPRLADIPGVRLVGTATEKASVLSFVLAGHEPLEVGKALNAEGIAVRAGHHCAQPVLRRLGLEATVRPSFAFYNTYEEIDVFINVVRRIAEGGTNIG

SEQ ID NO: 49656 - protein, 181 aa, Pfiesteria piscicida
MGLSLSTVWSRLVGKQEQRLLMLGLDAAGKTTILYKLKLGEVVTTIPTVGFNVETLEYKNLCFTVWDIGGQDKIRRLWRHYYQGTHGLIYVVDSNDRERVDVAREELQHMLREEEMQDAAVLVFANKQDLPNSMTAAEVAEKLGLQELRRQQWFIQAACAATGEGLYEGLDWLSRTLSKRR

SEQ ID NO: 49657 - protein, 452 aa, Agrobacterium tumefaciens str. C58
MYDIENAKKFFADNPDIEILEAFVIDANGVPRGKWIPRERAIDVLEKGMAIPRSVYALDIWGRDVHAAGLAEGTGDPDGFCFPVPGTLSRVTWLGRPTAQVLLAMKNADGTGFYGDPRHVLSQVLNAYKKAGLTPVVATELEFYLIDPVRSALDPVRPPHSREGRWHTGQTQVLSISELQDFEDVFHDIATACRAQGVLADTTLRENGPGQYEINLNHVPDALQAADFAVFLKRIVKGVARRHELDATFMAKPYGLQAGNGMHVHFSVLDRDGRNIYAGENGPSDALMHSVGGLLENMGESMAIFAPHANSYRRLTPSEHAPTYASWGIDNRSAAVRVIVASKAATRIEHRVAGADTNPYLVLAMILSAAIAGMKEKRQPGGAIAGDSHAINHEPLPTNWDYALQRFTRSSFAYATLGQKYRTLFSACKQQELSEFSLRVTDVEYDAYIRTV

SEQ ID NO: 49658 - protein, 504 aa, Triticum aestivum
  misc_feature (252)..(252): Xaa can be any naturally occurring amino acid
MALAILARRRAAEAVARRAHAPGAAALSAWRAYAAAAEESDVVVVGGGPGGYVAAIKAAQLGLKTTCIEKRGTLGGTCLNVGCIPSKALLHSSHMYHEAKTSFAHHGVKISNLEVDLPAMMAQKDKAVAGLTKGIEGLFKKNKVTYVKGFGKLTSPSEVSVDLVDGGNTVVKGKNIIIATGSDVKSLPGITIDEKKIVSSTGALCLSGIPKKMVVIGAGYIGLEMGSVWNRLGTEVTVVEFAPDIVPSMDGXEIRKQFQRMLQKQKMKFMLKTKVVGVDTSGDGVKLTLEPAAGGEQSILEADIVLVSAGRTPYTAGLGLDAIGVEMDKAGRILVDKRFMTNVSGVYAIGDAIPGPMLAHKAEEDGVACVEFLAGKEGHVDYDLVPGVVYTHPEVASVGKTEEQVKASGIAYRVGKFPLMANSRAKAIDDAEGMVKVVADKETDKILGVHIMAQNAGEIIHEAVLALQYGASSEDVARICHAHPTVSEALKEACLQTHSKAIHI

SEQ ID NO: 49659 - protein, 339 aa, Triticum aestivum
EPLRTVQLDGLVVLKIIKHCRESYPNDVTGQLLGLDDKSVLEVTNCFPFPSDGDEDTSAQYQLDMMRCLRAVNVDNNTVGWYRSAHLGNFVDLSLIETQYSYQNSLSAQSVVLIHDVSKSAAQGNLSIRAFRLTDAFMKAYETKKFTTESLAQAKLSFSNIFEELPVQIHNSYYVTMMLHNIEMPKLNADRLGYLSTFTSTKKTQIELEEARPLAPNFDVLDLELDPFMQKNLQYLLDCTELQQQEQYSHQYWKKAVAREQAKMQSWLTARKQENAERAEKGQEPLPEDEVNTLFKLPPEPSRLDSMILNAQMHNFTKQLNQFAGPSLTRLYSIQELQK

SEQ ID NO: 49660 - protein, 461 aa, Polaromonas sp. JS666
MPSNTSSLIDLDRAHLIHPVAPWRKHEQRGVTVLESGHGAWLKDAAGNELLDAFAGLWCVNVGYGQESVVQAATEQMRKLPYATGYFHFGSEPAIQLAAKLVEIAPPSLKHVYLTLGGSEAIDAAVRLIVHYYNATGRPGKKQFISLERGYHGSSSTGAGLTALPVFHRGFDLPRPEQHYIASPYLYRSPEGSTAQSVIDASVQSLRAKVASLGADNVAAFFCEPIQGSGGVIVPPTGWLKAMRQACTELGILFVVDEVITGFGRTGPMFACQAEGVEPDLMTMAKGLTSGYAPMGALMMSGAVYAGIADGAAPGVPIGHGATYSAHPVSAAIALEVIRIYQEGGMLAHAQKVAPHFAQGLDALTAHPLVGEARHRGLLGALELVSNKTTKAGFDPALGLSDLLFETGYRNGLVFRSFGDNILGFAPALCYTEGEFSQLFERLEKTLDEVLAVPDVRRALG

SEQ ID NO: 49661 - protein, 175 aa, Triticum aestivum
MAPTVMASSATSVAPFQGLKSTAGLPVSRRSNGASLGSVSNGGRIRCMQVWPIEGIKKFESLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 49662 - protein, 780 aa, Saccharomyces cerevisiae YJM789
MAPKSSSSGSKKKSSASSNSADAKASKFKLPAEFITRPHTSKDHGKETCTAYIHPNVLSSLEINPGSFCTVGKIGENGILVIARAGDEEVHPVNVITLSTTIRSVGNLILGDRLELKKAQVQPPYATKVTVGSLQGYNILECMEEKVIQKLLDDSGVIMPGMIFQNLKTKAGDESIDVVITDASDDSLPDVSQLDLNMDDMYGGLDNLFYLSPPFIFRKGSTHITFSKETQANRKYNLPEPLSYAAVGGLDKEIESLKSAIEIPLHQPTLFSSFGVSPPRGILLHGPPGTGKTMLLRVVANTSNAHVLTINGPSIVSKYLGETEAALRDIFNEARKYQPSIIFIDEIDSIAPNRANDDSGEVESRVVATLLTLMDGMGAAGKVVVIAATNRPNSVDPALRRPGRFDQEVEIGIPDVDARFDILTKQFSRMSSDRHVLDSEAIKYIASKTHGYVGADLTALCRESVMKTIQRGLGTDANIDKFSLKVTLKDVESAMVDIRPSAMREIFLEMPKVYWSDIGGQEELKTKMKEMIQLPLEASETFARLGISAPKGVLLYGPPGCSKTLTAKALATESGINFLAVKGPEIFNKYVGESERAIREIFRKARSAAPSIIFFDEIDALSPDRDGSSTSAANHVLTSLLNEIDGVEELKGVVIVAATNRPDEIDAALLRPGRLDRHIYVGPPDVNARLEILKKCTKKFNTEESGVDLHELADRTEGYSGAEVVLLCQEAGLAAIMEDLDVAKVELRHFEKAFKGIARGITPEMLSYYEEFALRSGSSS

SEQ ID NO: 49663 - protein, 299 aa, Triticum aestivum
  misc_feature (20)..(20): Xaa can be any naturally occurring amino acid
  misc_feature (72)..(72): Xaa can be any naturally occurring amino acid
  misc_feature (98)..(98): Xaa can be any naturally occurring amino acid
SITKEPGLVPLLNPHHSPGXGGTTWPLPLNGGSSGRPPIPGGFRQSPCTGGFRLRSVAPGVWVRLPGPLHGXGNGRPPSHGGSWFVPDPSHSGGYGSXPDAPSHGEGAYGSSPTPSTAGAYGSSPTPSHDGGPYGSSPTPAHDGGSYSGTPAAPSHSSHGSVTPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAAAGGVDSAAAAQAASFKKANGGGRRRSTGSPWRGL

SEQ ID NO: 49664 - protein, 456 aa, Oryza sativa Japonica Group
MPTITHYVLDPLLETGSATQSQKAASKPPPAPPLPQEKAAEKPIPVPVAPVRRAQTASATLYATPESTSLPDSPSSFPGTWSPYLINHKRRGPCLVKTLSQGDVGSDGSQQPTLSVTLPPLPKRSQSFEAQEPEFEFQQASNGVLEGDSGVVETLDWQNGMLQKGKGTVSGEYGHDQAEFEFQHGNPDATVRPVNVGRPANGGTPRKINNDAFFELQDSLSMASNSEAEDAGGHERWWKPSSPLGTSVGTPGAEFYDAFEEISSDGATRSSQCMDDDLREMRLSLLMEIERRKQAEEALENWQKEWKKLSDHLSLIALTLPPPSLAEDTDDSSMDPGAELCQQITVSQLVAAAIARGFARAEVETDMETKIAAKNFEIARLSDRVQYYEAANREMSQRNQEAIEMSRQQRNIRKKRQKWFWGSVGLAVTLGTAAIAWSYLPAAQPQASQDSNTNSD

SEQ ID NO: 49665 - protein, 642 aa, Synechococcus sp. RS9916
MSLISLVDAEKDFGIRTLFADLTLHIGSNDRLGLIGPNGAGKSTLLKVLAGQEPLGGGERRCSPRLRVELVGQESVVQPGLTVLEQVLAGCGEKRELLLRFSALTEAVAQSPDDTTLLTELGHLSQRMDEAEAWGLEQQCQEVLQRLGISDLHKPVEDLSGGYRKRVGLASALVACPDVLLLDEPTNHLDAAAVEWLQSWLDRYPGAVVLVTHDRYVLDRVTRRIVEVADGEARSYDGNYSTYLQGKAQQDVADAAAAAKFKSVLRRELAWLRQGPKARSTKQKARLQRIEAMRSAPPKKAKAKLEMASVSRRIGKVAIEAEHLKVTSDGTTEGTVLLDDFTYSFSPEDRIGIIGPNGSGKSTLLDLIAGRRTPSGGELRLGDTVHLGYLDQHTDALTSGRGLERKVIEFVEEAASRIDLGGEQLTASQLLERFLFPPAQQHSPISKLSGGERRRLTLCRLLIQAPNVLLLDEPTNDLDVQTLSVLEDLLEDFRGCVVVVSHDRYFLDRTVDRLFNFENGCLNRFEGNYSEFLAHRRELEKAEELKRSAEKAGKTRSSSTAESTPQTNAVASKPRRRSFKESKELKELDRQLPELETRKAELEAALSAGSSNLSDLSQELASLLDTLAAAEERWLELSELAP

SEQ ID NO: 49666 - protein, 319 aa, Triticum aestivum
  misc_feature (269)..(269): Xaa can be any naturally occurring amino acid
MATREAKATKEAKVVPAGDADADGEELVPALASLEPVYGAGPALDEARLRFARLADRFRALYSAGPALFARSPGRVNLIGEHIDYEGYSVLPMAIRQDMIVAIRRADAGLVRVANVDDKYATCVYPADPDKEIDIKNHKWGHYFMCGYKGVYEYARSKGIHMGEPVALDVVVDGTHPQRSGLSLSAEYVWSVTLAIMGVLGMESPLRDVDRSTCHSDRRIGTRPAGMDQAISIMANAGYAESRDFSPVKEPDVQVPSGGRFAIARCLGXSRNQTSCSNYNNRFLKCGLSPMFSHQTRDAPKRPSVFHTPSVLRAILPLV

SEQ ID NO: 49667 - protein, 400 aa, Silicibacter pomeroyi DSS-3
MSFLSATLSRVKPSPTVAMTAKAAELKAGGRDIIGLSAGEPDFDTPQNIKDAATAAIAAGKTKYTAPDGIIELKQAVCAKMQRDHGLSYTPAQVSVGSGGKQTLYNALMATLNPGDEVIIPAPYWVSYPDMVLLGGGTPVVVETALESAFKLTPAQLEAAITPRTKWFIFNSPSNPTGAGYSRDELKGLTDVLMRHPHVWVMSDDMYEHLAYDGFAFCTPAQVEPGLYERTLTCNGTSKAYAMTGWRIGYAAGPVGLIAAMRKIQSQSTSNPCTISQWAAVEALNGTQEFLAPNNALFKRRRDLVLSMLNAIEGIDCPTPEGAFYVYPSIAGLIGKTTPKGTRIDSDETFCTALLEEADVAVVFGAAFGLSPNFRVSYAASDAALTEACTRIQRFCASLT

SEQ ID NO: 49668 - protein, 235 aa, Brassica rapa
MSSQICRSASKAARSLLSSAKNARFFSEGRAIGAAAAVTASGKMPLYASNFARSSGSSKSWITGLLALPAAAFMVQDQKVFAAEMERTFIAIKPDGVQRGLISEIISRFERKGFKLVGIKVVVPSKDFAQKHYHDLKERPFFNGLCDFLSSGPVIAMVWEGEGVIRYGRKLIGATDPQKFEPGTIRGDLAVVVGRNIIHGSDGPETAKDEINLWFKPQELVSYTNNAEKWIYGDN

SEQ ID NO: 49669 - protein, 587 aa, Emericella nidulans
MRVSVPLHSIRRSCNSSIANAATRLTPQRLYLSYGRRSSIVQAHLGTQARPIASYTHPHHASAISVLSTAVDTSSPDFRENERQMQEVLNRMNSLHSTISQGGPQKAKDKHVARGKMLPRDRVSALIDPGTSFLELSQLAGHEVYPGEDVPAGGIITGIGTVEGVTCMIVANDSTVKGGTYYPVTVKKHLRAQAIAQENKLPCIYLVDSGGANLPHQADVFPDKEHFGRIFFNQARMSSQGIPQISVVMGPCTAGGAYVPAMSDETIIVENQGTIFLAGPPLVKAATGEVVSAEDLGGGQLHSTISGVTDYLAVDDAHAIVLARRSISNLNYPKAKQPLESNDDIKEPLYDPAELNGIVGTNLRRQIPVHEVIARIVDGSEFAEFKRDYGTTLVTGFARIHGHRVGIVANNGILFSESSLKGAHFIELCAQRNIPLVFLQNISGFMVGADAEKGGIAKNGAKLVTAVACADVPKFTVVFGSSAGAGNYGMCGRAYSPRFLFMWPNAKIGVMGSELSSVMEAVGRTADPELKARIDRESEATFSSARLWDDGIIPPAHTRHVLGLSLAAALGGKSDKDVQTKFGVFRM

SEQ ID NO: 49670 - protein, 332 aa, Solanum tuberosum
  misc_feature (292)..(292): Xaa can be any naturally occurring amino acid
MSHHYQEQEEQKIPFLLDSLYCEEDILTEVSVETESFSAHDLLWEEEELTSLFSKETEYKISCNVLEKDQSFISARRESVEWILKTTAYYSFSAQTAFLAVNYFDRFLLFSFNQSLKHKPWMIQLAAVTCPSLAAKVEETDVPLLLDLQVEESRFVFESKTIQRMEMLVLSTLKWKMNPVTPFSFLDFITRRLGLKYCLSLEFLRRCEKVLLYTITDGRFIGYLPSAMASATMLHVLDRLKPCIGEKYQDQLLGILGIVKDKVEECYRLIQEVACNIDFDSNKRKFGTLPGXPTGVMDVSFSSDYSNDSWSVATSVTSSPEPLSKKIRESNE

SEQ ID NO: 49671 - protein, 531 aa, Pleurotus eryngii
MFPGARILATLTLALHLLHGTHAAIGPIADMYIVNEDVSPDGFARSAVVARSVPATDPTPASVSVPGVLVQGNKGDNFQLNVRNQLSDSTMLKTTSIHWHGFFQSGSTWADGPAFVNQCPIASGNSFLYDFNVPDQAGTFWYHSHLSTQYCDGLRGPFVVYDPSDPHLSLYDVDNADTVITLEDWYHVAAPQGAVLPTPDSTLINGKGRFAGGPTSPLAIINVESNKRYRFRLISMSCDPNFTFSIDGHSLQVIEADAVNIVPLVVDSIQIFAGQRYSFVLNANQAVDNYWIRANPNLGSTGFEGGINSAILRYAGATENDPATTSSTSTPLLETNLVPLENPGAPGPAVPGGADININLAMGFDFTNFEMTINGSPFKAPTAPVLLQILSGATPAASLLPSGSIYALEANKVVEISIPALAVGGPHPFHLHGHTFDVIRSAGSTTYNFDTPARRDVVNTGIDANDNVTIRFVTDNPGPWFLHCHIDWHLEIGLAVVFAEDVASIKAPPAAWDDLCPIYDALSDSDRGGIA

SEQ ID NO: 49672 - protein, 568 aa, Arabidopsis thaliana
MFKILTTKIQSFFCLNISGGTEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 49673 - protein, 533 aa, Pleurotus eryngii
MAVAFIALVSLTLALVRVEASIGPRGTLNIANEVIKPDGFSRSAVLAGGSYPGPLIKGETGDRFQINVVNKLADTSMPVDTSIHWHGIFVRGHNWADGPAMVTQCPIVPGHSFLYDFEIPDQAGTFWYHSHLGTQYCDGLRGPFVVYSKNDPHKRLYDVDDESTVLTVGDWYHAPSLSLSGVPHPDSTLFNGLGRSLNGPASPLYVMNVVKGKRYRIRLINTSCDSNYQFSIDGHAFTVIEADGENTQPLQVDQVQIFAGQRYSLVLNANQAVGNYWIRANPNSGDPGFANQMNSAILRYKGARNVDPTTPERNATNPLREYNLRPLIKEPAPGKPFPGGADHNINLNFAFDPATVLFTANNYTFVPPTVPVLLQILSGTRDAHDLAPAGSIYDIKLGDVVEVTMPALVFAGPHPMHLHGHSFAVVRSAGSSTYNYENPVRRDVVSIGDDPTDNVTIRFVADNAGPWFLHCHIDWHLDLGFAVVFAEGVNQTAVANPVPEAWNDLCPIYNSSNPSKLLMGTNAIGRLHAPLKA

SEQ ID NO: 49674 - protein, 309 aa, Schizosaccharomyces pombe 972h-
MSFQDRTAEFQACVTKTRSRLRTTTANQAVGGPDQTKHQKSEFTRIAQKIANQINQTGEKLQKLSQLAKRKTLFDDRPVEIQELTFQIKQSLSSLNSDIASLQQVVKGNRNKPAQMNQHSENVVVSLQNSLANTSMTFKDILEIRTQNMKASQNRTEKFVASSSMNANPLINSGNSISPFADYNDPKPEANEDYLSLNLGDGANTRYEQMALLESQTDTYSQQRMSSIQNIESTITELGGIFSQLAQMVSEQRETVQRIDMHTDDIVSNIGSAQREIVKFYERMSSNRALLFKIFGIVIIFFLLWVLVT

SEQ ID NO: 49675 - protein, 486 aa, Arabidopsis thaliana
MAKVDWCNERRKFWKITLFLSIAVMAISLLVFCKRGKPNNMEDSTEYAIIFTAKYLIIQYAVFGASIKVEEMWGWMPSSSSPPPEECSPAERAWSELAFVVFICVMTLGLGKVVEVFFFTMSSIIGLIAISHLFYPTPDHKFEMVMKHFWFIVGLGIIFTKMHFDKAEKQFLVLILRLYTVCSMSLDLRGLHDNIDPSIEVKGELSLIDPHCSSRKTFVSKVFHCNGLLLCTTMTGLVVWNPCTDQTRWIKTEVPHNRNDKYALGYGNYKSCYNYKIMKFLDLESFDLEIYEVNSNSWRVLGTVTPDFTIPLDAEGVSLRGNSYWIASHKREEIEEEEEEENEYFINDFLISFDFTTERFGPRVSLPFKCESSWDTISLSCVREERLSLFFQDDGTLKMEIWMTNNITETKTTTMSWSPFLKIDLYTYGHRFGNEVSFLVDEENKVIVCCDEEEDDINDTVYIIGENEYWRKEDIVQRSYRPHIPS

SEQ ID NO: 49676 - protein, 150 aa, Arabidopsis thaliana
MGTKLFLSFLNGIHGTLSFIFSEDTKVLSAQYGPKARTKKNENAEKACLKSYGSLKPDRLVIVNAFSFSERGLFCRLRKVEKEYETILKRTLQSICVLRVVPNTTTSVIIQVVHDGGSVSFLCSFHLGKHLLMLSETHIIRYKQCLFEYL

SEQ ID NO: 49677 - protein, 424 aa, Mycobacterium leprae TN
MCRTTLPGGLRVVTEHLPAVRSASVGVWVGVGSRDEGATVAGAAHFLEHLLFKSTSTRTAMDIAQAIDAVGGELNAFTAKEHTCYYAHVLDSDLELAVDLVADVVLNGRCAVDDVELERDVVLEEIAMRDDDPEDALGDMFLAALFGDHPVGRPVIGTMESVSAMTRTQLHSFHVRRYTPERMVVAVAGNVDHDEMVALVREHFGSRLIRGRQSAPPRKSTGRINGGPALTLGKRDAEQTHVLLGVRTPGRSWEHRWALSVLHTALGGGLSSRLFQEIRETRGLAYSVYSALDIFADSGALSVYAACLPGRFADVMQVISEVLASVAGDGITEAECRIAKGSLRGGIILGLEDSNSWMSRLGRSELNYGKYRGIEHTLQQIDEVTVEQVNALAHQLLNKRYGAAVLGPYASKKTLPRQLRIMVN

SEQ ID NO: 49678 - protein, 184 aa, Aspergillus oryzae
MGGQVSKLMGKIFGTKEMRILMLGLDAAGKTTILYKLKLTNQEVTTIPTVGFNVESVTYKNVKFNVWDVGGQDKIRPLWRHYYSGTQGLIFVVDSSDTARMEEARSELHKIINDREMKDALLLVFANKQDIQGHMSPEDVTNALQLNKLKDKLWYVAPSVATEGTGIFEGLAWLSNNVKTPAQK

SEQ ID NO: 49679 - protein, 530 aa, Mycobacterium leprae TN
MACSVQMPALGESVTEGTVTRWLKQEGDTVELDEPLVEVSTDKVDTEIPSPAAGVLTKIIAQEDDTVEVGGELAVIGAPSEAAAAAPAPRPEPKAQPEPAASSQPAAPAQQPSGAATATPVLMPELGESVTEGTVTRWLKKIGDSVQADEPLVEVSTDKVDTEIPSPVAGVLVSITTNEDTTVPVGGELARIGVTLDSIATPAPAPRAESVPSRPTPARKEANGAPYVTPLVRKLATENNIDLAKVIGTGVGGRIRKQDVLAAAEQRKQQQAPTSAPSAAAPTPTPVLAHLRGTTQKVSRIRQITAKKTRESLQATAQLTQTHEVDMAKIVGLRAKAKAAFAEREGVNLTFLPFIAKAAIDALKIHPNINASYNEDTKEITYYDAEHLGFAIDTDKGLLSPVIHYAGDLSLAGLARAIVDIAARARSGNLKPEELSGGTFTITNIGSQGALFDTPILVPPQAAMLGIGAIVKRPRVVIDASGNESIGVRAICYLPLTYDHRLIDGADAGRFLTTIKHRLEEGAFEADLGL

SEQ ID NO: 49680 - protein, 216 aa, Triticum aestivum
NKFVQKSRLVPVRNSRDIVDPRVRPSSSSSSSTPQEAAAEPPVPDRGLNRRIAVLTTLAAVGLFGSQRLQLGGFSLKDLAANAVPYEEALSNGKPTVVEFYADWCEVCRELAPDIYKIEQQYKDRINFVMLNVDNTKWEQELDEFGVEGIPHFAFLDKEGNEEGNVVGKLPRQYFLDNVVALSSGDPTIPHARAVGQYSSAEFRKVHQVADPRSHG

SEQ ID NO: 49681 - protein, 518 aa, Agrobacterium tumefaciens str. C58
MLCTNSSAMLHPSKNRGGLPMKEIGHFINGKHVPGASGRTSNVYNPATGEVQATVALASDAELRAAVESAKAAQPKWAATNPQRRARVFFKFVELLNRDLNELAVLLSSEHGKTVEDSKGDIIRGLEVCEFVCGIPHLQKGEFTEGAGPAIDMYSIRQPVGIGAGITPFNFPGMIPMWMFAPAIACGNAFILKPSERDPSLPIRLAELMIEAGLPAGMLNVVNGDKGAVDAILTDPDIGAVSFVGSTPIARYVYGTAAMNGKRAQCFGGAKNHMIIMPDADLDQAVNALMGAGYGSAGERCMAVSVAVPVGEDTANRLVEKLIPQIESLRIGPYTDDKADMGPLVTKEAQTRVRGLIDSGVEQGAKLLVDGRDFKLQGYEDGYFVGGCLFDHVTPDMDIYKTEIFGPVLSVVRAKNYEDALELPMKHEYGNGVAIYTRDGDAARDFASRINIGMIGINVPIPVPLAYHSFGGWKASSFGDLNQHGTDSIKFWTKTKTITSRWPSGIKSGAEFVMPTMK

SEQ ID NO: 49682 - protein, 237 aa, Triticum aestivum
  misc_feature (179)..(179): Xaa can be any naturally occurring amino acid
  misc_feature (191)..(191): Xaa can be any naturally occurring amino acid
  misc_feature (208)..(208): Xaa can be any naturally occurring amino acid
  misc_feature (215)..(215): Xaa can be any naturally occurring amino acid
  misc_feature (230)..(230): Xaa can be any naturally occurring amino acid
NKFVQKSRLVPVRNSRDIVDPRVRKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETXDTFIADLAVGLXTGQIKTGAPCRSERLAXHQLLEIXEDLGPAAVYAGLQFXRAPGEPY

SEQ ID NO: 49683 - protein, 492 aa, Polaromonas sp. JS666
MPLTLSQTDLLRQQNFINHQWQDAQSGARLPVSDPATGLDFAHVPDSGAADALAAVDAAHAVFPAWRARSARERAQFLKRWHALILANQHDLGRLISREQGKPLAEGVGEVAYAASYVEWFAEEATRTYGDMIPEPARGRKLMVVKEPVGVVAAITPWNFPAAMIARKIAPALAAGCTVVAKPAEDTPLTSLALVLLAQQAGLPPGVLNMVTASREKTPEVVDVWLADARVRKITFTGSTPVGKHLARESAGTLKKLSLELGGNAPFIVFDDADIDAAVNGLMVAKFRNGGQTCVCPNRVFVQDAVHDAFVEKLRARVGALKVGPASAPDSQIGPMINARAVEKIERHVADAVAKGARIAVGGQRMEGAAYASPNYYAPTVLTGAHSGMACSLEETFGPVVPVTRFGSEAEVIAAANDTPFGLAAYFYSSNIARVWRMADALESGIVGINEGALAAEVAPFGGVKESGYGREGSRYGLEDYMHTKYLCQGLV

SEQ ID NO: 49684 - protein, 293 aa, Oryza sativa Japonica Group
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGVGAAWRLAKVQPGSSVVVFGLGSVGLAVVQGAKMCGATKIIGVDLNPNKEEVGKEFGVTDFVNPSQLGDKSVSEVINAMTDGGADYSFECIGISSVMTEAVRSTKSVLISPH

SEQ ID NO: 49685 - protein, 315 aa, Salmonella enterica subsp. enterica serovar Typhi str. CT18
MNITIATLSELLVEFLAKKENQGFSSPGEFWGPYPSGAPAIFADQVAKLGFRSLLFSCVGNDAFGVMNITRLSRDGVNVQGISVLPNATTGSAFVSYRSQAQRDFIFNMPDSACGLLSADHLDETLLRQYRHFHIMGSSLFSFRLIDAVRKAISIVKENGGTISFDPNIRKEMLKIREMSQAFEYILDYTDFFLPSDGELDYFGLSKSRDEEKIVARLHKRGIAHVIIKRGARGASYYSKDEQHHVAGYPVKVVDPTGAGDCFGATFVSLFLAGYSVPDALAHANAAGSLAISARGPMEGTSTLAQIKELMRQQN

SEQ ID NO: 49686 - protein, 241 aa, Oryza sativa Japonica Group
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGVGAAWRLAKVQPGSSVVVFGLGSVGLAVVQGAKMCGATKIIGVDLNPNKEEVGKKRVRCD

SEQ ID NO: 49687 - protein, 791 aa, Vibrio campbellii AND4
MQKNTLWFNGLSMDDVDKVGGKNASLGEMVSNLANVGVSVPNGFATTSHAFNQFLDHEGLDERIHQLLDELDVEDVEALRETGAKIRQWVLEAPFPVDLEQDIRDNYKELTDNHPEISVAVRSSATAEDLPDASFAGQQETYLNVKGIDAVLEATRHVYASLFNDRAISYRVHQGFDHRGISLSAGIQRMVRSDKASSGVMFTLDTESGFDQVVFITSSWGLGEMVVQGAVNPDEFYVHKPMLEAGQHPIVKKTFGSKQIKMIYSNSQEIGKQVEIINTSVEERHAFSLNDEEIKELAKQAMVIEKHYQRPMDIEWAKDGIDGKLYIVQARPETVCSQNEQNVIERYELNNKADVLVEGRAIGQRIGKGPVRLVDSLDQMSLVQEGDVLVTDMTDPDWEPVMKKASAIVTNRGGRTCHAAIIARELGIPAIVGCGDATRKLTNDETVTVSCAEGETGYVYQGELEFEIKRSAVDELPMLPTKVMMNVGNPDRAFDFAQIPNEGVGLARLEFIINKMIGIHPKALLNFDAQSDELKAEINERIRGYNDPIDFYVSKLTEGIATIASAFWPKRVIVRMSDFKSNEYSNLVGGKGYEPHEENPMLGFRGASRYISPVFEDCFELETQAIKRVRNKMGLKNVEIMIPFVRTPSEAASVIDLLAKFDLRRGDQGLKVIMMCELPSNAVLAEEFLKYFDGFSIGSNDMTQLTLGLDRDSGDVAHLFDERNPAVKAMLQMAIDAATKAGKYVGICGQGPSDHDDLAEWLMEQGISSVSLNPDTVIDTWLKLGNVSKPL

SEQ ID NO: 49688 - protein, 458 aa, Treponema denticola ATCC 35405
MEAKKEKRNLNLFNIFSLGFGGAVGSGIFVLTGLGIAATGKSIVVSIMAGCIFMLLAYFYNVLLSSMFMFEGGDYSQKALVFNPFFTGINGYITFINGFSVAMYSLAMVNYAGIVFPQILPYTKLIAIIIITLFFAATIRGSKFVSTINNIMTVVLILAIIFYIVFGVPKVKPGYFTDPNFFTDGFKGIIAGIAIMGWACQGTTMGPVSVSAVTIKPKKNIPYGIFLVTIAIAIVYGLMGYVSAGVLPISEVAGQNLSLVAAEIFPRSIFILFIMGGAVFAIATSMITGIIMVRYPILKVAQAGWLPKFFTQTTQTGYPWAVYGIYYILSILPVLLGLKLDAIVSLVMIPAMLTNLYTNIKCIKVIRDYPEQWKKSVLHMPRILMDIICILSALCAAIVCYNLFMMLSTKEKLLMIGIMVIISILSIYNLKSKHVKIEELEANKRQIIEDALLAETEE

SEQ ID NO: 49689 - protein, 197 aa, Treponema denticola ATCC 35405
MSTLVPYVIEQTGNGERSYDIFSRLLKDRIIFVDGEINDMSADLVVAQLLFLEAQNPDKDISLYINSPGGSVTAGLAIYDTMQHIRPDVQTICLGQCASMGAVLLAGGAKNKRYALPSSRVMIHQPWGGVQGQAVDINIQAKEIVRLKKLTIKYFAENTGKTEKQVAADMERDFFMSAEEALTYGIIDTVMNRRKDG

SEQ ID NO: 49690 - protein, 559 aa, Synechococcus sp. RS9916
MGTRERPQLIHGWDLRHWRGDLLGGLTAAVVALPLALAFGNAALGPGGAIYGLYGAIVTGFLAALLGGTPAQVSGPTGPMSVTVAGVVSSLMAVGVASRLSGGELLPLVMAAVVLGGLFQILFGLLKLGRYITLVPYSVVSGFMSGIGIIILLIQAGPLLGIPASGGVINSLAMVFQQFRPNPGALAVGLMTLAVVFLTPKRISQVLPAPLLALLLITPLSVLLFNDQRLEALGWEALPRIGSIPEGGLQLIQPNWGQHLPLLLRAGVVLALLGSIDSLLTSLVADNISQSRHDSNRELMGQGAANAVAGLMGGLPGAGATMRTVINIKSGGRTPLAGMTHSLVLLLLLLGAAPLAESIPTALLAGILIKVGLDIIDWGFLHRAHRLSLKTALVMWGVLLLTVFWDLIGAVLIGMFVANLLTIESLTTHQLAGMGRPERDAFTAHEQQLLDQCGDDVMLFSLQGPLSFGAATGISERMTLVRQYRVLILDISQVPHLGVTATLAIERIMQDARSKQRQVLVAGAQGKVRSRLEQFGIGGLCGSRQDAITKAYNWLHQTD

SEQ ID NO: 49691 - protein, 361 aa, Solanum tuberosum
MAIENNDQSFLLDVLYCEEEEEKWGDLLEDEEGVIINPLLLSSEETTKTNSLLLLPLLLLEQDLFWEDEELLSLFIKEKETHCCFESFGSDPFLCSARVDVVEWILKANAHYDFSALTAILAINYLDRFLSSLQFQKDKPWMTQLAAVTCLSLAAKVEETQVPLLLDFQVEDAKYVFEAKTIQRMELLVLSSLKWRMNPVTPLSFLDHIIRRLGLKNNAHWEFLRRCESLLLFVMTGCRFVRYMPSVLATAIMLHVIHQVEPCNAVDYQNQLLGVLKISKENVNNCYELISEVSSKPIISHKRKYDENPSSPSGVIDPIYTSESSNDSWELDLPLFKKSKVQEQQMKMASRVFVEAVGSPH

SEQ ID NO: 49692 - protein, 105 aa, Yarrowia lipolytica CLIB122
MGAGGIPLKLLSEAQGHVVTVELTSGHTYRGKLIEAEDNMNVQIRDVTVTARGGRVSHLEQVYIRGSHVRFFSIPEMLKNAPMFRPQTLAAVRSSRGRGGRGRGR

SEQ ID NO: 49693 - protein, 356 aa, Atriplex nummularia
MAAPVCCLPNDDLASRLVQKIAQTVEDEIPEQFLHKDGFPEAKDVPELWTRSLLIDFSLLSSGDQDEIVKFRSALSNWGCFLVKNHGIEGSFLEEVIEVSRKFFSLPFEEKMKYYTDDIFQGYDTDAVCQGLDQQKMNWNDRLFLTMYPKSKGNLKAWPQNPSNFSEIVDEYSKELINLTKGLYKAAAKSLNVREDSFCLEKEGVILSRFTLYPKCPRPKNVLGSKPHLDGSVFTIVLADQEGLEVQKDGQWFKVPVIPGALFVNFGDFGEVLTNGIYKSTMHRVATHSAKDRLSVTAFCTMDATQELTPLTELVTANRPPLYKKFKVYEYKEGVCCKCGPGENAIDAIKLDFPIL

SEQ ID NO: 49694 - protein, 391 aa, Shewanella sp. ANA-3
MAIINMSDLDLQGKRVLIREDLNVPVSNGVVTSDARLRASLPTIELALAKGAAVMVMSHLGRPTEGEYNSEFSMQPVVDYLAKALSCPVRLATDYLDGVEVAVGEVVVFENVRFNKGEKKNDEALSKKMAALCDVYVMDAFGTAHRAEASTNGVGLHAPIACAGPLLAQELEALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVNEVGDSDMIFDIGPDSAEALAKIIESAGTIVWNGPVGVFEFDQFGEGTKRIAQAIADSKAFSIAGGGDTLAAVDKYDIADKVSYISTGGGAFLEFLEGKELPAVAMLKQRGA

SEQ ID NO: 49695 - protein, 176 aa, Borrelia burgdorferi B31
MKNKTEYYDQFISKIPNFPKKGVLFYDITSVLLKPEVYSSLINEVYSFYNFKKIDCIAVVESRGYLIGAPLSLKMQLPLVLIRKEGKLPREVFSEEYELEYGFGRIEVHKDDVRTYSNILLIDDILATGGTLKSSAILLERAGGKVKDIFCFIELCAINGRQSLESYEVNSLVRYN

SEQ ID NO: 49696 - protein, 579 aa, Corynebacterium glutamicum ATCC 13032
MSIKWARFVPGITAMRGYQRSWLKGDVIAGITVAAYLVPQVMAYAVIAGLPAVVGLWGVLAPMALYFFLGTSRNLSVGPESTTALMTAAGVGALVGAAGGPERYAEVAALLAIAVGIVCAVGFIGRLGFLTRLLSRPVLVGYLIGIAVLMIVSQLSKVTQVNVESGQTWQEIISFIKVAGQAHIPTVILAVVVLSLLYLANWLTPKFPSTLMVLLLSAAAVGFFHLDRFGLEVIGEVPRGLPQPSIPSIGDLEIWSLLPYAVGIAIVGFSDNVLTARAFASGKDEVIDSNQELLALGTANLANGFFQGFPVSSSGSRTVLGDTAGARTQVHSLVVVALVIMVLLFAGPVLESFPDAALGALVIYAATQLIDIAEIKRIARFRKSELVITAATAASVVASGVLAGIGVAVTLSILDLIRRITRPYADVLGYTPGMAGMHSLEDYPESTAVEGLVVFRYDSPLFFANADDFSKRAIEAVDEATQPVHWFLLNAEANTEVDLTAVDAMEALRKTLEERGIRFAMARVKQDLRRSLEPAGFIESVGEEYIFATLPTAVKGYSVEFRDRFGNYPEGVPKEILEL

SEQ ID NO: 49697 - protein, 303 aa, Oryza sativa Japonica Group
MTKSFAHTLGKGGYGTVYKGSLSDGSEIAVKMLEDTKDDAEDFINEVVSIGRTSHINVVTLLGLCLHRSKRALVYEYMPNGSLDKYAVGVVDTVQGEKSLSWEKLYEILVGIAQGLDYLHRWCNHRVVHLDIKPQNILLDQDFRPKISDFGLAKLCKPKESKISIGGARGTIGYMAPEVFWRHHGAVTTKSDVYSYGMLILQMVGARENTNASMQTVSKYFPEWLYDNLNQFCGAATEGIDSRNTCISEVARKLVTIGFWCIQCTPEDRPSMSEVIDMFDRSMHELQLPPRMSCCGIDNPSIV

SEQ ID NO: 49698 - protein, 224 aa, Colwellia psychrerythraea 34H
MSSTKIHLTKAAFTISAPDIRRLPADSGIEVAFAGRSNAGKSSALNTLTNQRGLARISKTPGRTQLINVFEVAENRRLIDLPGYGFAQVPLAMKKKWQKALGEYLEKRQCLKGLVVLMDIRHPLKDLDMDLIQWAADSDLPVLALLTKCDKLSQGKRSSEVLAVKKALSSLNADIQVQAFSSLKYTGKEQADAIICQWLEQEAQEYELPEEDDFDDSDEFTEEE

SEQ ID NO: 49699 - protein, 384 aa, Arabidopsis thaliana
MTLPELPKDLVEEILSFVPATSLKRLRSTCKGWNRLFKDDKRFTRIHTEKAAKQFQPLTLTKNYRICPINVNLHGTTPSLEVKNEVSLLDPHSKNSAAQFNIDRVFHCDGLLLCTSQKDSRFVVWNPLTGVTKWIELGDRYNEGMAFILGYDNKSCNKSYKAMSFNYLDKDSEIYEFSSDSWRVIDDIIKPPHYMDYFRECFSLKGNTYWLGIDRRRRPPDLRITLIKFDFGTEKFGYVSLPPPCQVHGFEASNLSVVGDEKLSVLVQAGSTSKTEVWVTSKIGEANVVSWSKVLSLYPKPDVGFWHGLSFLLDEEKKVFLCCKSKGWMEEEDEDNVYIVGEDNKFILLNFGVETIGGESPIITTYVPSLVQIELAGSKRKTDY

SEQ ID NO: 49700 - protein, 550 aa, Gibberella zeae PH-1
MICLSKADESFYQRLTWNQAPSPLAASQTTRQDLNGISNLREHVDAAQDDGSGGTAGSLLNGHDDSNQAGSHPAEPFKGSLKDAGRQSRISGLSSCLKTVNGGVDHFRLPRGTLSSCASHIWSWTVWVLSVLAVSTLISYWNSPAPVAVVMTSPPIVQESIPIHLSPLHKRASTCESGGVNKDEYNTPLHVGALFIILFVSTLACAFPIMASKFPGLRIPNRFFFAVRHFGTGVLIATAFVHLLPTAFISLGNPCLSSFWNKDYPAIPGAIALAAIFLVTVIEMVFHPSRHVSPAEITTPKEGSVGSNSGGCMGGTGMLPIRDMGPIRGRSSSIGQNLSTLNSRDVRMQDLEEEACEDDDNVQSGRKNLEETSLEAVQMPVLTPEQQQRKELLQCVLLELGILFHSVFIGMALSVSIGNEFIILLIAIVFHQTFEGLALGSRIASVKWPQGKMQPWFMALAYGCTTPLGQALGLATHTLYSPNSETGLIVVGVMNAISAGLLTFASLVELLSQDFLSDESWQFLRGRKRIYACLLVFFGAFFMSLVGAWA

SEQ ID NO: 49701 - protein, 405 aa, Escherichia coli K12
MSPIEKSSKLENVCYDIRGPVLKEAKRLEEEGNKVLKLNIGNPAPFGFDAPDEILVDVIRNLPTAQGYCDSKGLYSARKAIMQHYQARGMRDVTVEDIYIGNGVSELIVQAMQALLNSGDEMLVPAPDYPLWTAAVSLSSGKAVHYLCDESSDWFPDLDDIRAKITPRTRGIVIINPNNPTGAVYSKELLMEIVEIARQHNLIIFADEIYDKILYDDAEHHSIAPLAPDLLTITFNGLSKTYRVAGFRQGWMVLNGPKKHAKGYIEGLEMLASMRLCANVPAQHAIQTALGGYQSISEFITPGGRLYEQRNRAWELINDIPGVSCVKPRGALYMFPKIDAKRFNIHDDQKMVLDFLLQEKVLLVQGTAFNWPWPDHFRIVTLPRVDDIELSLSKFARFLSGYHQL

SEQ ID NO: 49702 - protein, 263 aa, Schizosaccharomyces pombe 972h-
MSIPEVSSHDSCLNDCHSVNSEEQAKPVCCLELNAHKDGIKVVDTSNDASTFSNSPLVPDNFGVVYPGIIYRSACPRASNFNFLESLHIRTIISLRQEEYSEEDLHYFTKHHINYYHIAMPGSKHRKNDCISSSSNPDISDVDDLVRKTLQLLLNKENWPVLLHCSRGKHRTGIVIGCLRALMNWPVGNRLQEYISFSHPKEREVDEEYIQNFSSDPSLKSSLNDLKRYISDSSSELADVVLSSESPTVQAATVNETCRSPGS

SEQ ID NO: 49703 - protein, 471 aa, Sulfitobacter sp. EE-36
MKDSSSPQNGPYDLAVIGAGSAGFSAAITAAEAGARVALIGAGTIGGTCVNVGCVPSKALIRAVESLHHARAAGRFDGIEAEARVTDWAATVAQKQALVEELRQAKYADVLPRHENVDYVEGRATFDDEGKLTVDGSLFPAGKFIIATGSRPHVPAIPGIEEVDTLDSTSALELTALPSSMLVLGAGYIGVELAQLFARAGVDVTLVSRRGVLPEAEPEVSAALEGYLADEGIRLVRAKGYDRISKQGAAIALNLSDDQVLTAERLVLATGRVPNSDGLNLAAAGITVGARGGIETNPHMRTTNPNIWAAGDVTGRDQFVYMAAYGAKIAARNAVADETRTYDNATMPWVVFSDPQVAGVGLSEAQARAAGLEVVTSILPLDAVPRALAARDTRGLIKLLSEAGSKRLLGAQILAPEGADSIQTAAMALKAGLTYEELGDTIMPYLTTVEGLKLAAQTFEKDVAALSCCAG

SEQ ID NO: 49704 - protein, 463 aa, Corynebacterium glutamicum ATCC 13032
MAKSNEGLGTGLRTRHLTMMGLGSAIGAGLFLGTGVGIRAAGPAVLLAYIIAGAIVVLVMQMLGEMAAARPASGSFSRYGEDAFGHWAGFSLGWLYWFMLIMVMGAEMTGAAAIMGAWFGVEPWIPSLVCVVFFAVVNLVAVRGFGEFEYWFAFIKVAVIIAFLIIGIALIFGWLPGSTFVGTSNFIGDHGFMPNGISGVAAGLLAVAFAFGGIEIVTIAAAESDKPREAISLAVRAVIWRISVFYLGSVLVITFLMPYESINGADTAAESPFTQILAMANIPGTVGFMEAIIVLALLSAFNAQIYATSRLVFSMANRQDAPRVFSKLSTSHVPTNAVLLSMFFAFVSVGLQYWNPAGLLDFLLNAVGGCLIVVWAMITLSQLKLRKELQANDEISTVRMWAHPWLGILTLVLLAGLVALMLGDAASRSQVYSVAIVYGFLVLLSFVTVNSPLRGGRTPSDLN

SEQ ID NO: 49705 - protein, 448 aa, Sulfitobacter sp. EE-36
MTETLDLIVIGAGMAGVNAAKKAARAGWSVAIVDELPYGGTCALRGCDPKKMLRAGAEAVDAARLLSGKGVAGDTRIDWPALMKHKESFTDPVPENMEDGLKKAGVQTLHGSTRFTAADRIEIDGHGAITFGHALIATGAKPRPLDFPGAERLIDSTDFLNLSNLPKRIIFVGGGYISFEFAHIAAPAGAEVTILDHGARQLKLFDPDLVDMLLERSRAAGIEIISETTPEKIEAAGKAQRIFYGKDGNTHVKEADLMVHGAGRMPAVDELNLSAAGIETEHGGVKVSPWLQSTSNPRVYAAGDAAASPGKPLTPVAVFEGKIATSNMLKGKQTEPDYTGVPSVVFTIPELARVGMLEEEARETGDVEVSFTDTSGWFSQKRLGETHAGAKIISNSEGKILGAHMFGPDYAELINIFSLAIKLGLTVDQIKTMPAAYPTGASDIGSML

SEQ ID NO: 49706 - protein, 449 aa, Vitis vinifera
MQLSQCTWTFPELLKRPAFLRRSIDSISSRSRSSSKYPSFMASASTVSAPNTEAEQTHNPPQPLQVAKRLEKFKTTIFTQMSMLAIKHGAINLGQGFPNFDGPEFVKEAAIQAIKDGKNQYARGYGVPDLNSAVADRFKKDTGLVVDPEKEVTVTSGCTEAIAATMLGLINPGDEVILFAPFYDSYEATLSMAGAQIKSITLRPPDFAVPMDELKSAISKNTRAILINTPHNPTGKMFTREELNVIASLCIENDVLVFTDEVYDKLAFEMDHISMASLPGMYERTVTMNSLGKTFSLTGWKIGWTVAPPHLTWGVRQAHSFLTFATCTPMQWAAATALRAPDSYYEELKRDYSAKKAILVEGLKAVGFRVYPSSGTYFVVVDHTPFGLKDDIAFCEYLIKEVGVVAIPTSVFYLHPEDGKNLVRFTFCKDEGTLRAAVERMKEKLKPKQ

SEQ ID NO: 49707 - protein, 241 aa, Glycine max
KENDHFIPPRPCNLPPPPWGFRTLVREQLEKAKKKEAALLRTPPPREQEIAELKSAVRDLKVQLKPPSMQSRRLLLDPAVHEEFTRLKNLVEEKDKKVKELQDNIAAVSFTPQSKMGKMLMAKCRTLQEENEEIGNQASEGKMHELGMKLALQKSQNSQLRSQFEGLQKHMEGLTNDVERSNEMVLMLQEKLEDRDREIQRLKHELQQKNLEDQRLKHKLQQKNLEDGNDNNETIAGEAAN

SEQ ID NO: 49708 - protein, 869 aa, Saccharomyces cerevisiae
MTESAIDDQRFNLTKELQRHSCRDQGKITQKDDALDFISYSSFQSSFNTDQKSANNGSTVRRSIRSIFRRAAELPRVHMGPLTYSHGINELVNKKLRKDCDLSTLCRVLQRGIRMIRMTRRRRKFYEFKLINNNGQIIWKDGSKYLELDSVKDIRIGDMASTYQEEVDPKRLRSDSKLWITIIYKVSNKLKALHVVALNELDFNTFLSCICGLVKLRRELMESILLPDNSQFARIHWQITVSEKEEDEKKDTLSFADVKKLCDKFHIYVSTGQLLEFFQLADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRGLSVNEPFPSSFSSSYESANEQELRMKDDSTNSSSATNSSSMQRIKRIGLKKHVDIINDVSNISGIHGIKFRNFSLPESKTIAHCFSLNERKVEYMIKDKHLKLSLDKHNRRYLMRVYPHVLRYKSSNFNPIPFWKAGVQMVATNWQTNDIGQQLNLAMFQILDHQPDGSFKSGYVLKPKKLLPVVTKAKMIPLIYEHFENGSDPVTVKIRILSTQLLPRLNDTSPSRNNTNSFVKVEFHTDDEPTMPISIDKGTRISATEASTKSSQGNGFNPIWDAEVSITLKDTDLTFIKFMVISEETQIASVCLKLNYLRMGYRHIPLFNMEGEQYIFCTLFIHTQIL

SEQ ID NO: 49709 - protein, 469 aa, Glycine max
KVYYARNIKTGEGVAIKVIDKEKILKGGLVAHIKREISILRRVRHPNIVQLFEVMATKSKIYFVMEYVRGGELFNKVAKGRLKEEVARKYFQQLISAVGFCHARGVYHRDLKPENLLLDENGNLKVSDFGLSAVSDQIRQDGLFHTFCGTPAYVAPEVLARKGYDGAKVDLWSCGVVLFVLMAGYLPFHDQNVMAMYKKIYRGEFRCPRWFSPDLSRLLTRLLDTKPETRIAIPEIMENKWFKKGFKQIKFYVEDDRLCNVVDDDGLMDNDDDTASIVSVASFSDYSVSESDSEIETRRRINAPLPRPPSLNAFDIISFSPGFNLSGLFEEKEDETRFVTAAPVNRIISKLEEIAQLVRFSVRKKDCRVSLEGTREGVRGPLTIAAEIFELTPSLVVVEVKKKGGDRAEYERFCNDELKPGLQNLMVEESATSSELSTPIQPSLLRGLSEPVPDISSDIETPLCIPSDD

SEQ ID NO: 49710 - protein, 569 aa, Francisella tularensis subsp. holarctica
MNSETKKDFSQLGLNQDIVDTVIKLGYENPTPIQQYAIPYILSGRDVLGQAQTGTGKTAAFALPLINNMDLASRDRAPQVLVLAPTRELAIQVAEQFEAFAKNVPNLDVACIYGGQEYGSQIRALKQGVKVVVGTTGRVMDHIEKGTLQLDNLRALVLDEADEMLRMGFIDDVQFVLSHVSEQCQRLLFSATIPTDIADIIEEYLRNPCKIQVKAKTKTANTVTQKFIVIKGFRKIDALDRLLETEETDGVIIFVKTKTSTIEVADNLKALGYKVAAINGDMQQSQREYIVDQFRSAKSDILVATDVVARGIDLERISHVINYDMPNDTDTYVHRIGRTGRAGREGTSISLVPLKEMRFLRTLERFTGSPMQEVFMPSAKDLAQSRVEHFKARIISALDKNKSLDKYKEIITSIRYELQLDSEELLAGLTLLAQGKKTFFPREIQAKEEKPARDNRNSRDGRRNERFERRNDQGDRTKRFDKADRKPRRAVNIDLTTYKLDVGRDNDVQARNIVGAIANEGNIDSKHICNISIQKDYTLVDLPANLSPKVINHLKKVWVAGKKLNLTAQ

SEQ ID NO: 49711 - protein, 343 aa, Mycobacterium avium subsp. paratuberculosis K-10
MTPVFVDVDTGVDDALALMYLFASPDADVVGIASTGGNVAVEQVCENNLGLLQLCGLTGIPVSKGSGQTLTGPMRLPSKVHGPRGLGYAELPPSDHRVTDHDSATAWVCAAHAHPGELIGVATGPLTNLALALRAEPALPTLLRRLVIMGGSYDHRGNTTAVAEWNISVDPEAAAEVLAGWGGADVGRERLPILCGLDLTRKVAMTPGHLTRLATAADSSTRPLSADDEPGTRSAAANPLIRVIEDAMRFYLEAYHDLGHGYQAHMHDPLAAAVALDPTLVATRPATVEIELTGTLTRAMTVTDWSGRREPNALIGIDVDSAAFFDRFIERVGPFARRVGGGR

SEQ ID NO: 49712 - protein, 509 aa, Brassica juncea
MTSVNVKLLYHYVITNLFNLCFFPLTAIVAGKAYRLTIDDLHHLYYSYLQHNLITIASLFAFTVSGFGLYIATLPKPLTLVEYSCYLPPRHLKVSVSKIMDIFYQIRKADTSSRNVACDDPSSLDFLRKIQERSGLGDETYSPEGLIHVPPRKSFAASREETEKVIIGGIENLFENTKVKPKDIGILVVNSSKFNPTPSLSAMVVNTFKLRSNIKSFNLGGMGCSAGVIAIAIDLAKDLLHVHKNTYALVVSTENITQGIYAEENRSMMFSNCLFRVGGAAILLSNKSGDRRRSKYELVHTVRTHTGADDKSFRCVQQGDDEDGKIGVCLSKDITNVAGTTLTKNIAICRPLILPLSEKFLFFATSVAMKLLKDKIKHYYVPDFKLAVDHFCIQPGGRAVIDELEKNLGLSPIDVEASRSTLHRFGNTSSSSIWYELAYIEPKERLKKGNKGWQIALGLGFKCNSAVWVALNNVKASANSPWEHCIDRYPVKNDSDLSKSKTHVQNGRS

SEQ ID NO: 49713 - protein, 519 aa, Aspergillus oryzae
MASVESSPVDTSMIKDADVTVSNWAGLKGRESTVESSEDVEAGQSGKSSGVLNVFISGLALFSDGYNAQINCLPLTSFLVYGRYKDGMSPTIKGRLSNSFLIGEIFGMLFFGVLIDRLGRRTGVVAATTFLVLGIALAAAAHGKSELGMFWMMIIARGVAGFGAGGEYPVCATSATEAADETTKLRKNRGFLVASTTDFAVDLGFVSAGIVALIVLACYGQETRSGVWRVSFGLGFVLPLVICFFRIRMINSTQYQKHSIKSRYPYGLILKRYWKPMLGTCGSPNHLSMCSSADFVALAWFCYDFVTYPFGIFSSTIIQQLMTDNSTVQNIGYGTVINCFYLPGCLLGGYLMDKIGRKQNMTLGFMLWAIWGFILGGALHPIQSVFPLFVVMYGIFMALGEMGPGVSTFLCAAESFPTPLRGHFLGFAAAVGKAGASIGTEVFTPIQNSFDTTAKGQQAVFLIASAFTVVGGLIAWFLIPDMSRELEDEDARFKAYLEENGYDVSHYGEALQVDRKSGH

SEQ ID NO: 49714 - protein, 525 aa, Mycobacterium avium subsp. paratuberculosis K-10
MAESPPTEVPEPPARPVLVVDFGAQYAQLIARRVREARVFSEVIPHTATIEEIKARQPRALVLSGGPSSVYEPGAPQLDPAVFDLGVPVFGICYGFQAMAQALGGTVAHTGTSEYGRTELKVLGGELHSGLPGVQPVWMSHGDAVTAAPDGFEVVASSPGAVVAAFENRARRLAGVQYHPEVMHTPHGQQVLSRFLHDFAGLGADWTAANIAGVLVEQVRAQIGDGHAICGLSGGVDSAVAAALVQRAIGDRLTCVFVDHGLLRAGERAQVQRDFVAATGANLVTVDAADTFLQALAGVTNPEGKRKIIGRQFIRAFEGAVRDVLGDKPVEFLVQGTLYPDVVESGGGSGTANIKSHHNVGGLPGDLKFTLVEPLRLLFKDEVRAVGRELGLPEEIVARQPFPGPGLGIRIVGEVTATRLDTLRRADSIAREELTAAGLDSLIWQCPVVLLGEVRSVGVQGDNRTYGHPIVLRPVTSEDAMTADWTRVPYEVLERISTRITNEVPEVNRVVLDITSKPPGTIEWE

SEQ ID NO: 49715 - protein, 355 aa, Arabidopsis thaliana
KCDMPESLNVGNGNPSIPIINERTLPKFLESARMEKSVNRTNTRLKLFSGTANPALAQEIAWYMGLDLGKVNIKRFADGEIYVQLQESVRGCDVYLVQPTCTPTNENLMELLIMVDACRRASAKKVTAVIPYFGYARADRKTQGRESIAAKLVANLITEAGADRVLACDLHSGQSMGYFDIPVDHVYCQPVILDYLASKSIPSEDLVVVSPDVGGVARARAFAKKLSDAPLAIVDKRRSGHNVAEVMNLIGDVRGKVAIMVDDMIDTAGTIVKGAALLHQEGAREVYACCTHAVFSPPAIERLSGGLLQEVIVTNTLPVAEKNYFPQLTILSVANLLGETIWRVHDDSSVSSIFL

SEQ ID NO: 49716 - protein, 120 aa, Zea mays
IVLPLPVEPNGKGVWFTLKEGSPYRLKFTFSVSNNIVSGLRYTNTVWKTGLKVDRAKEMLGTFSPQLEPYTYVTPEDTTPSGMFARGSYSARTKFLDDDRKCYLEINYTFDIRREWPSTS

SEQ ID NO: 49717 - protein, 265 aa, Magnaporthe grisea 70-15
MAAMFSQNPVMNGPNYAFSDTPRVNAPGGARQHGFNPYTDNGGSTLAIAGDDFAIMAGDTRMASGYSINTRFYPKVFKIGGTTADNSDATLVLSVVGFAADGEALKERLDAICKIYRYRHGKPMTVKACAKRLSTILYQKRFFPYYTHAILAGIDEEGHGAVYSYDPVGSYEREQCRAGGAAASLIMPFLDNQVNFKNQYVPGSGTGHDLQERERKPLPRETVETLVKDAFDGAVERHIEVGDGLQMMIITKDGIEEVIMPLKKD

SEQ ID NO: 49718 - protein, 338 aa, Shewanella sp. ANA-3
MIRVAINGYGRIGRSILRALYESGKRQQIQIVAINELAKPEAIIHLTQYDTTHGRFQPRVKLVDDQMLIGDDVIKILHEPDPAKLPWREMDIDIVYEATGAILDRNSCEAHILAGAKQVLISHPSSADVDGTIVYGVNQDLLRAEHTVVSNASCTTNCIVPVIDVLDKHFGVKSGAITTIHSAMNDQQVIDAYHDDLRRTRAAGQSIIPVDTKLARGIERILPHMKDKFEAISVRVPTINVTAIDLSVTLDKTVDIATVNQVLELAANGRFNGILGYTDEPLVSCDFNHDPRSSIIDGTQTRVSAGQLVKLLLWCDNEWGFANRMLDTSLAMIAAKQS

SEQ ID NO: 49719 - protein, 135 aa, Zea mays
MATVLSSPRAPAFSFSLRAAPATTVAMTRGASSRLRAQATYNVKLITPEGEVELQVPDDVYILDYAEEEGIDLPYSCRAGSCSSCAGKVVSGSLDQSDQSFLDDSQVADGWVLTCVAYPTSDVVIETHKEDDLIS

SEQ ID NO: 49720 - protein, 400 aa, Bordetella pertussis Tohama I
MSIVADKIKRIKLSPSVATRAIVAQLREEGRRVIDLTVGEPDFSTPAHICEAAIAAMQRGETKYPPAQGTMPLRKAVRARLREETGVDYPEGRIIVGTGAKQVLYNGLAATLNEGDEVIIPAPYWVSYPDMVLVNGGVPVAVTATPATQYKLTPQALEAAITPRTKWLMMNAPSNPTGAIYTADEWRGLAEVLRRHPHVWLMTDDIYARLNFTATPTVHPLQVAPELAERTLVVNGVSKAYAMTGWRIGYGAGPEALIKAIAILQSQSTSGACSISQAAAREALAGPQDCVAEFARTFKARRDAAVAALQGAPGLSVVMPEGAFYVFPDCAGVLGKTTPDGRVLETDTDFVHYLLREAGVAVIDGTPYGVPGTFRLSFAAALEDIQQGCAAIRAACERLA

SEQ ID NO: 49721 - protein, 379 aa, Zea mays
  misc_feature (367)..(367): Xaa can be any naturally occurring amino acid
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLXGESIRCIITMGA

SEQ ID NO: 49722 - protein, 330 aa, Kluyveromyces lactis NRRL Y-1140
MSQLKVDNGPLSHVANSGPISIGAYCFSSIMMTVTNKFVVNLKGFNMNFVMLFVQAAVCVNLLFFLRLLGYAKFRPLNRTDAKNWFPITIFLVLMIYTSSKSLQYLAVPIYTIFKNLTIILIAYGEVLFFGGSVTAMELSSFLLMVLSSVVATLGDQQALKKTADAGASLFNIGYMWMFINCLSSAAFVLVMRKRIKLTNFKDFDTMFYNNILSMPVLLALSFLMEDWSTENLTKNLSRDSVTAMIISGMTAVCISYCSGWCVRVTSSTTYSMVGALNKLPIALSGLIFFDAPKNFLSIFSIFLGFLSGIVYAVAKQKKQQNPQPSAPIK

SEQ ID NO: 49723 - protein, 303 aa, Oryza sativa Japonica Group
MTKSFTHTLGKGGYGTVYKGSLSDGSTIAVKILEDSNNDGEDFINEVSSIGRISHINVVTLLGLCQHGSKRALIYEYMPNGSLDKFAVGGNDTMQQEKFLISWEKLYDILVGVAQGLDYLHHWCNHRVVHLDIKPQNILLDQDFCPKISDFGLAKLCKPKESKISIGCARGTIGYMAPEVFWGHRGAVTTKSDVYSYGMLILHMVGERENINASTESGSKYFPEWLYDNLNQFCGVPSGGIDGSNSTSEVAHKLVIIGFWCIQSAPTDRPSMSEVIDMFDRSLTELQLPPRISCCGNYNESFG

SEQ ID NO: 49724 - protein, 200 aa, Magnaporthe grisea 70-15
MHTKGPTPQQHDGSALRIGIVHARWNETIIEPLLAGTKAKLLACGVKESNIVVQSVPGSWELPIAVQRLYSASQLQTPSSGPSLSAGDLLGSSTTDLTALPTTTASSTGPFDALIAIGVLIKGETMHFEYIADSVSHGLMRVQLDTGVPVIFGVLTVLTDDQAKARAGVIEGSHNHGEDWGLAAVEMGVRRRDWAAGKTE

SEQ ID NO: 49725 - protein, 363 aa, Haemophilus influenzae R2866
MGFKCGIVGLPNVGKSTLFNALTKAGIEAANYPFCTIEPNTGVVPMPDPRLDALAEIVKPERVLPTTMEFVDIAGLVAGASKGEGLGNKFLANIRETDAIGHVVRCFENDDIVHVAGKIDPLDDIDTINTELALADLDSCERAIQRLQKRAKGGDKEAKFELSVMEKILPVLENAGMIRSVGLDKEELQAIKSYNFLTLKPTMYIANVNEDGFENNPYLDRVRKIAAKEGAVVVPVCAAIESEIAELDDEEKVEFLQDLGIEEPGLNRVIRAGYSLLNLQTYFTAGVKEVRAWTVSVGATAPKAAAVIHTDFEKGFIRAEVIAYEDFIQFNGENGAKEAGKWRLEGKDYIVQDGDVMHFRFNV

SEQ ID NO: 49726 - protein, 160 aa, Hyphomonas neptunium ATCC 15444
MAIKVGDKLPEATFMEMTVDGPKPVTTAQVFGGKTVALFAVPGAYTPTCSARHLPGYVDKAGDFKAKGVDEIVCTSVNDVFVMGAWGKSSKAEEAVRMLADGNGAFAQSLGLELDASGFGMGKRSQRYSMLVKDGVVAELNVEQGGEFKVSAADYLLGQL

SEQ ID NO: 49727 - protein, 464 aa, Schizosaccharomyces pombe 972h-
MAPISKVFDYLVIGGGSGGLASARRAAKHGAKVALIEASGRLGGTCVNYGCVPKKIMWNIADLVAKMKTAKQNGFPNSQLGSFDWGMIKRKRDAYIGRLNGIYERNVNKDGVAYISGHASFVSPTEVAVDMNDGSGTQVFSAKYILIAVGGHPIWPSHIPGAEYGIDSDGFFELESQPKRVAIVGAGYIAVELAGVFAALGTETHMFIRQSKFLRKFDPIISDGIMDHFQHIGINVHTNSLEFKKVEKLPSGELCIHQQDGSTFNVDTLLWAIGRAPKIQGLRLEKAGVKTLPNGIIIADTYQRTNVPTVLSLGDVCGKLELTPVAIAAGRRLSDRLFGGIKDAHLDYEEVPSVVFAHPEAGTIGLTEQEAIDKYGESQIKVYNTKFNGLNYSMVEQEDKVPTTYKLVCAGPLQKVVGLHLVGDFSAEILQGFGVAIKMGATKSDFDSCVAIHPTSAEELVTLV

SEQ ID NO: 49728 - protein, 216 aa, Citrus sinensis
MVSAQISSSSEHDGINETQVVLNVYDLTPVNSYTYWFGFGIFHSGIEVHGKECGFGAHDFPVSGVFEVEPRSCPGFIYRASNLLGRINMPPSEFRTFIECSASEYHGDAYNLISKNCNHFTDDIAWRLTGKHVPGWVNRLARLGALCGCLLPESLQATTVKQLPEYHDCTEEDGSESLSTATPRESTEMDDNDQEKLLVTSSAGTGEVAFVREATK

SEQ ID NO: 49729 - protein, 714 aa, Escherichia coli K12
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 49730 - protein, 1389 aa, Mycobacterium ulcerans
DPIDVAHSLATTRSHHPHRATITTSIEHHSENNHDTTDALAALHALANNGTHPLLSRGLLTPQGPGKTVFVFPGQGSQYPGMGADLYRQFPVFAHALDACDAALQPFTGWSVLAVLHDEPEAPSLERVDVVQPVLFSVMVSLAALWRWAGITPDAVIGHSQGEIAAAHVAGALTLPEAAAVVALRSRVLTDLAGAGAMASVLSPEEPLTQLLARWDGKITVAAVNGPASAVVSGDTTAITELLITCEHENIDARAIPVDYPSHSPYMEHIRHQFLDELPELTPRPSTIAMYSTVDGEPHDTAYDTTTMTADYWYRNIRNTVRFHDTVAALLGAGEQVFLELSPHPVLTQAITDTVEQAGGGGAAVPALRKDRPDAVAFAAALGQLHCHGISPSWNVLYCQARPLTLPTYAFQHQRYWLLPTAGDFSGANTHAMHPLLDTATELAENRGWVFTGRISPRTQPWLNEHAVESAVLFPNTGFVELALHVADRAGYSSVNELIVHTPLLLAGHDTADLQITVTDTDDMGRQSLNIHSRPHIGHDNTTTGDEQPEWVLHASAVLTAQTTDHNHLPLTPVPWPPPGTAAIEVDDFYDDLAAQGYNYGPTFQGVQRIWRDHATPDVIYAEVELPEDTDIDGYGIHPALFDAALHPLLALTQPPTNDTDDTNTADTGDQVRLPYAFTGISLHATHATRLRVRLTRTGADAITVHTSDTTGAPVAIIDSLITRPLTTATGSAPATTAAGLLHLSWPPHPDTTTDTDTDTDALRYQVIAEPTQQLPRYLHDLHTSTDLHTSTTEADVVVWPVPVPSNEELQAHQASDTAVSSRIHTLTRQTLTVVQDWLTHPDTTGTRLVIVTRHGVSTSAHDPVPDLAHAAVWGLIRSAQNEHPGRFTLLDTDDNTNSDTLTTALTLPTRENQLAIRRDTIHIPRLTRTAVLTPPDSGPWRLDTTGKGDLANLALLPTAHTALASGQIRIDVRAAGLNFHDVVVALGLIPDDGFGGEAAGVISEIGPDVYGFAVGDAVTGMTVSGAFAPSTVADHRMVMTIPARWSFPQAASIPVVFLTAYIALAEISGLSRGQRVLIHAGTGGVGMAAIQLAHHLGAEVFATASAAKWSTLEALGVPRDHIASSRTLDFSNAFLDATNGAGVDVVLNCLSGEFVEASLALLPRGGHFVEIGKTDIRDTEVIAATHPGVIYRALDLLSVSPDHIQRTLAQLSPLFATDTLKPLPTTNYSIYQAISALRDMSQARHTGKIVLTAPVVVDPEGTVLITGGTGTLGALFAEHLVSAHGVRHLLLTSRRGPQAHGATDLQQRLTDLGAHVTITACDISDPEALAALVNSVPTQHRLTAVVHTAAVLADTPVTELTGDQLDQVLAPKIDAAWQLHQLTYEHNL

SEQ ID NO: 49731 - protein, 423 aa, Ralstonia solanacearum
MDRAIEIDFRTISVVGLGYIGLPTATVLASRQRELIGVDINQHAVDTINQARIHIVEPDLDMLVRAAVSQGYLRATTEPEPADAFLIAVPTPFLEDKQPDLTYIEAAAKAIAPVLKRGDLVVLESTSPVGATEQLSAWLSEQRSDLSFPHQLGEESDIRVAHCPERVLPGHVLRELVENDRIIGGMTPRCSQAAQRLYELFVRGRCIVTDARTAEMCKLTENAFRDVNIAFANELSMICDEIGVNVWELISVANRHPRVNILQPGPGVGGHCIAVDPWFIVDAAPESARLIRTAREVNDAKPHYVLDRVKQAARRFKEPVIACFGLSFKANIDDLRESPAIEIVRTMVQQQLGTVLVVEPHIKVLPASLEGVELLNAEPALSRADIVVLLVDHQKFRKLDTDRLQSRVVIDTRGMWSAKRLAA

SEQ ID NO: 49732 - protein, 681 aa, Vibrio harveyi
MDAIRKVYQYAEPNLSLVGWMGFIGFPIYYIVWEFMFPQPYENLPLRILCSVLFFGIIYRNRTPFEWRGFLPAYYQVVTTLCLPCFFFYMLLMNNWSNVWVMSFMSAIFLHILLVHITSVMFVQTFVGIGLATFFAWVAQGFHLELTMDWTHVPIFLFIYLFGNLFYFRNQVEHEAKVSIAKSFGAGIAHEMRNPLSGLLTSIDVIQSVLPNPKEGKKEQYTLSDEDVTLLREVSSDAMKIIHSGNETIDLLLTSIDENRVSRSTFKKHSAQSVVESAIESFSYKRSTDRFAISLDVRSEFDFLGSDTLLKYVMYNLFKNAFHHRSSEDFHIHVTMYSDEFANQIVVTDNGSGIAPEVLQSIFQDFYTTGKSGNYGLGLPFCKKVMRSFGGDIRCQSEVGEWSQFTMTFPTIGSSAVKEIKSELTKLKTILFVSEQNILVSKVTDIARFMRFELTVLDVPAVLKNKEYEFEFDLILIDMESLDRSGSHIDKVESLLSFTEARIVYMFEHHPIQRARSVSFEPIWVETQAWLLNTRATIDRLLYDANYVVPSMPAKPLDSTNKRTIMVVDDNESLRKFTAMLLEKQGFEVIQTEDGLQAINALNENNVDLILMDIEMPVMDGVEASRQIRGSNKAYASVPIIAHTGDSSPITLDKIGSSGMSDFIVKPADKNRLFDKIANWI

SEQ ID NO: 49733 - protein, 375 aa, Citrus sinensis
MADVAQVNGVGQTADFPAVPTHGGQFIQYNIFGNLFEITAKYRPPIMPIGRGAYGIVCSVLNTETNELVAIKKIANAFDNHMDAKRTLREIKLLRHLDHENVIAVRDVVPPPLRREFTDVYIAAELMDTDLHQIIRSNQSLSEEHCQYFLYQLLRGLKYIHSANVIHRDLKPSNLLLNANCDLKICDFGLARPTSENEFMTEYVVTRWYRAPELLLNSSDYTAAIDVWSVGCIFMELMNRRPLFPGKDHVHQMRLLIELLGTPTDADLGFVRNEDAKRYIRQLPQHPRQSLAQVFPHVHPLAIDLVDRMLTFDPMKRITVDEALAHPYLARLHDEADEPVCPEPFSFDFEQQSLGEEQIKDMIYQEALALNPGFA

SEQ ID NO: 49734 - protein, 549 aa, Brucella melitensis 16M
MARDATKLEATVAKLKKHWAESAPRDMRAAFSADPGRFGRYSLCLDDLLFDWSKCRVNDETMALLKELAVAADVEGRRAAMFAGEHINNTEDRAVLHVALRDTSSKEVLVDGHNVLPDVKHVLDRMAAFADGIRSGALKGATGRKITDIVNIGIGGSDLGPVMATLALAPYHDEPRAHFVSNIDGAHIADTLSPLDPASTLIIVASKTFTTIETMTNAQTARKWVADTLGEAAVGAHFAAVSTALDKVAAFGIPEDRVFGFWDWVGGRYSVWSAIGLPVMIAVGPDNFRKFLAGAHAMDVHFRDAPLEKNLPVMLGLIGYWHRAICGYGSRAIIPYDQRLSRLPAYLQQLDMESNGKSVTLDGKPVSGPTGPVVWGEPGTNGQHAFFQLLHQGTDTIPLEFIVAAKGHEPTLDHQHEMLMANCLAQSEALMKGRTLDEARAQLQAKNLPASQVERIAPHRVFSGNRPSLTLIHDMLDPYTLGRLIALYEHRVFVEAQIFGINAFDQWGVELGKELATELLPVVSGKEGASGRDASTQGLVAHLHARRKA

SEQ ID NO: 49735 - protein, 607 aa, Kluyveromyces lactis NRRL Y-1140
MAPVSASKAKRDAKKAERDAKRVAAGKTTRRSKKEDETVDEAAAAADKIAQLKLQQDKDGISDRVVTGVLDSLETSRDIKLSSVSLLFHGKVLIQDSQLELNYGRRYGLLGENGCGKSTFLKAVASREYPIPENIDIYLLDEPAEPSEYSALEYVVREAQGELKRLEDLVEKILLEDGPESDLLEPLYERMDDMDPSTFESRAAIILIGLGFNSKTINKKTKDMSGGWKMRVALAKALFVKPTLLLLDDPTAHLDLEACVWLEEYLKRFDRTLVLVSHSQDFLNGVCTNMLDMRLQKLMAYGGNYDSYVKTRSELETNQMKQYTKQQEEIAHIKKFIASAGTYANLVKQAKSRQKILDKMEADGLIQPVAADKVFSFRFPEVERLPPPVLAFDDISFSYDGNSENNLYEHLDFGVDMDSRIALVGPNGVGKSTLLKIMTGQLTTQSGRVSRHSHVKLGVYSQHSQDQLDLTKSALEFVRDKYPHVSQDFQYWRGQLGRYGLTGEGQTVQMGTLSEGQRSRVVFALLALEQPNVLLLDEPTNGLDIPTIDSLADAINEFNGGVVVVSHDFRLLDKIAKDIFVVEHKTATRWDGSILDYKNKLAKNVVL

SEQ ID NO: 49736 - protein, 575 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSSSCLLIIGLYYALHFCQYETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 49737 - protein, 237 aa, Oryza sativa
  misc_feature (217)..(217): Xaa can be any naturally occurring amino acid
MVSSHAAIVFFLVAASSLLSYGEAAPKMTAVAADYGYPADYGYAAGSKLGPENWGKLSPAYKLCGDGKKQSPIDIVTKQAISNPNLDSLNRTYTASDGTLVNNGKDILMEFEPDKVGTVTVNGKVYSFRRVHWHAPSEHTINGEKHPLELQMVHAAADGSLAVIAILYKYGAPDSFYFQLKRKLAELAADGCSFGEENAQVALGLVHLRSLQKRTGXSYFRYAGSLTAPPWHRGTTN

SEQ ID NO: 49738 - protein, 166 aa, Crocosphaera watsonii WH 8501
MFSYNYRWAILNRLGFSAPLEICREDTIKITSDYFHSGGKLTKSDAQKCGYFLHTLVKKDNKDALKLLINHGVDVNAKDDDAGTPLHNAVWEQNKEIVELLINHGADVNAKSKSEMNPTPLHNAVWEQNKEIVELLINHGADVNAKNDDAGTPLHAASMKDNKEIV

SEQ ID NO: 49739 - protein, 429 aa, Arabidopsis thaliana
MVNSCENKIFVKPTSTTILQDETRSRKFGQEMKREKRRVLRVINQNLAGARVYPCVVNKRGSLLSNKQEEEEGCQKKKFDSLRPSVTRSGVEEETNKKLKPSVPSANDFGDCIFIDEEEATLDLPMPMSLEKPYIEADPMEEVEMEDVTVEEPIVDIDVLDSKNSLAAVEYVQDLYAFYRTMERFSCVPVDYMMQQIDLNEKMRAILIDWLIEVHDKFDLINETLFLTVNLIDRFLSKQNVMRKKLQLVGLVALLLACKYEEVSVPVVEDLVLISDKAYTRNDVLEMEKTMLSTLQFNISLPTQYPFLKRFLKAAQADKKCEVLASFLIELALVEYEMLRFPPSLLAATSVYTAQCTLDGSRKWNSTCEFHCHYSEDQLMECSRKLVSLHQRAATGNLTGVYRKYSTSKFGYIAKCEAAHFLVSESHHS

SEQ ID NO: 49740 - protein, 299 aa, Triticum aestivum
  misc_feature (112)..(112): Xaa can be any naturally occurring amino acid
  misc_feature (155)..(155): Xaa can be any naturally occurring amino acid
  misc_feature (169)..(169): Xaa can be any naturally occurring amino acid
  misc_feature (178)..(178): Xaa can be any naturally occurring amino acid
  misc_feature (198)..(198): Xaa can be any naturally occurring amino acid
  misc_feature (235)..(235): Xaa can be any naturally occurring amino acid
  misc_feature (253)..(253): Xaa can be any naturally occurring amino acid
  misc_feature (281)..(281): Xaa can be any naturally occurring amino acid
MEGKEEDVRLGANRYSEHQPIGTAAQGGGADEKDYKEPPPAPFFEAGELTSWSFYRAGIAEFLGTFLFLYISVLTVMGVVGNPSGSKCGTVGIQGIAWSFGGMIFVLVYCTXAGISGGHINPAVTFGLFLARKLSLTRAVFYIVMQCLGAICGAXGVVKGFQTTLYQGXGGGANSVAXPGTPRGTGLGAEIVGTFVLXVYTVFSATDAKRSARDSHVPILAPLPIGFAVFLVHLXATIPITGTGINPARSLGXAAIIYNKKQAWDDHWIFWVGPFIGRGAXAAIYHVVVIRAIPFKSRD

SEQ ID NO: 49741 - protein, 427 aa, Frankia sp. CcI3
MPSIEAVGAREILDSRGNPTVEVEVVLEDGTLGRAAVPSGASTGAFEAVELRDGDNRYGGKGVTKAVAAVIDRIGPAIMELEATEQRLLDATLIDLDGTPGKSALGANALLGVSLAVAKAAAASSGLPLFRYLGGPTAHLLPVPMMNILNGGAHADTNVDIQEFMIAPIGASTFAESLRWGAEVYHALKSVLKARGLATGVGDEGGFAPSLPTNREALDLIAEGIDKAGFALGTDIALALDVASTEFYADGSYTFEGNSRSAEYLSDYYAELVSAYPIVSIEDPLAEDDWDGWVALTERLGGKVQLVGDDLFVTNPERLARGIALKAANALLVKVNQIGTLTETLDAVNLAHRSGYRAMMSHRSGETEDTTIADLAVAVDCGQIKTGAPARSERVAKYNQLLRIEEELDDAARYAGAAAFPRRRQAG

SEQ ID NO: 49742 - protein, 843 aa, Aspergillus oryzae
MPGDLKTKIGHGAAKALGIKIPYRDPLGVHADPVTRGESMFSVGTIDTYSYLEPEPTPAEWLKEVCPSWHQVGRYFYNLFPFLSWITRYNLQWLLGDMIAGVTVGAVVVPQGMAYAKLANLPVEYGLYSSFMGVLIYWFFATSKDITIGPVAVMSTLTGKIVAEAQTKLPDVEGHVIASCLAIICGAVVCAMGLLRLGFIVDFIPLPAISAFMTGSAINICSGQVKDMLGETADFSTKDSTYLVIINTLKHLPSAKIDAAMGVSALAMLYIIRSGCNYGAKKFPRHAKVWFFVSTLRTVFVILFYTMISAAVNLHRRSNPRFKLLGKVPRGFQHAAVPQVNSRIISAFASELPASIIVLLIEHIAISKSFGRVNNYTIDPSQELVAIGVSNLLGPFLGGYPATGSFSRTAIKSKAGVRTPLAGVITAVVVLLAIYALPAVFFYIPKASLAGVIIHAVGDLITPPNTVYQFWRVSPLDAIIFFIGVIVTVFTTIEIGIYCTVCVSVAILLFRVAKARGQFLGRVTIHSVIGDHLVQDDGKYGSANSPNAASDDKDELSRSIFLPINHTDGSNPDVEVQQPYPGIFIYRFSEGFNYPNANHYTDYLVQTIFKHTRRTNPFSYGKPGDRPWNNPGPRRGKSEDDESHLPLLQAVILDFSSVNNVDVTSVQNLIDVRNQLDLYASPKTVQWHFAHINNRWTKRALAAAGFGFPSPDSDEGFQRWKPIFSVAEIEGSASAAAHAEMVNNRHTQHNIKSEDLEHGLKHDSETTERETHGIEESSDASSTREDKLQRDLKDSKAYRSRRRVAMVQGLNRPFFHIDLTSALQSALANAGEQPDPKMNVLDA

SEQ ID NO: 49743 - protein, 190 aa, Treponema denticola ATCC 35405
MTIAKIRCRLFIMKDKIIDAAIRRVPDFPKKGILFYDITGILVNPEVFSYCLDKMTEMYKDKKVDAVAAIEARGFIFAAPFAYKMGIPLILIRKKGKLPGETYSASYDLEYGQASVEVHKTDVVKGQKVLLLDDLIATGGTLNAARSILEEGGAKVVGFCGVVGLPFLNYSKVLGDLPVKTLIEYDSEKI

SEQ ID NO: 49744 - protein, 175 aa, Oryza sativa Japonica Group
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKANPDAFVRIIGFDNVRQVQLISFIAYKPPGCEESGGN

SEQ ID NO: 49745 - protein, 301 aa, Zea mays
MASFFADDGADDLPRATSHPFDSDDFGAAAADDASAGGYASFADGGVEEVDEEITVESYGVPIRHVSGGYSPSPFSPDLEPNGSDGPTLPPPTEMGREEGILLREWRRKNAMELEKKEQKEKELRAQIIAEAEEFKKAFFEKRIQNCASNMVNNREREKIFVASQEKFHANADKQYWKSISDLIPHEIATIEKRGKKDKDKKPSVTVIQGPKPGKPTDLSRMRHILVKLKHAPPPHMLQPPPAPAAKEGAKDGSKEGGKDGGAKDGAAAPANDAKQPAESQETSTANGPSEAEKEQPAASE

SEQ ID NO: 49746 - protein, 391 aa, Thermotoga maritima MSB8
MAKVFLKRMNRRISGGHLWIFYNEILKVEGEYENGSVVDVFRPDGSFFGKGYINDNSKIRVRILTWKNEVIDRNFIKNRIESALKRKKKLVKETTAFRVVHSEGDFLPGLIVDLFGDYLVFQITTLGMEKMKDWILDSLVEIFKPKGIYEKSEGTFREKEGLDNREEWVYGKGPELIEFEMNGFKFLADTRGQKTGFFLDQRENARMVMDLAEGKVCLDVFSYTGNFAVHLLKGGAKHVTLVDYSERALEVAREILKLNGFDSSRYDLLPGNAFDILKSFDREGRKYDLVVLDPPSFAKSSSNLESARRGYKEINLRAMRILKKPGVLVTSSCTQIVSEELFREILFDASFDTKTSLTVLRRGGQPPDHPVLMNVPETQYLKFYILQVDKR

SEQ ID NO: 49747 - protein, 350 aa, Hyphomonas neptunium ATCC 15444
MKQTLLLLPGDGIGPEVVAQARRIAEALVPDVQIEEGLVGGASFDAHGTPLTDETLDRARKASAVLLGAVGGPRWTATARDKRPEAGLLALRKGLDVFANLRPAFCFPALVDASSLKKDRVEGLDLMIVRELTGGVYFGQPRGIDEEGGLRRGYDTAIYTHPEVERVARIAFDIARGRNGRVTSVEKSNVMESGLFWRQEVTLAHAELGAGVELAHMYADACAMELVRAPKQFDVILADNLFGDILSDAAAMLTGSIGMLPSASLGAPGTPGLYEPVHGSAPDIAGQGIANPCAAILSLEMALRWSLGKEKAADTLLAAVGKALDRGARTRDLGGDLSTRAMADAVLNAL

SEQ ID NO: 49748 - protein, 505 aa, Polaromonas sp. JS666
MSTLRRIAGQCPSPDTSQIPSCQDPNLMTYPNTQLFIAGEWQEAADGRSLAVFNPATGKEIGRVAHAAKVDLDRALAAAQQGFETWRKVPAFERSKIMRRAAGLMRERAGEIAAVLTQEQGKPLAEAKVEAMAAADIIEWFAEEGFRVYGRVVPSRNLATRQLVLKDPVGPVAAFTPWNFPINQAVRKLSAALATGCSIIVKAPEETPAGPAALIQAFADAGIPAGVIGLVYGNPAEISGYLIPHPVIRKITFTGSTPVGKQLAALAGQHMKRVTMELGGHAPVIVAEDADVELAVKAAGGAKFRNAGQVCISPTRFLVHESIRNDFAAALVKHAQGLKVGDGLGEGIQMGPLANPRRLTAMAEFTQDAVQRGAKVAAGGERIGDLGNFWAPTVLTDVPLDAKVFNDEPFGPMAAIRSFNTLDEAIAEANRLPFGLAGYAFTRSLKNAHALSQHVEVGMLWINQPAAPWPEMPFGGVKDSGYGSEGGPEALEAYLNTRAVSIMNV

SEQ ID NO: 49749 - protein, 372 aa, Catharanthus roseus
MADKENCIRVTRLAKKRAVEAMAASEQQRPSKKRVVLGELKNLSSNISSIQTYDFSSGPQKQQKNKNKRKAKESLGFEVKEKKVEEAGIDVFSQSDDPQMCGAYVSDIYEYLHKMEMETKRRPLPDYLDKVQKDVTANMRGVLIDWLVEVAEEYKLLPDTLYLTVSYIDRFLSMNALSRQKLQLLGVSSMLIASKYEEISPPHVEDFCYITDNTYKKEEVVKMEADVLKFLKFEMGNPTIKTFLRRLTRVVQDGDKNPNLQFEFLGYYLAELSLLDYGCVKFLPSLIASSVIFLSRFTLQPKVHPWNSLLQHNSGYKPADLKECVLIIHDLQLSKRGSSLVAVRDKYKQHKFKCVSTLTAPPSIPDEFFEDI

SEQ ID NO: 49750 - protein, 143 aa, Rhodopirellula baltica SH 1
MKVATFDTDRGTIRIELFDDKTPKTVENFETLCEKKYYDGLVFHRVIPNFMVQGGCPEGSGRGGPGYQFEDEFHPELKHDGPGVLSMANAGPNTNGSQFFITHEAQPHLDNRHSVFGKVIEGQDVVDAIEQGDTMKTVRVTEE

SEQ ID NO: 49751 - protein, 397 aa, Thermotoga maritima MSB8
MDVFSDRVLLTEESPIRKLVPFAEMAKKRGVRIHHLNIGQPDLKTPEVFFERIYENKPEVVYYSHSAGIWELREAFASYYKRRQRVDVKPENVLVTNGGSEAILFSFAVIANPGDEILVLEPFYANYNAFAKIAGVKLIPVTRRMEEGFAIPQNLESFINERTKGIVLSNPCNPTGVVYGKDEMRYLVEIAERHGLFLIVDEVYSEIVFRGEFASALSIESDKVVVIDSVSKKFSACGARVGCLITRNEELISHAMKLAQGRLAPPLLEQIGSVGLLNLDDSFFDFVRETYRERVETVLKKLEEHGLKRFTKPSGAFYITAELPVEDAEEFARWMLTDFNMDGETTMVAPLRGFYLTPGLGKKEIRIACVLEKDLLSRAIDVLMEGLKMFCSSRISC

SEQ ID NO: 49752 - protein, 515 aa, Magnaporthe grisea 70-15
MAFFFPSAPVWVYSAGAALLFIIGSIILNFIWQQLPRPKSEPPLVFHWLPFIGNAVSYGMDPYRFYSQCREKHGDVFTFVLFGRRMTVFLGVQGNDFILNGKLQDLNAEEIYSPLTTPVFGSDIIYDCPNSKLMEQKKFVKFGLTQKALDSYVPLIEREVLDYIESSPVFQAGNHGIVDIPSMMAEITIFTASRTLQGPEVRKKLTGEFARLYHDLDLGFRPINFLAPWAPLPQNRRRDVAHARMRDVYMDLINKRRRQKDDQEEEEEAEPDMIRHLMGSCVYKNGQALPDKEIAHMMITLLMAGQHSSSSSSAWIMLRLASRPDIAEEVYQEVQRLGHASLQHSDLDKLPLLANVVKETLRVHSSIHSIMRKVKRPMRIPGSDYVVTPGKVLVSAPIMTHLDEEHFRDARAWEPHRWDDAVDAQDDEIVDYGYGATSKGTKSPYLPFGAGRHRCIGEKFAYLNLAAIVSTLVRNFKFSTLDGKATVPPTDYTSMFSRPMQPATVRWERRSPKTA

SEQ ID NO: 49753 - protein, 426 aa, Pseudomonas syringae pv. syringae B728a
MSKTNESLMQRRHAAVPRGVGQIHPIFAASAKNATVTDVEGREFIDFAGGIAVLNTGHLHPKIIAAVQEQLTKLSHTCFQVLAYEPYVELCEKINAKVPGDFDKKTLLVTTGSEAVENAVKIARAATGRAGVIAFTGAYHGRTMMTLGLTGKVVPYSAGMGLMPGGIFRALYPCELHGVSVDDSIASIERIFKNDAEPKDIAAIIIEPVQGEGGFYVAPKAFMLRLRELCDKHGILLIADEVQTGAGRTGTFFAMEQMGVAADLTTFAKSIAGGFPLAGVCGKAEYMDAIAPGGLGGTYAGSPVACAAALAVLDIFEEEHLLERCKAVGEQLVTSLKAMQAKYPVIGEVRALGAMIAVELFEDGDSHKPNAAAVAQVVAKARDKGLILLSCGTYGNVLRVLVPLTAEDELLKRGLAILDECFAEIA

SEQ ID NO: 49754 - protein, 210 aa, Zea mays
MTSVWKTKVLPGLNKIFDKDGKKAAAAGFLKSFNKEEFDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKEEPAAEATSREVAVEEKKEEAEPAAATEAAPAPAETPSEEAVVEEKKEEEKKEEEDKPAAEEAAPPAAAAAAEEK

SEQ ID NO: 49755 - protein, 480 aa, Pseudomonas syringae pv. syringae B728a
MQLKDSTLFRQQAYINGQWLDADGGQSIKVNNPANNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGAELTGNPIVRKLSFTGSTDIGRQLMAECAKDIKKVSLELGGNAPFIVFDDADLDKAVEGAMISKYRNNGQTCVCANRIYVQDAVYDAFAEKLKAAVGKLKIGNGLEEGVTTGPLIDDKAVAKVKEHIADAVSKGATVLTGGNSLEGSFFEPTILVNVSKDAAVAREETFGPLAPLFRFKDEAEVIAMANDTEFGLASYFYAQNMSRVFRVAEALEYGMVGINTGLISNELAPFGGIKSSGLGREGSKYGIEDYLEIKYLCLSV

SEQ ID NO: 49756 - protein, 424 aa, Mesorhizobium loti MAFF303099
MTAIIDIVGREILDSRGNPTVEVDVVLEDGSMGRAAVPSGASTGAHEAVELRDGGARYLGKGVLKAVEAVNGELFEAIGGMEAENQIHIDQTMIELDGTPNKSRLGANAILGVSLAVAKAAADAAGLPLYRYVGGTKAHILPVPMMNIINGGAHADNPIDFQEFMILPVGAPTLREGVRWGSEIFHTLRKKLKDAGHNTNVGDEGGFAPNLKSAPVALDFIMESIEKAGFKPGEEIALGLDCAATEFFKDGNYVYEGEKKTRDPKAQAKYLAKLAADYPIVSIEDGLAEDDWEGWKYLTDLIGKKTQLVGDDLFVTNTARLRDGIRMGVANSILVKVNQIGSLTETLDAVETAHKAGYTAVMSHRSGETEDSTIADLAVATNCGQIKTGSLSRSDRMAKYNQLIRIEEELGKQARYAGKSVIKG

SEQ ID NO: 49757 - protein, 198 aa, Mesorhizobium loti MAFF303099
MIVSYAGHSPAIDTDAWVAPDATVCGDVVIGAGSRVMHGARLVAEAGGSIRIGRDCIVLENAVIRATASHPCTMGNHCLVGPNSHVVGAEIGDEVFIATGAAVFHGAHIGRGSEVRINGIVHLRTRLEPGMVVPIGWIAVGDPAQILPPDQHEAIWSHQKPLDFPGFVYGVERDSPDIMRKITANLSAALGVHRTESA

SEQ ID NO: 49758 - protein, 514 aa, Oryza sativa Japonica Group
MYKNQLQELAQRSCFNLPAYTCLREGPDHAPRFKAAVNFNGEQFESPGFFTTLRQAEHAAAEVALAALARRGPSYSLAARILDETGVYKNLLQEVAQRVGAPLPSYTTERSGLGHLPVFTCTVELAGITFTGDPAKNKKQAEKNAASAAWSSLRQLVRQEASSSNEPESNDEQEQIRIARALLNYRLKEKMAMANNPHASPFPKKFPMQPERRTAFPQSSHSSYSKILPLFRPKSNSRSRPESPAASDAASQTPFRPTESPNPRSRFPAAEAAPYVPVGHFRMPCHSMAPPVTVRTSIPVFSAPPLPPPGARTQQLPPLMSHPPPIRMASPVRIRPAPPLFTPSAVQGPKPMMPVQIKDVQHQQIKETRSPVMPVQVKDAQNQLLKGSLSPVIPVQIKDVQSQPPKEALSPAIPVQIKDVQLQPRNEPVSIGKGVVPLPAIRPPVKVEAPAEVKEASQPVAGSSVVQCKADTSPDSLPKTQLKTANADNADAKDDHLPVDAEEVEDIIRHLELK

SEQ ID NO: 49759 - protein, 498 aa, Brucella melitensis 16M
MKHTGSAGSSSIDAGSPDIRGARLPAGDYAHVFDDLHPPLSPHEAIVESDRCYFCYDAPCMNACPTGIDIPLFIRQINAGNPAGAARTILAENILGGMCARVCPTETLCEEVCVREVAEGKPVKIGHLQRYATDMLMATGNHPFTRAAETGRHIAVVGAGPAGISAAHRLAMHGHQVTIFEARPKGGGLNEYGIAAYKTVNNFAQRELDFVLQIGGIHIEYNQTLGQDITVEALKAGYDAVFLAMGLPGVNDLGLAGEDAPNVLDAVDYIANLRQARNLSTLPVGRDIVVIGGGMTAIDVAIQTKKLGANNVTIVYRRGQESMNASAYEQELAQIHGVVIRHWLQPHALERSEDGIVHAITFEYTANRDGKLVGTGEYLTLDADQVFKAIGQTFDPEPLRGSGIALAKGRISVDAEGRTSVEGIWAGGDCVAGGKDLTVASVEDGKVAALSIHAALTSRPEAVEGFAEAVLSGAAHHAPAAPSRHATVQPGSEQGLGD

SEQ ID NO: 49760 - protein, 100 aa, Triticum aestivum
MGSGSFLKLLANNFDVLAGPLVSLAYPLYASVRAIETKSPVDDQQWLTYWVLYSFITLFELTFAPLIEWLPFWSYAKLFFNCWLVLPCFHGAAYVYDHFV

SEQ ID NO: 49761 - protein, 442 aa, Silicibacter sp. TM1040
MMKSIQALSQELANTRLAAPMGRVTGISGGEIEVSGLESQARIGDRLTLRRGKKDDLHGEVLAIGSDHIRMLPDTAPERASIGDAVLLFQTPEFAPDDSWVGRVIDPFGEPLDGKPMLRGVESRDLMESPPKAAARRGLGKRLSTGLAILNTVLPIVTGQRIGLFAGSGVGKSTLMAQLAQNMEADVVVMALIGERGREVNHFVKEVLGPEGMKRAVVVAATSDQSALVRRRCAWAAMSVAEHFRDQGLNVLFMADSITRFAEAHREIAVASGEAPALRGFPPSVTPLITGLCERAGPGLEGQGDITAVFSVLVAGSDMDEPIADILRGVLDGHIVLNREIAERGRFPAIDVSRSVSRSLPAAATKEENEMILAVRKFLGAYEQSEVMIRAGLYSEGNDLVLDQAVKIWPELDSFFGRNELDGIKGSFNRLALLLRRAGGGR

SEQ ID NO: 49762 - protein, 446 aa, Silicibacter pomeroyi DSS-3
MQAKNWLRKNPQVRTIRVAAADLNGQPRGKRVPGRFADKAIEGGTRFPLSVMNLDIWGEDIEDSPLVLASGDRDGVLQPTERGFMPMPWLDTPTGLLPIWMFHEDGRPYEGDPRHALNTVVKRYKARGLKPVVAVELEFFLIDDSGRHLQVPQSPRSGKRRKAGEILSLRALDQFDHFFTELYDACEVMDIPADTAISEAGVGQFEINLMHQDDALRAADDAWLFKMLVKGLARKHGFAASFMAKPYEDYAGSGMHMHFSVLDEDGNNVFDDGTERGSDTMLHAVRGCLDAMSGSTLIFAPHDNSYARLVPNAHAPTGVAWAYENRTAAIRIPSGSPVARRIEHRVAGGDVNPYLMIAAVLGAALNGIEDGQMPPQPISGNAYKANLAQIPDRWDTAIDAFESDPAVARIFAPELIRNFVMTKRQEFRYFQELTEKEKTEVYLDTV

SEQ ID NO: 49763 - protein, 296 aa, Saccharophagus degradans 2-40
MSGKKLLFIGYGDIAGRTSRQLATNGYSITGIARTPRQLPEGVSQWLGSAQDAEILNKISQTAFDTVVITLTPAARSDEGYKAGYVDPLQALSNAWQASNTPPKCVIFVSSTSVYGQNEDEWVDETSTCKPTNYSGQRILEAEKLALSLAENGTTTSCIVRFSGIYGPGRDQLLRQVLAGKAGTEAYTNRIHADDCAGVLAHLIQLHASGQQLASHYLASDCEPVTAKAARQWLGKQLGLPETHLKRDPTAKTRAGSKRCNNKRILESGYSFIYSSYREGYKDIIATFKQQAQSQQ

SEQ ID NO: 49764 - protein, 803 aa, Catharanthus roseus
MRILIQEMLIRTLFFFYLIISSLEFTPENNYLINCGSFNDTSIDDRIFLADNLNSTVLSTPETIFANSSNSNSVLDLYKSARIFNGSSQYNFSINKKGWHWIRLHFFPFPISNEKFNLSSAKFSVFAQNFTLLKDFQPLNNVPVVKEFSLNVNSNNLLLKFTPSRNSLAFLNGLEVISLPDELIPFSIGNQNLEKNALETVVRVNMGNVTVSSKDDPLGRIWLSDYNYLSNVNLVVFVSNIHLVNYTKGEEKVSENIGPSSVYGTGTKLHSVFDPNTQINATWLFNVDSGFGYFIRFHFCNLLNPIPNNNFFFNVFLNSEFVVKDLNLSTSGAPMYKDVVVVTNVVPQIRISVGPSNVRNSYPDGILNGLEIMKISTSDGSLAAVDADFPSSSSSSKLKVWIIVSLAIGISLILVVFTVVFLFRRRKRHVMIHSTPDHLTEEDDSNSSIFSRSKIGYRFPLAVVQEATDNFSENRVIGIGGFGKVYKGVFKDGTKVAVKRGISCSSSKQGLSEFRTEVELLSQFRHRHLVSLIGYCDEKNEMIIIYEFMENGTLRDHLYGSDKPKLNWRKRVEICIGSAKGLHYLHTGTMKRIIHRDVKSANILLDENLMAKVADFGVSKTGPDHFDQTHVSTAVKGSFGYLDPEYLTMQKLTEKSDVYSFGVVMLEILTGRPVIDPSKPREMVNLVEWAMKCSRKGEEIVDSDIVNEVRPESLIKFQETAEKCLAERGVDRPTMGDVLWNLECALQLQGKQKENEQPEEMRDVSATEISLGSMADLAAVSMSKVFSELVKAQGTRSEFGSAP

SEQ ID NO: 49765 - protein, 637 aa, Oryza sativa Japonica Group
MDEEDYSWVRRTRFSHSVVRSKSGREQFGAFVEQFNRGAARRQRGPGSGFMLHGLNLEPRARLPATTSANSSVPRTTGSSNAQPSSETKPASSSSDAKLEQHEKSLNLEPRTRLSATTSANSSVPWTTGSSNAQPLSETKTASSSSDAKPEQQEKPRDHQPSQEVSTKQDDKAENDTKATATSGPLEFSFHPDEQTLRLQRACSSPVPFPSNKNMLVADAAARSSSLKVAGEGPKPKPKQRARSPPLRRDVPELFKEAKSSSKRFSTPPPRRKPSSPPAPSRSPPHVFATARAHGKPKHKKDSSANGRAKVAALEVLEKWTVDRSQLLIGHRFASGAHSRLFHGIYKEQPVAVKFIRQPEDEEDAELAAQLEKQFNTEVTTLSRLNHPNVIKLIGACSSPPVFCVITEFLSGGSLRTFLHKQEHKSLPLEKIISIGLDIANGIGYIHSQGVVHRDVKPENIIFDSEFCAKIVDFGISCEEAECDPLANDTGTFRWMAPEMMKHKPYGRKVDVYSFGLILWEMFTGSVPYEDLNPFQAAFAVFDKNERPVIPSSCPAPLRLLIEQCWASQPDKRPEFWQIVQILDKFKAVLDKDGTLDNMPCLNLQGTHDHKNWLAHWVQKLKHTHHDLSGPPPPKLM

SEQ ID NO: 49766 - protein, 196 aa, Streptococcus pyogenes M1 GAS
MIPVVIEQTSRGERSYDIYSRLLKDRIIMLTGPVEDNMANSVIAQLLFLDAQDNTKDIYLYVNTPGGSVSAGLAIVDTMNFIKADVQTIVMGMAASMGTVIASSGTKGKRFMLPNAEYMIHQPMGGTGGGTQQTDMAIAAEHLLKTRHRLEKILAQNAGKTIKQIHKDAERDYWMSAEETLAYGFIDEIMENNELK

SEQ ID NO: 49767 - protein, 225 aa, Arabidopsis thaliana
MMNSIFGKRKTPAELLRENKRMLDKSIREIERERQGLQTQEKKLINEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSGAVAVPAAKNKVVQAEATGAEDSGGIDSDLQARLDNLRKM

SEQ ID NO: 49768 - protein, 342 aa, Pfiesteria piscicida
MPGREATPPSRSLAHLPLACYYIAGGIGDTCAALVSHPFDTVKVRQQVSGELDIRSRRAPQGLGALVQTFRAIVVADGVFGLYQGLSASVLRQSVFSTLRHGGYATCAVALAGYHLEAPARDTAKLPPHPSLALNAWQAVGCGVLAGSLAAFIANPFDIALIRMQADGHWPPQQRRNYRSGLHAVGTIASAEGAARLWRGCGPTVSRAALITATQLPTYHAAKASLLRAAPGCWKGGDDPKLHLSASLASAACATLATCPVDVIKTRIMNMQRADAGGAQYSSALDRAVRTARTEGVLGLYKGLLPTFARLAPHTVVLWQVQELVLRTLWASVLRHHDAAAA

SEQ ID NO: 49769 - protein, 125 aa, Oryza sativa Japonica Group
MDSYDSPNRWVIEVTGAAGTLYAGETYQLQVDFPEHYPMEAPQVIFLNPAPMHPHIYSNGHICLDILYDSWSPAMTVSSVCISILSMLSSSPAKQRPQDNDRYVRNCRNGRSPKETRWWFHDDKV

SEQ ID NO: 49770 - protein, 321 aa, Staphylococcus aureus subsp. aureus COL
MLNNEYKNSSLKIFSLKGNEALAQEVADQVGIELGKCSVKRFSDGEIQINIEESIRGCDVFIIQPTSYPVNLHLMELLIMIDACKRASAATINIVVPYYGYARQDRKARSRKPITAKLVANLIETAGATRMIALDLHAPQIQGFFDIPIDHLMGVPILAKHFKDDPNINPEECVVVSPDHGGVTRARKLADILKTPIAIIDKRRPRPNVAEVMNIVGEIEGRTAIIIDDIIDTAGTITLAAQALKDKGAKEVYACCTHPVLSGPAKERIENSAIKELIVTNSIHLDEDRKPSNTKELSVAGLIAQAIIRVYERESVSVLFD

SEQ ID NO: 49771 - protein, 342 aa, Pfiesteria piscicida
MPGREATPPSRSLAHLPLACYYIAGGIGDTCAALVSHPFDTVKVRQQVSGELDIRSRRAPQGLGALVQTFRAIVVADGVFGLYQGLSASVLRQSVFSTLRHGGYATCAVALAGYHLEAPARDTAKLPPHPSLALNAWQAVGCGVLAGSLAAFIANPFDIAPIRMQADGHWPPQQRRNYRSGLHAVGTIASAEGAARLWRGCGPTVSRATLITATQLPTYHAAKASLLRAAPGCWKGGDDPKLHLSASLASAACATLATCPVDVIKTRIMNMQRADAGGAQYSSALDCAVRTARTEGVLGLYKGLLPTFARLAPHTVVLWQVQELVLRTLWASVLRHHDAAAA

SEQ ID NO: 49772 - protein, 159 aa, Crocosphaera watsonii WH 8501
MNIRIGNGYDIHRLVPDRPLILGGVNIPHDLGLLGHSDADALTHAIMDAMLGALSLGDIGHYFPPSDPKWAGADSLLLLQQVDQLIKARGWHTGNIDSVIVAEKPKMKPHLGAMQEKIARTLQINRDHIGIKATTNEKLGPVGRQEGIAVYAVVLLFRG

SEQ ID NO: 49773 - protein, 112 aa, Triticum aestivum
  misc_feature (39)..(39): Xaa can be any naturally occurring amino acid
  misc_feature (47)..(47): Xaa can be any naturally occurring amino acid
  misc_feature (55)..(55): Xaa can be any naturally occurring amino acid
  misc_feature (87)..(87): Xaa can be any naturally occurring amino acid
  misc_feature (100)..(100): Xaa can be any naturally occurring amino acid
MAVSELEVDGVVFPPLARPPGSEHAHFLAGAGVRGMEIXGNFIKFTXIGVYLQGXPAVSALAAKWGGKPAADLASDAASSGDVVTGXFEKFTKVTMILPXEGARNRKDGTAS

SEQ ID NO: 49774 - protein, 313 aa, Rhodobacter sphaeroides 2.4.1
MLDWTDRHCRFFHRLMTRRAMLYTEMVTAPAVIHGPRDRLLGFSEAEHPVALQLGGSDPAELAQAVRLAEPYGYDEINLNVGCPSDRVQSGCFGAVLMERPSLVADCVAAMIAESPVPVTVKCRIGVDEQEPSEVLPAFLETVAAAGVRHFVIHARKAWLQGLSPRENREIPPLDYPLVIAMKRRFPELTICLNGGVGSLTQAEALLAQGLDGIMIGRAAYNEPELLLEADRLWGEEPPRDLAAVLADMRPYISAHLEGGGRLHQITRHMLGLFAGRPGARHWRRILSEGAARPGAGLALFDEALEAVQPRAA

SEQ ID NO: 49775 - protein, 436 aa, Catharanthus roseus
MATRNVVQVPQQNRDAAPAGMKQKNMAGEGKIRRALGDIGNLVTVRGVEGKPLPQVSRPITRSFCAQLLANAQAAAVAENNKKCKAVNVDGAADGGIIPKGARKPAQKKAATIKPKPEAVIEISSDSEQVKKEKKPSKKDAPTLTSTLTARSKAACGLSKKPKDQIIDIDAADADNELAVVEYVEDIYKFYKIAENESRVHNYMDSQPEINDKMRAILIDWLIEVHHKFELNPETLYLTINIVDRYLAVQTTLRKELQLVGMSAMLIASKYEEIWAPEVNDFVCISDRAYSHQQVLVMEKRILGGLEWNLTVPTPYVFLVRFIKASVPDSNMENMVYFFAELGMMNYSVAMMYCSSMIAASAVYAARCTFNKTPSWDDTLKLHTGFSEYQLIDCAKVLVNLHAMAADNKLKVIFRKYSSLERGSVALLPPAKSLLA

SEQ ID NO: 49776 - protein, 205 aa, Sinorhizobium meliloti 1021
MREAMQLVPMVVEQSSRGERSFDIYSRLLRERIIFLNGEVNDAVSALVCAQLLFLEAESPKKPIQLYINSPGGVVTSGFAMYDTMRYIRAPVHTLCMGTARSMGSFLLMAGEAGERTALPNASILVHQPSGGFQGQASDMLIHAEEIRRTKHRMTRLYAEHCGRTYEEFERAMDRDRFMTAEEALEWGLIDRIITEREIGAERDA

SEQ ID NO: 49777 - protein, 306 aa, Catharanthus roseus
MADKENCIRVTRLAKKRAVEAMAASEQQRPSKKRVVLGELKNLSSNISSIQTYDFSSGPQKQQKNKNKRKAKESLGFEVKEKKVEEAGIDVFSQSDDPQMCGAYVSDIYEYLHKMEMETKRRPLPDYLDKVQKDVTANMRGVLIDWLVEVAEEYKLLPDTLYLTVSYIDRFLSMNALSRQKLQLLGVSSMLIASKYEEISPPHVEDFCYITDNTYKKEEVVKMEADVLKFLKFEMGNPTIKTFLRRLTRVVQDGDKNPNLQFEFLGYYLAELSLLDYGCVKFLPSLIASSVIFLSRFTLQPKVHPW

SEQ ID NO: 49778 - protein, 190 aa, Ostreococcus tauri
  misc_feature (190)..(190): Xaa can be any naturally occurring amino acid
MVVRKKFSHSHRAPTRRSPHMSARVAPSRPMPRHRRVAPTATSTRAPAVTPSLPSLARDVERRRREDAAPNVVRVLENEIIVVDDALSRATCEEIIRTIEDGNGFAHATSRGPKYGEAWRSNGRYAREDETFARALWDAVDGKRTFEFELDDASGFNPNIRVYKYAGDTGDHFGPHVDERVTVRGRRSGX

SEQ ID NO: 49779 - protein, 386 aa, Aspergillus flavus
MTGLDMEIIFAKIKEEYARTDDVGKRKIQGHIRELQVGFYSDWDVVMRLSSGPLQVALAKVGIDLGIFRSLKKSDTPITLAEFVKKTGASPRLLGRILRTQAAFGLIKETGPQEYTSSAFTDVFANPAAAGAVVQLFDISGPCTQILPDFLAERHYQDITSNKDCVFQKAFDSDLTMFEWMPQHPKHMESLGHLMALERPVSWVDHFPVLEELGDFPAPDKVLMVDIGGGFGQQSKALRAKFPNIPGRVIVQDIPQTLANAQPAAGVEFMEHNFFEPQPIRNAKFYYLRHVFHDWPDEQCVLILKQIIPVMGPESQILIDEMVIPSTGVPWQAAFTDLLMMNSLGGVERTRAEWDDLMKQAGLEIIQSKVYDSKEQTILVAVPRRT

SEQ ID NO: 49780 - protein, 869 aa, Ostreococcus tauri
MALTETTTRTTTTARASDDRALEGDDSDARDGRGVEGRLAALEAAAVAVETNLVADEAAVERRARARDGREAREDGLREALRAKERAIESLGVSLMSTRESYERRLRVETEASAATARREESLRDDVRALSERVRSLETKAETREQKISSQEDVIQRMSRELEAKRSFDVEVAEHARTIEMDRLAERLRASDERAAALEAKLQLTCVEKSSLEREIEILRERLANTPTQAAMDDAYRFRVELDAEAKIANERLAFEEKQTKAELAQLFTQIKEMTLRSAGATAPVVRDSRESVDAELRRAKQDAEAEIESRRAEFRKLQSEILRDNARLHRELAALRGELDDKLRESSPGRAAPPSSAERSDVASPWAADFTFPLARDSPCFACNFTIDRYHRSTRRVERVSRLRAAHCAMRPFSTDTDTLVSMNNREFIVAALQGDEDSGPFRIDGRAPGEVRGGGDTFENQIEISFGPLDGVCVVRLGHTLACATTTGQLERPASAGASAEGSLRVDVEFSSGACTGFARDGRASRETRQRSRDLGMLLERGLKDGRAVDVESLCVLAGKRTWAITCSVTILAHDGNLAGVASLAACGSLMTYRRPECSVDPNSGIVTVHSVDAREAIALNMHHFPIASTYCFFDEAPGLAVADPTLEEEITADGSVVCVVNSLEEVCAVSTSGNGVSGEDVKQCVSASVNTAMKWTEVLKAAAADFEAARLANKVRTHYDGYKDAPDDDHLLDLFYKPGRDDIEFVDDDAEETPQSDSAEDEDSDDDERGEDIDNEAAIDDDAVVTERVSTKKTKKKTSEPPKDESDEETRFREDDDIDALFDKAEKKKKKKLASWDDLPGDGESLADAVKPRKKLKKTSTKSGKK

SEQ ID NO: 49781 - protein, 481 aa, Mesorhizobium loti MAFF303099
MAENYDVIIIGSGPGGYVTAVRSAQLGFKTAIVEREHLGGICLNWGCIPTKALLRSAEIMHYSDHLKDYGLKLDGKVSVDTSAVVDRSRKVSLRLNGGVAFLMKKNKVDVIWGEAKLSKPGEVVVSKTAKTPMEPQPPVPKGVKGEGTYTAKHIILATGARPRALPGIEPDGKLIWTYFEAMVPKEMPKSLLVMGSGAIGIEFASFYRTMGADVTVVELLPAVMPVEDAEVSKFAQKQFEKQGMKIILEAKVTKVEKGANSVTAHVEMKDGKVEKITADRMISAVGVQGNIENLGLEALGVKTDRGCIVVDGYGKTNVPGIYAIGDVAGPPMLAHKAEHEGVVCVEKIAGFPGVHAIDKLKIPGCTYCNPQVASVGLTEAKAKAEGKDIRVGRFQFAANGKAIALGEDQGFIKTIFDKKTGQLLGAHMVGAEVTELIQGFVVAMNLETTEEELMHTIFPHPTLSEMMKESVLDAYGRALNA

SEQ ID NO: 49782 - protein, 136 aa, Glycine max
  misc_feature (121)..(121): Xaa can be any naturally occurring amino acid
ASSLISSPAATTVNRAGAGLVAPFTGLKSMAGFPTRKTNNDITSIASNGGRVRCMQVWPPIGKKKFETLSYLPYLDDAQLAKEVEYRVKKRLMPYLEFEVKHDCVYREHNRSPRCYNRLYXTMIKLAMFSCTEACQ

SEQ ID NO: 49783 - protein, 454 aa, Rhodopirellula baltica SH 1
MFRLSRSTSISDSATNTVERLESEVRGYCRLFPSVFQTAKGSTLMTAEGRQFIDFFCGAGSLNYGHNPPAVKQALLDYVSHDGIQHSLDMMTEAKAQFLDRFEQTILRPRSMDYKIQFTGPTGTNAVEAAIKLAKQHRKRSHVVAFTNAYHGHSLGSLSLTGNQSYHSEYYGSHNNVSFLPYDGYLGDFDTTILLEKMLTDRSSGMPLPAAVVLETIQGEGGIHVANDAWLQRVQTLCREHDVLLIVDDIQVGNGRTGEFFSFEKAGLSPDLICLSKSIGGGLPLSLVMIRPECDVWQPGQHTGTFRGNNLAFVAANAVLNHWNEGSFVDGIQVRSNTLQAFLSSIVSEHVSENWDLRGRGMIWGLDVRRGDLARKVIDTAFQNGLLLESCGSDDEVLKFIPALNIPEQQLQQGLQLFRQSLQTVFPNPSATTPTLIPSTGSPVTSFGSSMVVS

SEQ ID NO: 49784 - protein, 407 aa, Mesorhizobium loti MAFF303099
MTEASENASATGGVAVVIVAAGRGARAGQANGPKQYQNIGGRAVIAHTLEIFLAHPRTDRIVVAIHADDHELFRQAAGSQAERVTAIIGGPTRQESVRLGLLALKEHAPGQVLIHDAVRPFVDADLIDRTISAIGENEGALPALPVADTLKRESAAGVVAETVSRSGLHAAQTPQGFPYGPILAAHDKAFQLGRLDFTDDAAIAEWAHIPVKLVPGSPDNVKLTWARDIAMAHQRLSSERTHFPDIRTGNGYDVHAFEPGDHVTLCGVAIPHDKKLSGHSDADVGLHALTDALLATCGAGDIGTHFPPSDPQWKGAASRIFVEHAAKVVRQRGGRIANADITLICEAPRVGPHREAMTAALSRMLGISADRISIKATTNEKLGFVGREEGIAAIATASVVFPGEVPE

SEQ ID NO: 49785 - protein, 378 aa, Bacillus subtilis subsp. subtilis str. 168
MKAVTYQGIKNVVVKDVPDPKIEKSDDMIIKVTSTAICGSDLHLIHGFIPNMQEDYVTGHEPMGIVEEVGSGVTKLKKGDRVIIPFNIACGECFFCKNQLESQCDQSNDNGEMGAYFGYSGQTGGYPGGQAEYLRVPFANFTHFKIPESCEEPDEKLSVIADAMTTGFWSVDNAGVKKGDTVIVLGCGPVGLFAQKFCWLKGAKRVIAVDYVNYRLQHAKRTNKVEIVNFEDHENTGNYLKEITKGGADVVIDAVGMDGKMSDLEFLASGLKLHGGTMSALVIASQAVRKGGTIQITGVYGGRYNGFPLGDIMQRNVNIRSGQAPVIHYMPYMFELVSTGKIDPGDVVSHVLPLSEAKHGYDIFDSKMDDCIKVVLKP

SEQ ID NO: 49786 - protein, 315 aa, Escherichia coli W3110 [sequence omitted]

SEQ ID NO: 49787 - protein, 239 aa, Streptomyces avermitilis MA-4680
MTDRKDQLAANLAKVEDRIAAACAAAGRGREEVTLIVVTKTYPAIDVRILSELGVRDVAENKDQDAAPKAAECSDLPLKWHFVGQLQTNKVRSVVGYADVVQSVDRPKLVTALSKEAVRAGREVGCLIQVALDAQEYGRGERGGVGPGGLEELGDLVAEAPGLRLDGLMTVAPLTGEYAGRQRAAFDRLMDLSTDLRRAHPAANMVSAGMSADLEEAVAAGATHVRVGTAVLGVRPRLG

SEQ ID NO: 49788 - protein, 313 aa, Staphylococcus epidermidis ATCC 12228
MTKVYFNHDGGVDDLVSLFLLLQMENIELVGVSTIGADCYLEPSLSASLKIINRFSDVEINVAPSYERGKNPFPKEWRMHAFFMDALPVLNESCIPKRCKASEDEAYIDIIRKVKSCDEKVTLLFTGPLTDLAKAIKYDNSILKNIEKLVWMGGTFLDKGNVEEPEHDGTAEWNAFWDPEAVKVVLDSDMNVDIVALESTNQVPLTMEVRQMWADKRQYLGVDFLGTSYAAVPPLTHFVTNSTYFLWDVLTTAYVGSPNLVESTKLKIDVVSQGPSQGRTFQSEYGREVQIITDVNKQAFFNYITDLAKKIES

SEQ ID NO: 49789 - protein, 440 aa, Staphylococcus aureus subsp. aureus COL
MKTYDLIVIGFGKAGKTLAKYAASTGQHVAVIEQSPKMYGGTCINIGCIPSKTLVHDGLEGKSFEASYNRKNDVVNALNNKNYHLLADDNNIDVLDFKAQFKSNTEVNLLDQHDDIVDSITAPHIIINTGATSVIPNIKGLDQAKHVFDSTGLLNISYQPKHLVIVGGGYIALEFASMFANLGSKVTVLERGESFMPREDQDVVAYGITDLENKGIALHTNVETTELSSDNHHTTVHTNVDNFEADAVLLAIGRKPNTDLALENTDIELGDRGEIKVNAHLQTTVPHIYAAGDVKGGLQFTYISLDDYRIIKSALYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 49790 - protein, 198 aa, Oryza sativa Indica Group
MADYVYGPGRNHLFVPGPVNIPDQVIRAMSRQNEDYRSPAVPALTKTLLEDVKQIFKTTTGTPFLFPTTGTGAWESALTNTLSPGDKIVSFLIGQFSLLWIDQQQRLNFNVDVVESDWGYGADLAALDYKLRQDPSHSIKAICIVHNETATGVTNDLSAVRKILDKHRHPALLLVDGVSSICALDFRMDEWGVDVALT

SEQ ID NO: 49791 - protein, 466 aa, Carboxydothermus hydrogenoformans Z-2901
MNKKIRALLTCAVGLAIWFSPIPTGLDPKAWHLLAIFVATIIGFILQPLPIGAIAFISVTLSALTGILDAKAALAGFANSTIWLIVSAFIFAIGFVKTGLGLRIAYYLIRLLGDSTLKLGYTLVLSDLIISPATPSNTARAGGVLFPIVRSLAEAFGSKPGESPRKVGAYLMQTAYQGNAITSAMFLTSMAGNPLIALLALKTLKIDITWNLWAKAAIVPGIISILVIPYLLYKIYPPEIKKTPEAKEIAAKELVKMGPMKFEEKVLAIVFIGALILWATSQYTKIDATIVAMLGVSAMLVAKVIDWKDVLAEKGAWDTLVWMGVLVALAGNLSELGFIPWFAKNVGNMISGISWFWAFVILLVVYLYAHYGFASLTAHITAMYAAFASVAVAAGAPPYLVALSLAFMSNLCMSLTHYAAGPSPIYFGAGYVDQGTWWKLGFIVSIVNLFIWVGIGAVWWKALGLW

SEQ ID NO: 49792 - protein, 422 aa, Crocosphaera watsonii WH 8501
MTHTILPEKPTQSFDPQHFDTYVMHTYGRFPIAIERGEGCRLWDTNGKEYLDFVAGIATCTLGHGHPALVKSVSEQIRSLHHVSNLYYIPQQGELAQWMIENSCADKVFFCNSGAEANEAAIKLIRKYAHTVLDFLEQPVILTAKASFHGRTLATITATGQPKYQQDFEPLMPGFAYIPYNDIKAVEHAIADMDEGNRRVAAIMLEPLQGEGGVRPGEIDYFLRLRKICDENNILLVFDEVQVGVGRSGKLWGYENLGVEPDVLTSAKGLAGGVPIGAMMCKEFCNVLTPGTHASTFGGNPLASAAALTVLKTIEEDNILQNVQARGEQLRTRLRAIAQKDPTLFIDVRGWGLINGIEINEEMSITSIDIVKAAMDEGLLLAPAGPKVLRFVPPLIVTEEEINEAAEKLETAISEVCAAAVN

SEQ ID NO: 49793 - protein, 233 aa, Populus trichocarpa
MAMATNLYTSYSIIATKAHNNKSVSLSLQPGTYTTSHVKFTLPIQKRTGLSISAASTTATQVEGSATSSKASRILPFRVGHGFDLHRLEPGYPLIIGGIDVPHDRGCEAHSDGDVLLHCVADAILGALGLPDIGQIFPDSDPKWKGAPSSVFIKEAVRLMHEAGYEIGNLDATLILQRPKLSPHKESIRANLSELLGADPSVVNLKAKTHEKVDSLGENRSIAAHTVVLLMKK

SEQ ID NO: 49794 - protein, 238 aa, Frankia sp. CcI3
MVSTEIERVNGPGPGAPLGSGGSAGPDSAGSDSAGSGAVRADQPAAAPSPRVAETDGDQDTRDASDLGLWEILREDWRRHYKSFAHPGLHVLAVYRIGQWRRTRSQPVRGIVTVFYKVVNKLVIRNLYGAELDEQARIGRRVHIGHHQTILIPPHCVIGDDCTLRHNLTIGYASGTAGPRDVPKVGKRVELAPGVHLIGAISIGDDARIGPGSIVMTDVPAGSTVFAAPARVMRPPGR

SEQ ID NO: 49795 - protein, 290 aa, Populus trichocarpa
MHNRGWRSIYCVTKRDAFRGTAPINLTDRLHQVLRWATGSVEIFFSRNNALFATRRMKFLQRVAYFNCGMYPFTSMFLIVYCVLPAISLFSGQFIVQSLSVTFLVLLLAITITLCLLAILEIKWSGITLHDWWRNEQFWLIGGTSAHPAAVLQGLLKVIAGVDISFTLTSKSATPEDADDEFADLYVVKWSFLMVPPITIMMLNLIAIAVGVARTLYSPFPQWSRLVGGVFFSFWVLSHLYPFAKGLMGRRGRVPTIVYVWSGLLSIIISLLWVYISPPGTQDYMKFQIP

SEQ ID NO: 49796 - protein, 545 aa, Oryza sativa Japonica Group
MATDGGVLQLHPYAMAAAAVALASAYMVWFWALSRRLSGPRMWPLVGSLPSVVLNRARVHDWIADNLRATGDAATYQTCILPLPFLARRQGLVTVTCNPRNLEHILRARFDNYPKGPMWQASFHDLLGQGIFNSDGETWLIQRKTAALEFTTRTLRQAMARWANRSIKYRLWRILDDHCNAAASVDLQDLLLRLTFDNICGLTFGKDPETLSPGLPENPFANAFDEATEATMQRFLFPSLLWRIKKAFGVGSERSLRDSLAVVDRHMTETIAARKATPSDDLLSRFMKKRDSKGKAFPEDVLQWIALNFVLAGRDTSSVALSWFFWTLMQRRDVERKVVLEIASVLRETRGDDTARWTEEPLNFDELERLVYLKAALTETLRLYPSVPQDSKYVVADDVLPDGTVVPAGSAITYSIYSVGRMESIWGKDCAEFRPERWLSADGSRFEPVKDAYRFVAFNGGPRTCLGKDLAYLQMKSIASAVLLRNSVELVPGHKVEQKMSLTLFMKNGLRVHVKPRDIASYVEPSEPAPPQGSLVIPTTTAAAA

SEQ ID NO: 49797 - protein, 425 aa, Ostreococcus tauri
MFGRQGSGRKSDDTKLYDVLGVSKSATPAEIKKAYRKMAVKHHPDKGGDEHVFKEISAAYEVLSDENKRAMYDQYGEEALKDGGMGGGGGGSPFDIFEAMFGGNPFGGPGGGRGGGRSRVRKGEDVVHALNLSLEELYGGVTKKLSLSKNIICPKCDGKGSKSGASGTCNGCRGAGVKVVVRQIAPGMVQQMQTVCNDCRGTGQTISEKDKCEQCRAAKVVQEKKVLEVHIEKGMRHNQKIAFQGEADEAPDTVPGDIIFVVQQKDHAVFSRKGDDLFMEKEITLVEALCGMKMTVDHLDGRQLVVTTAEGEVIKPGQVKAVYDEGMPKAGNPFQKGRLFIHFTVKFPVSGDLSDDALAALEKLLPPRPELSINMESENVEEVTMHEVDMEQEKRRREHEHKHSRQYEDSDDEGAGGPGVQCAQQ

SEQ ID NO: 49798 - protein, 220 aa, Thermotoga maritima MSB8
MVKIAASILACDLARLADEVKRVEEHVDMIHFDVMDGHFVPNISFGLPVLKALRKETKLPISVHLMITNPEDYIDRFIEEGADMVAIHYESTFHLHRLVHRVKDLGARAFVAINPHTPINLLSEIITDVDGVLVMSVNPGFSGQRFIARSLEKIRNLRKMVKELGLETEIMVDGGVNEENASILVKNGATILVMGYGIFRNDNYVELIKSIKQEREEFAD

SEQ ID NO: 49799 - protein, 358 aa, Ostreococcus tauri
MRALAQRARVAAREPVRAWTHRPRSRSTTHAKRKGFAEFLRVGGVDADDARSWYNGRRPLRPGARTPMRRVPSEIAPVPPYARDGHLPAYDDGTWQLATTAADREGMRAAGRFAAEVLDMAELMIVPGVTTTDDIDVAVHEMIVARGAYPSPLNYGGFPKSVCTSLNECICHGIPDDTVIESGDIINIDVTVYLNGYHGDTSRTIMCGEVTDEVRRLVETTERALDAAIAVCGPNVPVRRIGATIHKIADEGKYGVVEKFVGHGVGKVFHSGPTVKHHRNNDPGELKVGTTFTIEPMLTIGTTRDKMWKDGWTSVTADGKWTAQCEHTLLVTETGVEILTASPLRAQRAADAAAKTTA

SEQ ID NO: 49800 - protein, 394 aa, Mesorhizobium loti MAFF303099
MFEDLQPAPADKILALIGLYRADPRPNKVDLGVGVYKDRDGKTPVMRAVREAEKRLLNSQDTKTYLGLAGDTGFNAVMAKLAFGPGADMTRIRAAQAPGGSGALRLVAELLKRTRSDATIWLSDPTWPNHMPVMRAAGLQIREYPYFDAASGAVRFDDMLAALRTAKSGDVVLLHGCCHNPTGANLDAAQWQAVTDLMVERGLLPFVDIAYQGFGDGLEADALGLRLLAAKVPEMVVASSCSKNFAVYRDRVGAAMVLARDSAQADVAMSQMLSAARAMYSMPPDHGAAAVRIVLEDASLRADWEAELEEMRLRMLRLRVAFAEALRRQSNSDRFDFVASHRGMFSRLGLTEAQVERLRAEHGVYMVGDSRINVAGLPEDGMDALAKAIVSVLD

SEQ ID NO: 49801 - protein, 465 aa, Silicibacter sp. TM1040
MTTITNHLPTAELQALDAAHHMHPFTANGGLAQKGARIITRAKGVTLTDSEGHEILDAMAGLWCVNIGYGRDELAEVAARQMRELPYYNTFFQTTHVPVIALAAKIAELAPDNLNNVFFAGSGSEANDTNIRMVRHYWAMKGKPTKSVIISRKNAYHGSSVGSGSLGGMSAMHAQGGLPIPDIHHINQPNWWAEGGNTDPEDFGLQRAQELEKAILELGEDRVAAFIAEPVQGAGGVIVPPASYWPEIQRICDKYEILLIADEVICGFGRTGNWFGSETMGIRPDIMTIAKGLSSGYAPIGGSIVSDEVAAVIAQDEFNHGYTYSGHPVAAAVALENLRILEEENVLDHVRNVAAPYLKEKWEALTAHPLVGEAKIVGMMGSIALTPNKATRAAFEAEAGTVGFICRERCFANNLVMRHVGDRMIISPPLVITPEEIDTLIARATKSLDECYTELQAQGLLKSAA

SEQ ID NO: 49802 - protein, 568 aa, Kluyveromyces lactis NRRL Y-1140
MTYDRNHLEHPGTRDLPKSFSGYAHHLVSQINKEITWNKTYDVTEESEEISENDGVVGVNEFDSTGESLVAKADDSGKKSGSKTSFRSNLHIYWPIFTTGSGLFSDGYINASIGTVSTCLAQIYGDQYSNSNAIQNVSSIAFVGIVLGQLSFGYIADYYSRRLAMLMGNIILIVFSILAAGAWGVGTTTTQAGGIFAAITAYRFFLGVGIGSEYPAGSTAAAEASALLPAKRRNRWFVWFTNFMIDWGFVIAAVVPLVLICIFGEHRLQWVWRLTMGLGAIPPFSLFLMRLKFKENKSFTSTKFNKMMPYGLIFKFYWFRTIIISIIWFLYNFSSYAFGIYSSLIIKNLLTNDSDEQVGLKESFAWNVLFNAFYLPGSFAGAIFADYIGPRLTLSLGLFVQAMFGIGMTCGFKSLEKNIAAFTVVFGIFTSLGEFSVGDNIGLIASKSYATPVRGTLYSISAAFAKVGAFVGTYAFPQIIKNAGGSDTTNGMRAPFWVATALCLVSCFLALFFLPELDPNAIVDEDRKFAEYLAQSGYDMSTLGTESDNTVEVEYSQEILKSDSIDKN

SEQ ID NO: 49803 - protein, 173 aa, Debaryomyces hansenii CBS767
MSELFPTDVKLKYVPYTKSNDAVASCGNPIDFDLAKELPGKKIVLTAAPGAFTPTCTEEHIPNYLKNLEKFKSKGVDRVVVVTANDPFVNAAWGKALGSKDESNYVIFASDPNAALSKELGDNFVADLTKAGLGIRTARYTSIIDDGKVSFLESEEGLGFSEISSASTVLERL

SEQ ID NO: 49804 - protein, 597 aa, Pteris vittata
MASDASKKKAAQKKAAAAAKRGSKATATNATSSKTNGVSNSSPNEVADEMAYMQITDRTCTGILASHPQSRDIHIESLTVTFHGHDLIVDSSLELNYRRRYGLLGLNGCGKSTLLSAIGCRELPIPEHMDIYHLTREIEATDLTSLQAVVNVDEERIKLEKEAEMLAAQDDGGGEVLERLYERLEAMDAATAEKRAAEILYGLGFNKSMQQKKTRDFSGGWRMRIALARALFMNPTILLLDEPTNHLDLEACVWLEETLKKFDRILVVVSHSQDFLNGICTNIIHMQSKKLKFYTGNYDQYVQTREELEENQMKQYKWEQEQIANMKEYIARFGHGSAKLARQAQSKEKTLAKMERGGLTERVVKDKVLVFRFTDVGKLPPPVLQFVEVDFGYTPEHMIYKKIDFGVDLDSRIALVGPNGAGKSTLLKLMTGELSPIDGMVRRHNHLRIAQFHQHLADKLNLDMPALQYMMSEYPGLEEEKMRAAIGRFGLTGKAQIMPMRNLSDGQRSRVIFAWLAWRLPHMLLLDEPTNHLDIETIDALADALNEWDGGLVLVGHDFRLINQVAKEIWVCENQTVSRWEGDIMDFKQHLKAKAGL

SEQ ID NO: 49805 - protein, 531 aa, Streptomyces avermitilis MA-4680
MLTVDQLALLFVLLLGAVVSVPVGDRFGLPAPVLMTLLGIGLAVADFVPNVDIPPDLILPALLPPLLYAAVRRTSWRQFTANKRPIFLLAVALVFVTTAVVALVAGAIVPGLPIAAAVALGALVAPPDPVAATAVAGQLGLPRRLVSILEGEGLFNDVTAIVLYHVAIAAAVSGTFSLPNAVLDLVLSAVVAVAVGLALGWAANRLMDLLDDVTLQIGLTLLVPYASYVLAEELHGSGVLAVLTTALFLAEYATDADDVMTRLAGHTFWNVVDTLVTGVAFGLIGLELHNALRTASGRWGEMLGWAAAIVAVVVLVRLAYLLPATWLTKRLHAKRDYDEEIPTSWRETVVMWWAGMRGVASAALALAIPLKMDDGSPFPDRDEIVFIAFGVIMGTLVLQGLTLPWLVKRLGVRADTGSEKAFEKALAIRAAKAAKRRLREIEDVEELPEELSEQLLRRAFDIGARISPDLGDEERREAHEQRVRRMKRVRRIQGEMMSAARHEVLAARSEPGADPEIVDRVLRHLDVRSLR

SEQ ID NO: 49806 - protein, 459 aa, Bacillus subtilis subsp. subtilis str. 168
MIGNSSKDNFGQQQKLSRGLKNRHIQLMAIGGAIGTGLFLGSGKSIHFAGPSILFAYLITGVFCFFIIRSLGELLLSNAGYHSFVDFVRDYLGNMAAFITGWTYWFCWISLAMADLTAVGIYTQYWLPDVPQWLPGLLALIILLIMNLATVKLFGELEFWFALIKVIAILALIVTGILLIAKGFSAASGPASLNNLWSHGGMFPNGWHGFILSFQMVVFAFVGIELVGLTAGETENPQKVIPKAINQIPVRILLFYVGALFVIMCIYPWNVLNPNESPFVQVFSAVGIVVAASLINFVVLTSAASAANSALFSTSRMVYSLAKDHHAPGLLKKLTSSNVPSNALFFSSIAILIGVSLNYLMPEQVFTLITSVSTICFIFIWGITVICHLKYRKTRQHEAKANKFKMPFYPLSNYLTLAFLAFILVILALANDTRIALFVTPVWFVLLIILYKVQTQQRT

SEQ ID NO: 49807 - protein, 175 aa, Triticum aestivum
MAPAVMASSATTVAPFQGLKSTTGLPISRPSGSAGLSNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 49808 - protein, 458 aa, Oryza sativa Japonica Group
MPRRPSGGGGGAGPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGTVPFESMLSFWVPVLRKSLFHMQV

SEQ ID NO: 49809 - protein, 410 aa, Bacillus halodurans C-125
MAVEVVMPKLGMSMKEGTISVWNKKEGDMVAKGEAIVSIQSEKIETEIEAPADGTLLKVVVQEDQSVPPGTVIGYIGEPNEQLDQSKSLEKQQADSHAEKATEGAVFDVEKPSSKGATVSSSPVARKMALKAGINLENIVGTGPGGRITKADVEKAIAEQRVEPSEAKRSNSDVTEKGMQDGAKITPASAMRQVIATRMHGSLMQSAQLTMNMKADVTDLMALREEVNHTVQTRYGMKLTVTDFIARAVVLALQEHSNMNSAYIDEHIVTYEYVHLGMAVSLTQGLVVPVVQHAEALSVVELSKQIKSLSEQARTGKLQSDQLTGSTFTVTNLGVYGVDHFTPILNPPEAGILGVGAATDAPVFQGGDWQTRAMLPLSLTFDHRIVDGAPAAEFLQTIKQFLEKPTHLLL

SEQ ID NO: 49810 - protein, 116 aa, Zea mays
FDVCFRQMKAFADSISNWADVGIAYEPVWAIGTGKVATPEQAQEVHAAVRNWLTTNISPDVASSTRIIYGGSVNAANCAELAKKEDIDGFLVGGASLKAPDFATIINSVTAKKVAA

SEQ ID NO: 49811 - protein, 558 aa, Sulfitobacter sp. EE-36
MSEEWAVATGHPIATGAAERVLRGGGNAVDAGVAAGIALAVVQPDLVSFAGVAPVILYDAAREHVTSYDGVGVWPQAADVVQMQRDHGDHVPEGLLRTVVPAAPASWIKVLATHGTLGFGDVAQEAVQAARDGFDVYHLLADFIASREEKYARFPSTAAIFLPDGRPPKVGELFVQTDLAKTLQLLIDAESAARAEGGDRRAGLAAARAAFYTGPTAQKIVAFHAKNGGLLRAEDLASYEVREEPTFAVEFRGTQIHCCGAWCQGISMAQTLAMLEQAGPDATCDGDQIKLHFLLEVLKRVFADREAHVTDPRYMQIAPEALLDPAFIADRLRSIQETSDPLPAPKAPALAASGERPVFEVGCADTSHVSVIDGAGNIFSATPSDPSYDTVVIPGTGLSVSSRGSQSRAIPGHLNALAPGKRPRLTPNPILGLKDGKPWLAMGTPGGDVQVQAMAQVLLGMLDHGQAPHAAVEAPRVASYAYPGSFAPHDVHPNKVLYEADLPLEQIKDLRARGHDLEEWPARTWMAGGICIALRDGAGVDAVADPRRAGTAKTGAKP

SEQ ID NO: 49812 - protein, 556 aa, Rhodobacter sphaeroides 2.4.1
MYSYTDFDEAFVRTRVAQFSEQVRRRIDGSLTEDEFKPLRLMNGLYLQLHAYMLRVAIPYGTLDSRKMRQLAMIAERWDKGYGHFTTRQNIQFNWPKLGDVPEILSALADVGMHAIQTSGNCVRNVTADHFAGAAADEIEDPRPVAELLRQWSTDHPEFQFLPRKFKIAITGSPNDRAVTKSHDIGLRMVRNADGEPGFEVIVGGGLGRTPMIGRVVRDFLPKADLLPYVEAILGVYNELGRRDNKYKARVKILVHETGLEPLREIIEERFLETRAEFGGQDMALLAEIERAFAPPAFRQAPTAAYDDFYRADPIFRAWADTNLARHRNADYAIVTISLKAHGATPGDATAEQMRVMADLAERYGHDELRISHEQNVILPHVHKADLPAVHAALAQAGLATANVGLISDIIACPGMDYCALATARSIPVAQEIATRFDTLDLEHEVGPLKIKISGCINACGHHHVGHIGILGLDRAGVENYQITLGGDGTETAAIGEKTGPGFAYDEIVPAVERIVRAYLEIRSEPSETFLDTLRRVGHAPFKAALYEAEGKQDAA

SEQ ID NO: 49813 - protein, 459 aa, Bacillus halodurans C-125
MDRVAIVGGGPAGYVAAITAAHRGKQVTLIEQKKLGGTCLNEGCMPTKSLLESAATYDKVKHASDYGIKGPVDEMRIEWGQVQARKNQIVHQLVKGIDYLLKKHKIELLEGTASFQSAHELLVQTERGQQTIEANRIIIATGSEPTPLPFAPFDREWVISSEQAMSLPIQPESMIIVGGGVIGCEFASIYGRMGTKVTIIEMADRLLFGEDHDICKVLMEELKRQGVEIYPSTVIKEMQRDRKQVVVERDGQVEVLTGDYVLVAIGRKPRLQEIGLERIGVDFTSRGITVNEHMQTTIPHIYACGDVIGGIQLAHVAFHEGSVAAKHLCGEPIQVRYEAVPRCIYTSPEIATVGLTETQARENYGHVRIGEYPFAANGKALIVNETIGKVKVVVEPEYEAIVGLTIVGPHATELIAQGTLMVHNELTLDSLESFIAAHPTVSEAVHEAVLQALGQAVHV

SEQ ID NO: 49814 - protein, 258 aa, Xanthomonas oryzae pv. oryzae KACC10331
MAHQLKLRMDPARARWVPAVAGVLRLSTRLCARVNERCSKTAGPRTCDPSAMSLLIEQARYHLSAHNARQLPDDGGYEVAFAGRSNAGKSSALNALTRQNALARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVTSRFGDSVTVQTYSGQSRQGVDELRGIVGGWLGLIAEPLAEH

SEQ ID NO: 49815 - protein, 373 aa, Glycine max
MWLVLAVANEGVAVAKRAAPKPVSKKVIVKPKPSEKVTDIDASPDKKRVLKDKKKEGDANPKKKSQHTLTSVLTARSKAACGITNKPKEQIIDIDASDVDNELAAVELAAVEYIDDIYKFYKLVENESRPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFHSTLENGKLRVVYRKYSDPQKGAVAVLPPAKFLLPEGSASQHS

SEQ ID NO: 49816 - protein, 131 aa, Brassica napus
  misc_feature (106)..(106): Xaa can be any naturally occurring amino acid
AFVLANVLGRFPWLTCPRQDLSTGWLQCDADPLFKPEPFTLPAWIPGWFAWKEMEALSVQWHALCLGLFALIIAPFGGFFASGFKRAFKIKDSGDSIPGHGGITDXLDCLMDMSIFAYIYILLFIYFQSFL

SEQ ID NO: 49817 - protein, 468 aa, Chromobacterium violaceum ATCC 12472
MLRNTKILATLGPSSSAPEKILELARSGVNIFRLNMSHGSHDDHRARLAAIRAAEKTLDRPIGVLVDLQGPKLRIGKFPQPTTVKTGDRYEFVLDETEGNAERATLPHPEAFEALEPGHLILVNDGKLAFEVAEMHPRRIVTRVTVGGELSSNKGFNLPHTVLPLSAITGKDRKDAEFALEEGADWVAMSFVQTAADVKALRDIVGKRVGIVAKIEKPSAVDDLEAIAELADGVMVARGDLGVELPPEDVPVVQRRIVHHCRHLGRPVIVATQMLESMITAPTPTRAEANDVATAVYEGADAVMLSAETAAGQYPLEAVQIMDRIIRRVENAPDYRKVMALDYSAADEPDRTDAIAACVRKVSTLLPVTVAVAFTTSGASCLSLARERPSTPILGISPRLETARRLTLVWGVVAYHGPDAENLEDMVVKTTFCATKLSLAEQGKPMVIIAGVPFGTPGSTNLLRIVYP

SEQ ID NO: 49818 - protein, 181 aa, Rumex obtusifolius
MASSIMSSATVARPSAAQATVIAPFTGLKNIATFPTTRKSSDLSFPSNGGKVRCMQVWPPEGKIKFETLSYLPPLSEADLLAQINYLLINGWVPCLEFDVGPGAVYREHHHSPGYYDGRYWTMWKLPMFGCTDATQVVAELEEAKKAYPHAFVRIIGFDNVRQVQCVSFIAYKPPRAEGTY

SEQ ID NO: 49819 - protein, 368 aa, Vitis vinifera
MATTGQVITCKAAVAWEANKPLVIEDVQVAPPQVGEVRIKILFTALCHTDAYTWSGKDPEGLFPCILGHEAAGIVESVGEGVTEVQPGDHVIPCYQAECRECKFCRSRKTNLFMMSDRKSRFSINGTPIYHFMGTSTFSQYTVVHDVSVAKIDPVAPLEKVCLLGCGVPTGLGAVWNTAKVESGSIVAVFGLGTVGLAVAEGAKSAGASRIIGVDIDSKKFDVAKNFGVTEFVNPKDHEKPIQQVLVDLTDGGVDYSFECIGNVSVMRAALECCHKGWGTSVIVGVAASGQEISTRPFQLVTGRVWKGTAFGGFKSRSQVPWLVEKYMKKEIKVDEYITHNLTLGEINEAFDLMHEGGCLRCVLAMHV

SEQ ID NO: 49820 - protein, 245 aa, Rhodobacter sphaeroides 2.4.1
MRKLAAGNWKMNGTEADLGEIDALLAAHPSPRCEMLICPPATLVARMAGRAAQGLMVGGQDCHPKTSGAHTGDVSAAMLADAGASHVILGHSERRADHGETDSLVRLKAEAAWGAGLVAIVCVGETEAQRDAGQTLDVIGAQLAGSVPEAATAANTVIAYEPVWAIGTGRTPTTAEIAEVHAFLRARLAERFSDAEGFRLLYGGSVKPSNAAEIFAVPNVDGALVGGASLKAADFGGIVAALSAA

SEQ ID NO: 49821 - protein, 503 aa, Chromobacterium violaceum ATCC 12472
METYDLVIIGGGINGAGIARDAAGRGLSVLLCEKDDLASHTSSASTKLIHGGLRYLEYYEFGLVRKALQEREVLLKAAPHIIWPLRFVMPHARDQRPEWMIRAGLFLYDHLAKREVLPGSETVSFARHPSGAPLKDAFKRGFVYSDGWVQDARLVVLNAMDAAEHGAKIHVRTACVAARRDGEHWLATLEREDGSRFEVRARALVNAAGPWVQSLIEDKLAMPSSKSIRLVKGSHIVVKKIFDHPFAYIFQNPDKRIIFAIPYEKDFTLIGTTDVEYHGDPAQVAIDGDEINYLCEMSNRYFHSQITPADVLSTYSGVRPLLDDASDNASSVTRDYALEMDLKGAPLLSVFGGKITTFRKLAEEAVDKIAPLLGCGQATWTAGAPLPGGDMPGADFGRFLQGLRQRHPWLPEALAERWARAYGTRVGKLIGKADSLAGLGKEVLPGLYEAELAYLADAEWATRSEDILWRRSKLKLHLPANAAEVVDAWLAARAQPPREALSA

SEQ ID NO: 49822 - protein, 107 aa, Populus trichocarpa
MSSHNNNPASANDPRQPSASKSFLAPMVSPQDVPVDYSGFVAVILGVAGVMFRYKLCSWLALIFCAQSLSNMRNMENDLKQISMASMFAIMGLVTNYLGPARPASQS

SEQ ID NO: 49823 - protein, 490 aa, Ostreococcus tauri
MLARARARALCACGFARARVVHARRCPTGARGRRARLRSTAATALDDDDDDDARAVDDVSTRALGPRASATTWVWASEAYDVRGDGEGGRGARTRATRAGALSVAPMMEYTTAHFRVMCRLMSAKTWLWTEMEVDQTLTHAVLEGTRVDRFLDYPVETAATVLQLGGSDPEILGRATAIAAPYGYEEINLNSGCPSPKVAGKGCFGAALMTEPRLVAECLQAMNENAPSGTPVSIKCRIGVDECDSYDALCEYVDTIVRASATRRFYVHARKALLNGLSPAENRSVPPLKHEWAYALARDFPECEFHLNGGLKTLKDVENAIHRGPEGGGPIAGVMIGRQAHADPWGLLSAADTTIFGESTNPCASRRDFLEKYVEYADDTIGRYGTAKDGYRIPSVRHMMHPIQNLFHGCANNKMWRRLVDEELQKRSKKPDTTVRSILEATLGVIEDEDLDAPPRAAGIDAFDANREWDLPTKGGGYRAMDQRAVVQH

SEQ ID NO: 49824 - protein, 307 aa, Escherichia vulneris
MVSGSKAGVSPHREIEVMRQSIDDHLAGLLPETDSQDIVSLAMREGVMAPGKRIRPLLMLLAARDLRYQGSMPTLLDLACAVELTHTASLMLDDMPCMDNAELRRGQPTTHKKFGESVAILASVGLLSKAFGLIAATGDLPGERRAQAVNELSTAVGVQGLVLGQFRDLNDAALDRTPDAILSTNHLKTGILFSAMLQIVAIASASSPSTRETLHAFALDFGQAFQLLDDLRDDHPETGKDRNKDAGKSTLVNRLGADAARQKLREHIDSADKHLTFACPQGGAIRQFMHLWFGHHLADWSPVMKIA

SEQ ID NO: 49825 - protein, 302 aa, Pantoea ananatis
MTVCAKKHVHLTRDAAEQLLADIDRRLDQLLPVEGERDVVGAAMREGALAPGKRIRPMLLLLTARDLGCAVSHDGLLDLACAVEMVHAASLILDDMPCMDDAKLRRGRPTIHSHYGEHVAILAAVALLSKAFGVIADADGLTPLAKNRAVSELSNAIGMQGLVQGQFKDLSEGDKPRSAEAILMTNHFKTSTLFCASMQMASIVANASSEARDCLHRFSLDLGQAFQLLDDLTDGMTDTGKDSNQDAGKSTLVNLLGPRAVEERLRQHLQLASEHLSAACQHGHATQHFIQAWFDKKLAAVS

SEQ ID NO: 49826 - protein, 229 aa, Thermotoga maritima MSB8
MGLKENLERVLNRMKNAALRANRDPSEVRLVVASKYASVQQMEELVFLGIREFGENRAQDLVKKSEYFKGKPIIWHFIGRIQTNKVKYIVPRCELIHSVWREEELKEIEKRAEKLGKIQKILLEVNVFKEETKAGLLVEEVEGFLKLCQEFPHVEVLGFMTMAPYVGDPEEVRWGFRTLRELRDELASRFNGNVKLKELSMGMSNDFEVAIEEGATMVRIGSAIFEGGK

SEQ ID NO: 49827 - protein, 559 aa, Bacteroides fragilis NCTC 9343
MKVLDFKPRLFSTLKNYSKETFMSDLMAGIIVGIVALPLAIAFGIASGVSPEKGIITAIIAGFIISLLGGSKVQIGGPTGAFIVIIYGIIQQYGEAGLIVATLMAGILLILLGVFKLGAIIKFIPYPIIVGFTSGIAVTIFTTQIADIFGLNFGGEKVPGDFIGKWMIYFRHFDTVNWWNAVVSILSIIIIAITPRFSKKIPGSLIAIIVVTIGVYVLKTYAGIDSIDTIGDRFTIKSELPEAAIPTLNWEAIKDLFPVAITIAVLGAIESLLSATVADGVTGDKHDSNTELIAQGTANLITPLFGGIPATGAIARTMTNINNGGKTPVAGIIHAIVLLLILLFLMPLAQYIPMACLAGVLVIVSYNMSEWRTFKALLKNPKSDVTVLLITFFLTIIFDLTIAIEVGLVIACILFMRRVMETTEISVIKDEIDPNDELDIAACEEHLIIPAGVEVYEINGPYFFGIATKFEETMAQLGDRPKVRIIRMRKVPFIDSTGIHNLTSLCKMSQKEKITIVLSGVNEKVHKTLEKSGFYELLGKQNICPNINVALDRAKEIIN

SEQ ID NO: 49828 - protein, 413 aa, Photobacterium sp. SKA34
MASTSISVKPEMATFSLKLKKKLLLLGPAFIAAIGYIDPGNFATNIEAGSAFGYQLLWVVLWANLMAMFIQYLSAKLGIVTGKNLAEHLRDHLPKWAIGPYWIQAEIIAMATDLAEFIGAAVGFQLLFSITLMEGAIITAIVTMAILLLSNKSQKPLEVVIATLLLVVAVVYVIELFFAHPATGEMIKGLAIPTMNSSHQIYLAAGILGATVMPHVIYLHSALFKNTYGETKAKRLKSTRLDVLIAMVIAGFVNIAIVAMAAAVFHYSGNQDIAEIETAYKTLTPLVGQAASTLFAISLIASGLSSTVVGTMAGDVVMQGFVKFKIPLLLRRVVTMIPSFIVIGLAINTTEILVMSQVVLSFGIALAIIPLLIFTNNEKLMGEFKNNKYVSYAGVVIIALVVALNIYLMMTLS

SEQ ID NO: 49829 - protein, 273 aa, Pseudomonas syringae pv. syringae B728a
MDNKLTSRIAIITGAAQGIGAAIARRFLQEGCFVYVTDINDVLGRETARALGDRACYLHLDVRCEEDWQRVTAHVVKAHGRLDVLVNNAGITGFEQGAVQHDPEHARLEDWQAVHHTNLDGVFLGCKYAIRAMRHTETGSIINISSRSGLVGIPGAAAYASSKAAVRNHTKTVALYCAEQGLKVRCNSIHPAAILTPIWEPMLGADAGREERMAALVRDTPLRRFGMPEEVAAVALLLATDEATYITGSEFNIDGGLLAGSAATPVVLDDSET

SEQ ID NO: 49830 - protein, 386 aa, Aspergillus nomius
MTGLDMESIFAKIKEEYARTDDVGKRQIQGHIRELQVGFYSDWDVVMRLSSGPLQVALAKVGIDLGIFRDLKESKTPITLAEFVKKTGASPRLLGRILRTQAAFGLIKETGPQEYTSSAFTDVFAKVDAAGAVAQLFDISGPCTQILPDFLAERDYRDITSNKDCVFQKAFNSDLTMFEWMPQHPKHMESLGHLMALERPVSWVDHFPVLEKLGDFPGPDKVLMVDIGGGFGQQSKALRAKFPNLPGRVIVQDIPQTLANAQPAAGVEFMEHSFFEPQPIQNAKFYYLRHVFHDWPDEQCVQILKQIIPAMGPDSQILIDEMVIPSTGVPWQAAFTDLLMMNSLGGVERTRAEWDNLLEQAGLEIIQSKVYDSKDQSILVAVPKRP

SEQ ID NO: 49831 - protein, 1054 aa, Bacillus subtilis subsp. subtilis str. 168
MKQASAIPQPKTYGPLKNLPHLEKEQLSQSLWRIADELGPIFRFDFPGVSSVFVSGHNLVAEVCDEKRFDKNLGKGLQKVREFGGDGLFTSWTHEPNWQKAHRILLPSFSQKAMKGYHSMMLDIATQLIQKWSRLNPNEEIDVADDMTRLTLDTIGLCGFNYRFNSFYRDSQHPFITSMLRALKEAMNQSKRLGLQDKMMVKTKLQFQKDIEVMNSLVDRMIAERKANPDENIKDLLSLMLYAKDPVTGETLDDENIRYQIITFLIAGHETTSGLLSFAIYCLLTHPEKLKKAQEEADRVLTDDTPEYKQIQQLKYIRMVLNETLRLYPTAPAFSLYAKEDTVLGGEYPISKGQPVTVLIPKLHRDQNAWGPDAEDFRPERFEDPSSIPHHAYKPFGNGQRACIGMQFALQEATMVLGLVLKHFELINHTGYELKIKEALTIKPDDFKITVKPRKTAAINVQRKEQADIKAETKPKETKPKHGTPLLVLFGSNLGTAEGIAGELAAQGRQMGFTAETAPLDDYIGKLPEEGAVVIVTASYNGAPPDNAAGFVEWLKELEEGQLKGVSYAVFGCGNRSWASTYQRIPRLIDDMMKAKGASRLTAIGEGDAADDFESHRESWENRFWKETMDAFDINEIAQKEDRPSLSITFLSEATETPVAKAYGAFEGIVLENRELQTAASTRSTRHIELEIPAGKTYKEGDHIGILPKNSRELVQRVLSRFGLQSNHVIKVSGSAHMAHLPMDRPIKVVDLLSSYVELQEPASRLQLRELASYTVCPPHQKELEQLVSDDGIYKEQVLAKRLTMLDFLEDYPACEMPFERFLALLPSLKPRYYSISSSPKVHANIVSMTVGVVKASAWSGRGEYRGVASNYLAELNTGDAAACFIRTPQSGFQMPNDPETPMIMVGPGTGIAPFRGFIQARSVLKKEGSTLGEALLYFGCRRPDHDDLYREELDQAEQDGLVTIRRCYSRVENEPKGYVQHLLKQDTQKLMTLIEKGAHIYVCGDGSQMAPDVERTLRLAYEAEKAASQEESAVWLQKLQDQRRYVKDVWTGM

SEQ ID NO: 49832 - protein, 242 aa, Debaryomyces hansenii CBS767
MNATVASEYSSEVHTVPIEHRFNPYSDNGGTVLGIAGEDFSVLAGDTRQVVGYSINSRYEPKIFDVGDDIAMTANGFAADGAALIDRFRNQLKWYKFDHGGKKLSIKSAARYIQHLLYGKRFFPYYVSTLIAGLDDEGKGAVYSYDPVGSYEREQCRAGGAAASLIMPFLDNQVNFKNQFVPGTNGTEKKELRYLSLDEVLQLVKDAFSSATERHIYVGDGLEIFIITKDGIRKEYYPLKRD

SEQ ID NO: 49833 - protein, 714 aa, Escherichia coli K12
MEMTSAFTLNVRLDNIAVITIDVPGEKMNTLKAEFASQVRAIIKQLRENKELRGVVFVSAKPDNFIAGADINMIGNCKTAQEAEALARQGQQLMAEIHALPIQVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKKERPSSRPLPVRERILAGPLGRALLFKMVGKKTEHKTQGNYPATERILEVVETGLAQGTSSGYDAEARAFGELAMTPQSQALRSIFFASTDVKKDPGSDAPPAPLNSVGILGGGLMGGGIAYVTACKAGIPVRIKDINPQGINHALKYSWDQLEGKVRRRHLKASERDKQLALISGTTDYRGFAHRDLIIEAVFENLELKQQMVAEVEQNCAAHTIFASNTSSLPIGDIAAHATRPEQVIGLHFFSPVEKMPLVEIIPHAGTSAQTIATTVKLAKKQGKTPIVVRDKAGFYVNRILAPYINEAIRMLTQGERVEHIDAALVKFGFPVGPIQLLDEVGIDTGTKIIPVLEAAYGERFSAPANVVSSILNDDRKGRKNGRGFYLYGQKGRKSKKQVDPAIYPLIGTQGQGRISAPQVAERCVMLMLNEAVRCVDEQVIRSVRDGDIGAVFGIGFPPFLGGPFRYIDSLGAGEVVAIMQRLATQYGSRFTPCERLVEMGARGESFWKTTATDLQ

SEQ ID NO: 49834 - protein, 378 aa, Bacillus halodurans C-125
MKAVTYQGIKDVKVKEVPDPKLEKKDDVLVRITSTAICGSDLHLVHGMIPNFPKGYIIGHEPMGIVEEVGPDVTKVKKGDRVIVPFNIACGKCYYCTHDLESQCDNSNPNGQAGAYFGYSGTFGGYPGGQAELLRVPYGNFTPFVVPEDAEMEDEKLLFLSDIIPTAYWGVEQAEVKKGDTVVVLGCGPVGLLAQKFAWLKGAERVIAVDYVQYRLTHAKQTNQVEVLDFSTIDDVGTHIKEITKGGADSVIDCVGMDGKKSAVEMVETALKLQGGTLGPINIASQAVRKGGTVSIVGVYGTRYNAFPLGDFFARNITLKMGQAPIIHYMPTLYQMIKDEVFDPTDLITHRLPLELAEHGYDIFDAKQDDCIKVVLKP

SEQ ID NO: 49835 - protein, 459 aa, Arabidopsis thaliana
MVIAAASSFSLGPSHCHQSYTDEFSSSIPYKRTSNARNRVFDGCGSANLSVLSSRCKIPFFGSAFHVSSGGHDLGLTKVSVAADYSDSVPDSSFYGYHPLEDLKPSKRVQETKLSASEVARTTVEANSSAVLVFPGAIHCEPHDHNSWSEFKYVIDDYGDIFFEIPDDENILEDPGASNPVKAFFGMDVPRYENTRHHEEYNISDIGNLDQIIFDDHYFEIMDSEARDIPIDWGMPDTSNGVHPIYFAKHLSKAISMDYDRKMDYPSNGVSILGCLRPAFLDEESYIRRLFLSEDRDDYSWEVQGDDNPITSSRRDENDMSSSLYRLEIVGIELLSLYGAESSISLQDFQDAEPDILVHSTSAIIERFNNRGINSSIALKALCKKKGLHAEEANLISVDSLGMDVRVFAGAQVQTHRFPFKTRATTEMAAEKKIHQLLFPRSRRRKLKCHDESLKDAFR

SEQ ID NO: 49836 - protein, 487 aa, Mycobacterium smegmatis str. MC2 155
MTPVTINHLVAGDWVAGAGDVVVSVNPARPGDIVAEGHNATTAQVDTAVAAAAEAFRAWAATPTHQRGAVLLAAAQIVDRNAEAWGLELATEEGKTKAEGIGEVRRAAQILRYYGNEGDRQAGEIFSSPRAGEQILVTRKPLGVVGVITPFNFPIAIPAWKIAPALVYGNTVVWKPASTVPVLAIRFAQALTEAGLPAGALNLVIGDSETGTAIVDHPRIDGLTFTGSTAVGRRLASVAATCGIPMQAEMGGKNAAVVLDDADLDVAVEQVMLGAFRSTGQKCTATSRLIVTDGIADKFTEALVERARALRVGDPTDDATEMGPVITDTSRASILAGIDTAVAQGATVLAGGRPYTEGPLAEGYFIAPTVLELDGSPAKVWSEELFGPVLAVRRAADADEAFELANDSEFGLSAAIFTQDVTRVLQAMEQIDVGVLHVNSESAGADPHVPFGGDKKSGLGPKEQGAAARDFFTHTTTVYLRGGRPGV

SEQ ID NO: 49837 - protein, 182 aa, Glycine max
  misc_feature (37)..(37): Xaa can be any naturally occurring amino acid
  misc_feature (88)..(88): Xaa can be any naturally occurring amino acid
MENQMAPSMIDCPAVTTVNRAGAVMAASFTGLKSMAXGFRTRETNSDITYIASNGGRVQCMQVWPPVGTKKSETLSYLPDLDDAQLAXEVEYLLRKGWIPCLEFELEHGFVYREHNTSPGYYDGRYWTMWKLPMLGCTDASQVLKERAEAKTVYPNGFIRIIGFFFVGRVHCISWLAYKPPG

SEQ ID NO: 49838 - protein, 89 aa, Oryza sativa Indica Group
MAPSVMASSATTVAPFQGLKSTAGMPVARRSGNSSFGNVSNGGRIRCMQVWPIEGIKKFETLSYLPPLTVEDLLKQIEYLLRSKWVPCL

SEQ ID NO: 49839 - protein, 324 aa, Frankia sp. CcI3
MAYQTENRRNLMLFAGRSHPGLTAEVAAALDVEPVPTHAYEFASGEIFVRFSESVRGCDAFVLQCHSAPVNTWLMEQLIMVDALKRASAKRITVVAPFYPYARQDKKHRGREPISARLVADLFKTAGAHRLMSVDLHTAQIQGFFDGPVDHLFALPLLTDYIESKLDTSEVTVVAPDSGRVRVAERWTDRLGCPLAIIHKRRDPDVPNQVKMFDVVGEVHGRTCVIVDDMIDTAGTITKAAESLKEHGAAGVIAAATHGVLSGPAADRLKNSEISEVVLTNTLPLPSEARIDKITELSIAPLLAAAIKAVFEDGSVTGLFGGDA

SEQ ID NO: 49840 - protein, 436 aa, Glycine max
  misc_feature (412)..(412): Xaa can be any naturally occurring amino acid
MPTFTAMALDRLIEPGASKPVDKSAPTSMPVPNSQKLERSTSAPAKKSKVPQPPLKPALYTTPEVTPLPDAPSSFPPSPYIINHKRRGPRLLKSSSEASALSEVNIRCDDDNDKSVDAVVTSSAGDLQVTSTKPELVKEEKVNGVYDGQLDRSNDVDHANGHRETGSGSLTNGLLKEKPPALNLDRVSEVEDFFYPLDSMSFSSNTDGEENAGTELSMKLSSPSTEFYDAWEELSSEGMSQNSTYDIEAELREVRLSLLVEIEKRKQAEESINNMRSQWESIRQGLYQAGIILPAYLNATAEDEQLTSDPVEDLCQQVYIARFISNAIGKGIARAELETEMEAQLEAKNFEIARLLDRLHCYETMNREMSQRNQEAVEMARCERQRSSRRHRWIWGCITTVIALSTAAIAWXYLPTSKGSSSADHDLVPEYDDTAK

SEQ ID NO: 49841 - protein, 511 aa, Vitis vinifera
MIGPPRPPPTDSDSDDDLAEEEEEEEENRHRIPLSNEIVLKGHSKVVSALAVDHSGSRVLSGSYDYTVRMYDFQGMNSRLASFRQLEPSEGHQVRNLSWSPTSDRFLCVTGSAQAKIYDRDGLTLGEFVKGDMYIRDLKNTKGHISGLTCGEWHPKTKETILTSSEDGSLRIWDVNDFKSQKQVIKPKLARPGRVPVTTCAWDHEGKCIVGGIGDGSIQLWNLKPGWGSRPDIHVERGHSDEITGLKFSSDGRILLSRSFDGSLKVWDLRQMKKPLQVFEDLPNHYAQTNIAFSPDEQLILTGTSVERESTNGGLLCFYDRAKLELVSRVGISPTCSVVQCAWHPKLNQIFVTAGDKSQGGTHVLYDPTLSERGALVCVARAPRKKSVDDFEAKPVIHNPHALPLFREQPSRKRQREKILKDPIKSHKPELPITGPGFGGRVGSTKGSLLTQYLLKQGGLIKETWMEEDPREAILKYADVAANDPKFIAPAYAQTQPEPVFAKSDSEDEEK

SEQ ID NO: 49842 - protein, 296 aa, Pediococcus pentosaceus ATCC 25745
MNSNFDDFVKQNVELLDQHIDELFDSDSTLNTDLKMMMKYSIDAGGKRVRPLVLLAILKAFGKTPNYDILTVAAALEAVHTYSLIHDDLPAMDNDDLRRGRPTSHKKFGEAEAILAGDALLTVAFQWISSTNLKDRIKSELVLSLASDAGASGMIAGQLLDIQGNQRHYSLAELKHLHHLKTGKMLLFPAEAALIMKPSKLQVAELVKDFMANFGLAFQIHDDIIDVTESTAILGKTAGKDVDLNKNTYVNLLGLSGAKEELNQVLQKCEQDLTSLGELQPEMDLMILEGFLTYLK

SEQ ID NO: 49843 - protein, 238 aa, Zea mays
MAATPLDSAWEWLITNFSEFQLATVVTFVLHESVFFLSGFPSLLFERLGLFAKYKIQKKSNTSAYQNRCVMRLILYHVCVNLPVMIFSYPAFKFMGLRSSLPLPHWTVIVSQVLFYFILEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYAST

SEQ ID NO: 49844 - protein, 274 aa, Thermotoga maritima MSB8
MLYKELGRTGEEIPALGLGTWGIGGFETPDYSRDEEMVELLKTAIKMGYTHIDTAEYYGGGHTEELIGKAIKDFRREDLFIVSKVWPTHLRRDDLLRSLENTLKRLDTDYVDLYLIHWPNPEIPLEETLSAMAEGVRQGLIRYIGVSNFDRRLLEEAISKSQEPIVCDQVKYNIEDRDPERDGLLEFCQKNGVTLVAYSPLRRTLLSEKTKRTLEEIAKNHGATIYQIMLAWLLAKPNVVAIPKAGRVEHLRENLKATEIKLSEEEMKLLDSLG

SEQ ID NO: 49845 - protein, 509 aa, Rhodococcus ruber
MTGTLSRDSGTTNQVDERLGAAAREFLGRPHQLFIDGQWVDAADGRTFGTYDPATGAEITQVAHGGPEDVDRAVAAARRAFDDGDWATMKPNKREQILWRIGDLLDARGEMLGQIEALDNGKSAAIATAVDVTFAADVFRYYAGWCTKIEGTTVDVSMPFAGDKQFHAYTQRVPVGVCGQIIPWNFPLLMAAWKLAPALATGNTLVLKPAEQTPLTALLLGEIMAEAGVPDGVVNIITGFGDAGAAISAHDDVDKVAFTGSTEVGKLIVDAAKGNLKKVSLELGGKSANIVFADCDFDAAVAGSVAAWMFNHGQACTAGTRLYVEDSIYEKFTQAVADAAAQATIGHGLDPATELGPLVDQDQFDKVSYYLRAGIEDGGRALTGGGRHGDTGYFIQPTVFVDVEPDHRVVTDEIFGPVVAALRFSDMDDAVRQANDSIYGLAAGVWTKDISKAHKVASRLHAGSVWVNQYNGFDTAMPFGGFKQSGWGRELGKGALDLYTQTRSVNIQL

SEQ ID NO: 49846 - protein, 369 aa, Rhodococcus ruber
MKTKAAVLFDLHKPFEIIELELDDPGPGEVLIKYTAAGLCHSDLHLSDGSLPPRFPIVGGHEGAGIIEAVGVGVTKVKPGDHVVCSFIPNCGTCRYCSTGRQNLCDMGATILEGHMPDGTFRFHAGGKDFGAMCMLGTFSERSVISQHSVVKVDDWLPLDKAVLVGCGVPSGWGTATYAGNVRQGDTVVIYGIGGLGINAVQGAVHSGARHVVVVDPVQFKRDEALKFGATHAFADAAEAHAEVEKLTWGQMADQALILVGTVDEPVVSSAFDVIGKGGTVVITGLGNMTDKTVQVSGTMMALFGKTITGTVFGSANPQYDIVKLLRLYDEGKLKLDELITTTYTLDQVNEGYQDLQDGKIMRGVIIHD

SEQ ID NO: 49847 - protein, 307 aa, Bacillus subtilis subsp. subtilis str. 168
MTVITDITELIGNTPLLRLKNFDVPEGVAVYAKLEMMNPGGSIKDRLGDMLIRDALDSGKVKPGGVIIEATAGNTGIGLALSARKYGLKAIFCVPEHFSREKQQIMQALGASIIHTPRQDGMQGAIQKAIQLETEIENSYCVLQFKNRVNPSTYYKTLGPEMWEALDGNIHTFVAGAGSGGTFAGTASFLKEKNPAVKTVIVEPVGSILNGGEPHAHKTEGIGMEFIPDYMDKSHFDEIYTVTDENAFRLVKEAAEKEGLLIGSSSGAALYAALEEAKKASAGTNIVTVFPDSSDRYISKQIYEGGI

SEQ ID NO: 49848 - protein, 306 aa, Haemophilus influenzae R2866
MRKTLTVLGSINADHVISVPYFAKPGETLTGQNYQIAYGGKGANQAVAAARLGAKVAFISCIGSDSIGKTMKNAFAQEGIDTTHINTVSQEMTGMAFIQVAQSGENSIVLASGANSHLSEMVVRQSEAQIAQSDCLLMQLETPLSGVELAAQIAKKNGVKVVLNPAPAQILSDELLSLIDIITPNETEAEILTGVAVTDEQSAVKAASVFHDKGIKTVMITLGAKGVFVSRKGKSRIIKGFCVQAIDTTAAGDTFNGGFVTALLEEKSFDEAIHFGQAAAAISVTKKGAQSSIPTRQETLEFLEHA

SEQ ID NO: 49849 - protein, 95 aa, Zea mays
CTRKLGTRKLGPLEGYSRAAAGQPVEASARTSANRCSSCRKRVGLTGFRCRCGDLFCGAHRYSDRHGCRYDYRGAARDAIARENPVVRAAKIVRF

SEQ ID NO: 49850 - protein, 498 aa, Colwellia psychrerythraea 34H
MNIIGHLINGEICTDAARTQDVFNPATGEVTRQVALASVETVEQAITAAQAAFPQWRNTPPIKRARVMFRFKELLEANSDKICEMIGEEHGKISHDAAGELQRGIENVEYACGAPELLKGEHSKNVGPNIDSWSEFQPLGVVAGITPFNFPAMVPLWMFPMAIACGNCFILKPSERDPSSTLFIAQLLKEAGLPDGVMNVVNGDKVAVDVLLSDQRVKAVSFVGSTPIAEYIYATANANGKRCQALGGAKNHAIVMPDADMDNAVNQLLGAAFGSSGERCMALSVAVAVGDVAGDALITKMTAAMASLKVGAFSDSTNDFGPVITSQHRDKVVGYINHAQEQGATIVVDGRNPEVEGYNNGFFVGGTLIDNVTADMVSYKEEIFGPVLQVVRVQTMQQAMDLINDHEYGNGTCIFTRDGEAARYFSDNIQVGMVGINVPLPVPVAYHSFGGWKRSLFGDLHAYGPDAVRFYTKRKTITQRWPSAGVREGAEFSMPTLS

SEQ ID NO: 49851 - protein, 328 aa, Borrelia burgdorferi B31
MMYNLRNRSFLNLLDFTSKDIKYLLDLSINLKKSKYAGIEVQKLKGKNIVIIFEKDSTRTRCAFEIAAYDQGANITYLGSKGNQMGSKESMIDTARVLGRMYDAIGFRGFSQQTVECLANYSNVPVYNGLTDISHPTQILADLMTIKEHKGSLKGIKIVFCGDGRGNVANSLLKGCAIMGLDFRIFAPKELFPDPDLTLKARSLALESGGKITITDSKEEAVKCADVVYTDVWVSMGESNWEDRINLLKAYQVNKEIMCMAKDDAIFMHCLPAFHDLNTVIGKDIFDKYGLDGIEVTEEIFESKNSVVFDVAENRVHTIKAIMVSTLG

SEQ ID NO: 49852 - protein, 359 aa, Nocardioides sp. JS614
MALTIGIVGLPNAGKSTLFNALTKNDVLAANYPFATIEPNVGVVGVPDDRLPKLAHVFGSARILPATVEFVDIAGIVRGASEGEGLGNKFLSHIRESAAICQVTRVFRDEDVTHVDGEVNPASDISTIQTELILADLQTVEKAIPRLEKEAKGKKELAPVAAAAKEALAHLEAGTPIIATDIDRSLVRELSLLTAKPFIYVFNCDADELGDEALKDKMRALVAPSEAIFLDAKFEAELVELGDDDEAREMLHEMGVEEPGLEVLARVGFDTLGLQTYLTAGPKETRAWTIPKGATAPEAAGVIHTDFQRGFIKAEIVSFDDLVEAGSLLKAREAGKVRMEGKDYVMQDGDVVEFRFNVT

SEQ ID NO: 49853 - protein, 211 aa, Bacillus subtilis subsp. subtilis str. 168
MGKNPVVIGIAGGSGSGKTSVTRSIYEQFKGHSILMIQQDLYYKDQSHLPFEERLNTNYDHPLAFDNDYLIEHIQDLLNYRPIEKPIYDYKLHTRSEETVHVEPKDVIILEGILVLEDKRLRDLMDIKLYVDTDADLRIIRRIMRDINERGRSIDSVIEQYVSVVRPMHNQFVEPTKRYADIIIPEGGQNHVAIDLMVTKIQTILEQNAIL

SEQ ID NO: 49854 - protein, 476 aa, Corynebacterium glutamicum ATCC 13032
MEQSFNQVGNSSVDCGCHVVCPHPEALTDQAWRMFGLFIATIVAIILKPMPMGAVTIIGMIAAVLTGLVPLTASSDDPGAVYGLIGFSNGTIWLIVMAFLISRGFIKTGLGRRIALFFVSKVGGKMLGVTYGLALADLVLAPAIPSATARGGGIMAPIMKSVALTYDSTPGPTRRRAGAFLALNVGQVNAITCAMFLTAMAGNPLIASLASQMDVNITWTNWAVGAIVPGLVALIVVPWVVYKIYPPELKDTPEVKKMASDELKQLGGFTYGEKVLAGTFVVLLLLWTGGDLVLGISATTTAFVGVIILLVAHVLTWEDIIQEKTAWDTMVWFAVLYMMATALSQYGFIAWISEVIASSLGGMNWVVALVVLVLIYFFSHYFFASATAHISAMYLAFLGAAIAIGAPPLMAALVLAYTSNLFSSLTQYSGGPSPTLFGLNYITVGEWWRTSAIAGAVSITIWLVIGGLWMNVIGLW

SEQ ID NO: 49855 - protein, 588 aa, Sulfitobacter sp. EE-36
MHHRLTALFLALSPARPWFKQVDRSTVRADAVAGLSNAAVVLPQGVAFAIIAGLPPEFGLFTAVVVSLIAGIWGSSMIMVSGPTTAISAVVFGSMSQFAVPGSDDYIAMVLSLTLMVGVIQIVAGVFKLGGLISFISHSVLIGFTAAAAFLIAASQLNGALGLAKGAGGGVFERLYHAAENIGGANATAMLISAATILTLVLLSRVSKKMPAYIIALAVGTAVAWVLDAPAQGVAMFSPLRSIVPSFGAPVISFDLVTELLPVAATVAFVGLLEAISIGRSFALRRDEPYNSSQEMVGQGLSNAVGAFFQCYAGSGSFTRSGLNADAGAQTPLSTIFAAGFLVILLFVLAPYLEYVPVPAMAGVILFVSYRLINFHEIRHILTSNKRETAILAATFLTGIFTELDLAIVIGVITSLCVFLYDSAHPIVAVGSPTEINGRRVFKNAANYGLPECPQISVIRVDGPLFFASVENVEQQFRQVEERSPVPKTKLMGLKGLWKIDLSGAGLLLKEIRRARRAGADFHIFTTNAPALRIMRQLHVFDELGEDNMHNNKGEAIAAAVKAADDDICRGCELRIFMECASKPGPEK

SEQ ID NO: 49856 - protein, 426 aa, Nostoc punctiforme PCC 73102
MEESLPITILISVTVVAGIAAQVLAGYFHIPSIVLLLLFGILLGRDGLGFLDPSLLGVGLEVVVSLSVALILFEGGLNLQLGELKEVSSSLRNLVTLGVLITLMGAGITAHWLSEFPWPIAFLYASLVVVTGPTVINPLLKQIGVERQVSTLLEGEGVFIDPIGAILATIVLHFVLNVNVEPLILVKSLVLRLGIGVAIGVSGGWLLSQILKQDRFLSQELKNLVVLASVWGLFSFAQVLRSESGLVVAVIMGIVLKASNLSSEPLLRQFNEQLSILANSVLFILLAADLSIASVFALGWGSVLTVIVLMLIVRPVDILISTWNEGLKWQQQLFLSWVAPRGIVAASLASLFAVSLTKQGINGGDSIKALVFLTIIITVFFQGLTAPWIASLLNLRLTTQIDRECSQLASDDVKMQEDEEIISPVS

SEQ ID NO: 49857 - protein, 141 aa, Oryza sativa Indica Group
KSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 49858 - protein, 409 aa, Nostoc punctiforme PCC 73102
MKAVVFHGIGDIRLDNVPEPKIKESTDAIIRLTSSAICGTDLHMIRGTFTGMKPGTILGHEGVGIVEEIGSNVRNLKVGDRVVVPSTIACGYCSYCRTGYHAQCDNANPNGHNAGTAFFGGPEAAGPFDGLQAEYARIPYANAGLVKLPKEVTDDQAILLSDIFPTAYFGADIAEITPGDTVAIFGCGPVGQFAIVSARLFGAGHIIAVDTIPSRLEMARDLGAEIIDYNAEDPIEAIRELTGGIGVDRAIDAVGVDANAPDSGPAAEKARQEAQQFQQQLQQIAPKTNPQNGNWHPGNAPSLVLEWAVQALAKAGTLSIIGVYPPSHNFFPIGTAMNKNLTINMGNCNHRKYIPTLVDLVRNGTVDPTKVLTQVEPLMSVIDAYKAFDRRQPGWVKVELVPGATLANV

SEQ ID NO: 49859 - protein, 427 aa, Populus trichocarpa
MDSKCGCWAVLKRGVRGSCKSSASRDSANAIPRTSLVYDAATETRYLNASNRELCAHNEAQLSSDNPDPQDKKSPCQLLQFTFQELKSSTGNFRPDSILGEGGFGYVFKGWIEENGTAPAKPGSGITVAVKSLKPGGLQGHREWVAEVDFLGQLHHPNLVKLIGYCIEDDQRLLVYEFMTRGSLENHLFRRTIPLPWSNRIKIALGAAKGLAFLHGGPEPVIYRDFKTSNILLDSEYNAKLSDFGLAKAGPQGDKTHVSTRVVGTYGYAAPEYVMTGHLTSKSDVYSFGVVLLEILTGRRSMDKKRPSGEQNLVAWARPYLADKRKMYQLVDPRLELNYSLKAVQKVSQLAYSCLSRDSKSRPTMDEVVKVLTPLQDLNDLAILSYHSRLSQQGKRKKKSEGAQQHANVSSKSIRDSPLNTGKQRYR

SEQ ID NO: 49860 - protein, 213 aa, Oryza sativa
  misc_feature (11)..(11): Xaa can be any naturally occurring amino acid
  misc_feature (154)..(154): Xaa can be any naturally occurring amino acid
  misc_feature (165)..(165): Xaa can be any naturally occurring amino acid
  misc_feature (174)..(174): Xaa can be any naturally occurring amino acid
MDEWVRQAEVXWVGQAERWIRQQPPEQVYVAVAVVAVTVLLLVAVSCLKSSKANTIVLSGLSGSGKTILFYQLPDGSTHQGTVASMEQNNDTFVLHSELDRPSKVKPVHVVDVPAHARLKTKLDEVLPQAAAHIHVVDAQDLLSTMHAAAEYLXYDILPQATVVXQQVPALIFXCTPTHTLPLHSPESSIKSCGKEITKPREYGTVLYLYQTL

SEQ ID NO: 49861 - protein, 168 aa, Oryza sativa Indica Group
EAPIEVVKEQDKDLSKLGADAIIPAMPGHVMQAFTLLKSSPEAQGVVASLASDKNVWDAVLKNEKVMEFYKTHQQSLVYTFPEGTASVVSPEKLADASSENSSSGEKPESSPFADFMDNARKTVIDIVNNITNFFQDMFRKPNEAEILGGSFMALAIAVILLIMFKKA

SEQ ID NO: 49862 - protein, 375 aa, Trametes hirsuta
MALSTKVPHLMTLADLTPGQIQRIITHSYHLKRTAQPWLAPQGRAGSGGKYSNAPHKLRMPSQSLFSKSIALLFSKRSTRTRLSAETAALLLGGQALFLGREDIQLGVNETVPDSARVIGGMCQGIFARVGDHSEIEELARYSPVPVLNALSSLWHPTQVLADILTLHEHAALFDPASASPTPSAADAFSQKYTKLGEVRPLTVAYVGDSANVLHDMLVTYPRLGHQLRVASPENDRYRAPKAVWDRVVELGCDKNIFWTADPRAAVKGADLVVTDTWISMGQEAEKAQRLKDFAGYQVTEALCREGGANPDWKFMHCLPRKQDEVDDEVFYGPRSLVFQESDNRKWTIMALFDLLFGKWSLLARNGEGADAGSE

SEQ ID NO: 49863 - protein, 526 aa, Frankia sp. CcI3
MPDVTAREAADAGGSVRRTAPSGPWYSRRRTGRWPGVRHIRVELLAGLVTALALIPETISFSVVAGVDPKVGLFASFTISVVIAFTGGRPAMISAAAGSMALVAAPLVRDHGLNYLLATTIGVGLLMFVLGRLGVARLMRFVPQSAMIGFVNALAILIFTAQMPHVIGKSWQVYALVAAGLAILLALPRLTRAVPPPLVAVAVLTLVTAGFDISVPTVGDEGRLPSSLPVPGVPDVPLTWETLRIIAPYVVALTAVGLVETLLTAQIVDRLTDTTHDPNRESWGLGVANIVNGFFGGMGGCAMIGQTMVNVNSGGRGRLSTFAAGGFLLMLVVPLRDLVRVIPMSALVAVMILVSVMTFEWRSIQPSTLRRMPRGETAVMVATVAVVVPTHNLAYGVGVGVMLAALLFTRRAANLALVTSVLDPEGRERIYVVQGTLFFASTSDLVNAFDYACDPERVVIDLSEAHLLDSAAVTALDDVRAKYRERGTQVNLVGVNARSAALLHKLSAEPAQVEPAPTEPAPTRVR

SEQ ID NO: 49864 - protein, 507 aa, Pediococcus pentosaceus ATCC 25745
MTPNQTLNGRYKIIRPLGEGGMANVYLAHDLILDRDVAVKLVRFDMQDDVSAIKRFQREALSTTELVHPNIVGVYDIGEEHGMNYLIMEYVEGQNLKQYIRDQFPIPLGQVVSLMSQILNGVQTAHYHGIIHRDLKPQNILIDKHGKAKITDFGIAIANQQSSFTRTNTVIGSVQYLSPEQVRGHIATQQSDIYSLGIILFEMLTGKVPFEGESAVSIAVKHYQDQLPLVKDFNTKIPQSLENVVLKATAKNPIDRYKNVAEMAADLKTVLQPERANESKFVEDSLVEHTIVLNQDELKQGLAKDEVEKTRPIKLKMNNKINFAKKEKAPDAEESHMHRFKRRHPLRRRALFMAMAAVAFILGILIAFKLSSPQMVQVPNLEDLTQKQAMTKLSKVNLGVGKITKEADDKTSYNKVVETLPQSGKYVQEGIKVNIVISKGPNSFDVDNYVGSDYSSTKKQLEAKGFTIKKRKIVTNRFDNNRIISQDVVSGQVVVPRVTTITFTVAN

SEQ ID NO: 49865 - protein, 380 aa, Glycine max
MALHCGTFCFWTVASHPPSSVKLSQPTIKASSFSSPLAPPLVKLNVRGKAFPGDGTPETKESPLVVCFGEMLIDFVPTVNGLSLAEAPAFKKAAGGAPANVAVGISRLGGSSAFIGKVGEDEFGYMLANILKENNVNNEGMRFDPGARTALAFVTLRSDGEREFMFYRNPSADMLLQEDELDLDLIRKAKIFHYGSISLITEPCKSAHIAAAKDAGVVLSYDPNLRLPLWPSADSAREGILSIWETADIIKISEEEISFLTKGENPYDDAVVHKLFHPSLKLLLVTEGAEGCRYYTKEFSGRVKGLKVDAVDTTGAGDAFVAGILSQLAVDLSILQNEDELRDSLKFANVCGALTVTERGAIPALPTKEAVLNAMLKPVS

SEQ ID NO: 49866 - protein, 330 aa, Glycine max
MASTNALPPTGNGLIVSFGEMLIDFVPTVSGVSLAEAPGFLKAPGGAPANVAIAVARLGGKAAFVGKLGDDEFGHMLAGILKENDVRSDGINFEKGARTALAFVTLRADGEREFMFYRNPSADMLLTPEDLNLELIRSAKVFHYGSISLIVEPCRSAHLKAMEVAREAGCLLSYDPNLRLPLWPSAEEARQQILSIWDKADVIKVSDVELEFLTGSDKIDDASALSLWHPNLKLLLVTLGEHGSRYYTKNFRGSVEAFHVNTVDTTGAGDSFVGALLSKIVDDQSILEDEARLREVLKFTNACGAITTTKKGAIPALPTEADALKLIKEA

SEQ ID NO: 49867 - protein, 174 aa, Glycine max
MGGSSETKLMQDLLLYAASAALSCLVLFAGLRHLDPNRESSKKALEHKKEIAKRLGRPLIQTNPYEDVIACDIINPDHIDVEFNSIGGLETIKQALFELVILPLKRPDLFSHGKLIGPQKGVLLYGPPGTGKTMLGKAIAKESRALFINVRISYLMSKWFVDAQKLDAAAFILA

SEQ ID NO: 49868 - protein, 254 aa, Arabidopsis thaliana
  misc_feature (102)..(102): Xaa can be any naturally occurring amino acid
  misc_feature (117)..(117): Xaa can be any naturally occurring amino acid
MEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIXVGTFAIDLERNGIHXMDSGKNAQKGNGFWGSRRDLAKWEKNGSPLGPIKTGENGAFLPKGGFPQVVWFLTKREKIFGGGGGTPPPLCGGGPKKKTPPPPRGGKKKISWGREKKKKKKIGGGGGAPPPPRGGGFILWRGGFYQGEGEKRGGRK

SEQ ID NO: 49869 - protein, 472 aa, Salmonella enterica subsp. enterica serovar Typhi str. CT18
MSQNVYQFIDLQRVDPPKKPLKLRKIEFVEIYEPFSEGQAKAQADRCLSCGNPYCEWKCPVHNYIPNWLKLANEGRIFEAAELSHQTNTLPEVCGRVCPQDRLCEGSCTLHDEFGAVTIGNIERYINDKAFEMGWRPDMTGVRQTDKRVAIIGAGPAGLACADVLTRNGVKAVVFDRHPEIGGLLTFGIPAFKLEKEVMTRRREIFTGMGIEFKLNTEVGRDVQLEDLLKDYDAVFLGVGTYQSMRGGLENEDADGVFDALPFLIANTKQIMGFGETSDEPYVSMEGKRVVVLGGGDTAMDCVRTSIRQGATHVTCAYRRDEENMPGSRREVKNAREEGVEFQFNVQPLGIEVNANGKVSGVKMVRTEMGEPDAKGRRRAEIVAGSEHVVPADAVVMAFGFRPHSMEWLAKHSVELDSQGRIIAPERSDNAFQTSNPKIFAGGDIVRGSDLVVTAIAEGRKAADGIMNYLEV

SEQ ID NO: 49870 - protein, 370 aa, Zea mays
  misc_feature (83)..(83): Xaa can be any naturally occurring amino acid
  misc_feature (174)..(174): Xaa can be any naturally occurring amino acid
  misc_feature (206)..(206): Xaa can be any naturally occurring amino acid
GVSEGCRTCYVKAVKEIEPALKKQLIISTTLMTVGIAVISWLALLAKFTIFNFGTQKDVSNWGLFFCVAIGPWAGLIIGFVTXYYTSNAYSLVQDVADSCRTGAATNVILGLALGYKSVIIPIFAIAVIIYVSFSIAAMYGIAVAALGMLSTIATGLAIDAYAPISDNAGGIAXRTDAVDAAGNTTAAIGKGFAIGSAALVSLALXFGAFVSRAGVKVVDVLSPKVFIGLIVGAMLPYWFSAMTMKSVGSAALKMVEEVRRQFNTIPGLMEGTAKPDYATYWKISTDASIKEMIPPGALVMLTPLIVGTLFGFETLYGVLAGALVSGVQPSLSRGCDFLFHCIGYDLRPLSHPIRRPSACARLVFSVSPP

SEQ ID NO: 49871 - protein, 296 aa, uncultured bacterium
MSQQQLQSIIQMLKSQPIAGKPSIAETRAGFEQMAAMFPVEADVKSEPVSAGGVKSEWVTAPGADAGRAVLYLHGGGYVIGSINTHRSLAGRISRAAKARVLVIDYRLAPEHPFPAAVEDSVAAYRWMLSTGLKPSRIAVAGDSAGGGLTVATLVAIRDAKLPVPAAGVPLSPWVDMEGVGDSMKSKAAADPMVQKDGLIEMAKAYLGGKDPRTPLAAPLYADLAGLPPLLIQVGTAETLLDDSTRLAERARKAGVKVTLEPWENMVHVFQIFAPILDEGQQAIDKIGAFIRANAE

SEQ ID NO: 49872 - protein, 201 aa, Vitis vinifera
MATRAFLLTSLLLSCLLQICSGAYFSSLQRTLIVTASPKAGEVLKSGEDKITVTWGLNQSYPAGTDSAYKTVKVKLCYAPISQVDRAWRKTVDHLTKDKTCQHKIVSQPYKASNNSVEWTIEKDVPTATYFIRAYAYDAEDQEVAYGQTTDAHKTTNLFGIEAITGRHASLDIAAVCFSAFSVISLCGFFWVEKRKSRVAK

SEQ ID NO: 49873 - protein, 305 aa, Magnetospirillum magnetotacticum MS-1
MNSVNATGARRHFLDLNEFDTATLRHILDLGLAYKQGKGPKAPLAGKMLAMIFEKPSTRTRVSFEVGMKQLGGDVIMLAAGDTQLGRGETIADTARVLSRFVDVVMIRTNLPEKMTELAKYADVPVINGLTDESHPCQVMADVMTFEEHRGSLKGKVVAWVGDGNNVAASWIHAAGHFGCEIRLACPESLMPSRKAVDWARARGTSVVLTTHPAEAVAGAHLVLTDTWVSMGCQDDNRHELLEPYQVNEALMAKASPDALFMHCLPAHRGEEVTDAIMDGHQSVVWDEAENRMHVQKGILTWCLA

SEQ ID NO: 49874 - protein, 296 aa, uncultured bacterium
MSQQQLQSIIQMLKSQPIAGKPSIAETRAGFEQMAAMFPVEADVKSEPVNAGGVKSEWVTAPGADAGRAVLYLHGGGYVIGSINTHRSLAGRISRAAKARVLVIDYRLAPEHPFPAAVEDSVAAYRWMLSTGLKPSRIAVAGDSAGGGLTVATLVAIRDAKLPLPAAGVPLSPWVDMEGVGDSMKSKAAADPMVQKDGLIEMAKAYLGGKDPRTPLAAPLYADLAGLPPLLIQVGTAETLLDDSTRLAERARKAGVKVTLEPWENMVHVFQIFAPILDEGQQAIDKIGAFIRANAE

SEQ ID NO: 49875 - protein, 386 aa, Aspergillus flavus
MTGLDMETIFAKIKEEYARTDDVGKRKIQGHIRELQVGFYSDWDVVMRLSSGPLQVALAKVGIDLGIFRSLKESDTPIALAEFVKKTGASPRLLGRILRTQAAFGLIKETGPQEYTSSAFTDVFANPAAAGAVVQLFDISGPCTQILPDFLAERHYQDITSNKDCVFQKAFDSDLTMFEWMPQHPKHMESLGHLMALERPVSWVDHFPVLEELGDFPAPDKVLMVDIGGGFGQQSKALRAKFPNIPGRVIVQDIPQTLANAQPAAGVEFMEHNFFESQPIRNAKFYYLRHVFHDWPDEQCVLILKQIIPVMGPESEILIDEMVIPSTGVPWQAAFTDLLMMNSLGGVERTRAEWDDLMKQAGLEIIQSKVYDSKEQTILVAVPRRT

SEQ ID NO: 49876 - protein, 242 aa, Debaryomyces hansenii CBS767
MELYSPEGLRIDGRRWNELRRFECRINTHPSSSDGSSYIEQGNTKIICMVQGPMEPSLRSQTNSSKASIEINLSVANFSTIERKKRLKNEKRLIELKTTLERTFEQSVICKLYPRTVIQINLHVLCQDGGLLAGMTNAITLALIDAGIAMYDYVSAINAGLYDQTPLLDLNTLEENDMSCLTIGVVGKSEKLALLLLEDKMPLDMLESVLAIGIAGGHRVRDLMDNEVRKHGNIRSSRLVDQ

SEQ ID NO: 49877 - protein, 323 aa, Saccharum officinarum
MAPALSFPIIDMGLLGGEERPAAMELLRDACESWGFFEILNHGISTELMDEVEKLTKDHYKRVREQRFLEFASKTLKDAQDVKAAENLDWESTFFVRHLPESNIAEIPDLDDDYRRAMRQFAGELEALAERLLDLLCENLGLDRGYLARAFRGPRTGAPTFGTKVSSYPPCPRPDLVSGLRAHTDAGGIILLFQDDRVGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKLYVRHKFEAKEPRFEAFKSVETDSSNCIAIA

SEQ ID NO: 49878 - protein, 265 aa, uncultured bacterium
MRLKDKIALITGAGSGIGEATAKTFAREGATVVVVDLNEDGAARVVSEIRKAGGAAESLRADVGVPAEIERMIKFARDRFGRLDVLHNNAVFTTVGRIGEISLEGWQKTLDVGLTAYWYATKCALELMLPARKGAIVNTASVSGLAGDYTLGAYNAVKAGVVNITRVTGIEYARKGIRCNAVCPGPIGTPPLLRMEDSRPDIVARIREAIPMGRLGEPQEIANVVLFLASDEASFVTGAFFVADGGLWAHSGMPSLSGQGPEWQG

SEQ ID NO: 49879 - protein, 296 aa, uncultured bacterium
MSQQQLQQIIQLLKSQPIAGKPSVAETRAGFEQMAAMFPVEADVKSEPVNAGGVKSEWVTAPGADAGRAVLYLHGGGYVIGSINTHRSVAGRISRAAKARVLVIDYRLAPEHPFPAAVEDSVAAYRWMLSTGLKPSRIAVAGDSAGGGLTVATLVAIRDAKLPLPAAGVPLSPWVDMEGVGDSMKSKAAVDPMVQKDGLIEMAKAYLGGKDPRTPLAAPLYADLAGLPPLLIQVGTAETLLDDSTRLAERARKAGVKVTLEPWENMIHVFQIFAPILDEGQQAIDKIGAFIRANAE

SEQ ID NO: 49880 - protein, 590 aa, Arabidopsis thaliana
MPKHYRPTGKKKEGNAARYMTRSQALKHLQVNLNLFRRLCIVKGIFPREPKKKIKGNHHTYYHVKDIAFLMHEPLLEKFREIKTYQKKVKKAKAKKNEELARLLLTRQPTYKLDRLIRERYPTFIDALRDLDDCLTMVHLFAVLPASDRENLEVKRVHNCRRLTHEWQAYISRSHALRKVFVSVKGIYYQAEIEGQKITWLTPHAIQQVFTNDVDFGVLLTFLEFYETLLAFINFKLYHSLNVKYPPILDSRLEALAADLYALSRYIDASSRGMAVEPKVDASFSSQSNDREESELRLAQLQHQLPSSEPGALMHLVADNNKEVEEDEETRVCKSLFKDLKFFLSREVPRESLQLVITAFGGMVSWEGEGAPFKEDDESITHHIIDKPSAGHLYLSRVYVQPQWIYDCVNARIILPTEKYLVGRIPPPHLSPFVDNEAEGYVPDYAETIKRLQAAARNEVLPLPGVGKEDLEDPQNLLYAGVMSRAEEAEAAKNKKKMAAQEKQYHEELKMEINGSKDVVAPVLAEGEGEESVPDAMQIAQEDADMPKVLMSRKKRKLYDAMKISQSRKRSGVEIIEQRKKRLNDTQPSS

SEQ ID NO: 49881 - protein, 586 aa, Arabidopsis thaliana
MDSHSSHLNAANRSRSSQTPSPSHSASASVTSSLHKRKLAATTAANAAASEDHAPPSSSFPPSSFSADTRDGALTSNDELESISARGADTDSDPDESEDIVVDDDEDEFAPEQDQDSSIRTFTAARLDSSSGVNGSSRNTKLKTESSTVKLESSDGGKDGGSSVVGTGVSGTVGGSSISGLVPKDESVKVLAENFQTSGAYIAREEALKREEQAGRLKFVCYSNDSIDEHMMCLIGLKNIFARQLPNMPKEYIVRLLMDRKHKSVMVLRGNLVVGGITYRPYHSQKFGEIAFCAITADEQVKGYGTRLMNHLKQHARDVDGLTHFLTYADNNAVGYFVKQEIPQSFTSKSSVSTLSYQGFTKEIYLEKDVWHGFIKDYDGGLLMECKIDPKLPYTDLSSMIRQQRKAIDERIRELSNCQNVYPKIEFLKNEAGIPRKIIKVEEIRGLREAGWTPDQWGHTRFKLFNGSADMVTNQKQLNALMRALLKTMQDHADAWPFKEPVDSRDVPDYYDIIKDPIDLKVIAKRVESEQYYVTLDMFVADARRMFNNCRTYNSPDTIYYKCATRLETHFHSKVQAGLQSGAKSQ

SEQ ID NO: 49882 - protein, 730 aa, Arabidopsis thaliana
MKTKTSIFQFIVASVLTLLINDSSAATPPPPISNSSTSCNKTCGGISIPFPFGIGGKDCYLNGWYEVICNTTTSDSNTTVPLLSMINREVVNISLPDSNEPYGLVQIKGPVTSLGCSSNTSEGPQNSLPVLNVTGKGSPYFLTDENRLVAVGCGIKALMTDTESEILGCESSCEHRKSGEEVTNLICTGYRCCQARLPVGRPQAITVNIENSSGGEETCKVAFLTDKRYSPSNVTEPEQFHNNGYVVLELGWYFATSNSRFKSLLGCTNMSRKGSGFSDDNCSCEYDYFSGMSYRNCYCDYGYTGNPYLRGGCVDTDSCEGNHNCGEDAHCVNMPGPMSMCRPNPKITKPTKPPVLQGILIGLSGLVFFVGLFWLFKLIKKRRNINRSKKFFKRNGGLLLKQQLTTKDGNVEMSKIFSSKELRKATDNFSIDRVLGQGGQGTVYKGMLVDGSIVAVKRSKVVDEDKMEEFINEIVLLSQINHRNIVKLLGCCLETEVPILVYEYIPNGDLFKRLHDESDDYTMTWEVRLRIAIEIAGALTYMHSAASFPIFHRDIKTTNILLDEKYRAKVSDFGTSRSVTLDQTHLTTLVAGTFGYMDPEYFLSSQYTHKSDVYSFGVVLVELITGEKPLSRVRSEEGRGLATHFLEAMKENRVIDIIDIRIKDESKLEQVMAVAKLARKCLNRKGKNRPNMKEVSNELERIRSSPEDLDVRTENEDEEEDQPMAINNKR

SEQ ID NO: 49883 - protein, 475 aa, Corynebacterium glutamicum ATCC 13032
MDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 49884 - protein, 294 aa, Arabidopsis thaliana
MGEVWRWNKEVEMDSIRDCLKHFSSIAIDTEFPGCLKETPMDASEEIRYRDMKFNVDNTHLIQLGFTLFDRRGITKTWEINLSDFNEHKCFKNDKSIAFLKSNGLNLDKIGEEGIGIEEFFRDFSQILKEKDGKITWVNFQGSYDNAYLVKGLTGGKPLPETKEEFHETVEQLLGKFVFDVKKIAESCSGLSSRFGLQRIADVLQMKRVGKAHHAGSDSELTARVFTKLTFDLLNSRKQCVRRVDHQQYQLEQQQLMMTRCYIPIPIPIPRPRSVMFAAHHPNPYFGGGYFGMP

SEQ ID NO: 49885 - protein, 471 aa, Acidovorax sp. JS42
MAKTVADVMKMVKENEVKFVDFRFTDTRGKEQHVTVPISHFDEDKFASGHAFDGSSVAGWKGIEASDMLLMPDPNTANIDPFFEETTMIMACDVVEPADGKAYDRDPRSIAKRAEAYLKASGMGDTAYFGPEPEFFIFDGVRWSTDPNHTFYEIEEYEAPWNTGAKLEGSNRGHRPTTKGGYFPVPPVDSTQDMRAEMSLILESLGIPVEVFHHEVAGAGQNEIGTRFSTLVERADWTMLQKYVIHNVANAYGKTATFMPKPYHGDNGSGMHVHQSVWKDGKNLFAGDGYAGLSDFALYYIGGIIKHARALNAITNPGTNSYKRLVPHFEAPVKLAYSAKNRSASIRIPFVANPKGRRVEARFPDPLMNPYLGFAALLMAGLDGVENKIHPGEAATKDLYHLPPEEDKLVPTVCHSLDQALEALDKDRAFLTKGGVFTDSMLDAYIELKMQEVTRFRMAVHPVEYDMYYSL

SEQ ID NO: 49886 - protein, 436 aa, Corynebacterium glutamicum ATCC 13032
MSETYVSEKSPGVMASGAELIRAADIQTAQARISSVIAPTPLQYCPRLSEETGAEIYLKREDLQDVRSYKIRGALNSGAQLTQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAAVKRVGDLNYTIVEKNQGRVHMMSATEGAVCTEMLDLYQNEGIIAEPAGALSIAGLKEMSFAPGSVVVCIISGGNNDVLRYAEIAERSLVHRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 49887 - protein, 341 aa, Vitis vinifera
MAPVLQSSQPWVEKYRPKQVKDVAHQDEVVRVLTNTLETTNCPHMLFYGPPGTGKTTTALAIAHQLFGPELYKSRVLELNASDDRGINVVRTKIKDFAAVAVGSGHRQGGYPCPPYKIIILDEADSMTEDAQNALRRTMETYSKVTRFFFICNYISRIIEPLASRCAKFRFKPLSEEIMSSRILHICKEEELNLDSEALSTLSSISQGDLRRAITYLQGAARLFGSIISSKDLISVSGVVPQHVVQALFAACKSGDFDSANKEVNNVIAEGYPVSQMLYQLFDVVVEADISDEQKARICKRLAEADKCLVDGADEYLQLLDVASNAMRALCNMPEEFPHES

SEQ ID NO: 49888 - protein, 343 aa, Vitis vinifera
MSTCDSLKSPEFEYINNHDASPVSFVETKTGTCLHLSKHVEITGNICKGDVEVETIDKIVNVDKNFLDPRFYAAIDCDIYSNLRASEAKKRPSIDFMERVQKDINPSMRAILIDWLVEVAEEYRLAPDTLFLTVNYIDRYLSGNVMNRKQLQLLGIACMMIAAKYEEICALQVAEFCYITDNTYSKEEVLQMESAVLNYLKFEMTVPTTKCFLRQFIHAAQGNNKDPSLQLECLASYLTELSLLEYNMLCYAPSLIAASATFLARFILFSAEKPWNSMLGHYTHYLPSHLHDCVKALHHLCCNNHGSGLPAIKEKYSQHKYKFVAKKYCPPCVPPEFFEDPSD

SEQ ID NO: 49889 - protein, 363 aa, Vibrio angustum S14
MGFKCGIVGLPNVGKSTLFNALTKAGIEAANFPFCTIEPNTGVVPVPDPRMDALAVFVNPERIMPTTMEFVDIAGLVAGASKGEGLGNKFLANIRETDAIGHVVRCFENDNIVHVAGRIDPLEDMDIINLELAMADLDTCERAIQRLAKRAKGGDNDAKFEIKVLEKMLPHLTEGGMLRALELTKEEKAAIDYLHFLTLKPTMYIANVNEDGFENNPFLDKVIARAAEENAVVVPVCAAMESEIAELDDEDREEFLADMGIEEPGLNRVIRSGYQLLSLQTYFTAGVKEVRAWTIPVGATAPKAAGVIHTDFEKGFIRAEVIGYDDYINCGGESGAKEAGKWRLEGKEYIVKDGDVVHFRFNV

SEQ ID NO: 49890 - protein, 350 aa, Cryptococcus neoformans var. neoformans JEC21
MPSHFFFSTSVKSDEQVLPRPNRRKKGAAKEGEENTRANRDGVGFGQANANLYHKNHIYQRCEDRAHARWWVYKHTSPKLLELITLIGVRGLYTGLTASVFRQMTYSVTRLGVYDLMKNTMSNNGAKKLRTGDMVICASVAGALGGVAGNPADIILVRYIVLGSNQAVLLMNCFCRHRMVADPTKPAENQMHYRNAIHGIYKMVSNEGVASLARGLAPNTIRAILMNASQLVSYDFFKEHILAANLMENGMPLHFVSSALSGTVATTICAPADVVKSRIMNMKAGAGGHGPVGLLLESLKHEGPRFLFKGWLPAWIRLTPNTICMFVFLEQLRNAVDLFRNPTAKSQSAA

SEQ ID NO: 49891 - protein, 476 aa, Vitis vinifera
MKRSSSDNHGKVTTVPSHLAKKRPPLSNITNQKNASLSGLKSSAAVGTMVPCAEKISKAKRGSSKISRSVGITGNTSSASLNVKPTAVIPCKDTSLPKSDGTASTVTALPDPCSLDVSPNRSDGISASMDETMSTCDSFKSPEVEYMDVDDLAVNSIERKTCSKLYISEHVEAEGNICSEDIHVETETNGKIADIDDNFGDPQFCATMACDIYKHLRASEARKRPSTDFMERIQKDVNASMRSILIDWLVEVAEEYRLVPDTLYLTVNFIDRYLSGNVMNRQQLQLLGVACMMIAAKYEEICAPQVEEFCYITDNTYFKEEVLQMESSVLNYLKFEMTAPTAKCFLRRFVRAAQGMNEVPSLQLECLANYIAELSLLEYSMLCYAPSLIAASAIFLANYILLPSKRPWNSTLRHYTLYQPSDLCDCVKALHRLCCNNHNSSLPAIREKYSQHKYKFVAKKYCPPSIPSELFHNLSN

SEQ ID NO: 49892 - protein, 168 aa, Oryza sativa Indica Group
RSEIHALVELLESKNPTPEPTDKLQDKVDGCWRLVYSTISILGKKRTKLGLRDFISLGDFFQMIDVKEEKAVNVIKFSARALKILSGQLTIEASYKITTKTKVDITLDSSTITPDQLMNIFQKNYDMLLAIFNPEGWLEITYVDESLRIGRDDKANIFVLERADPSEV

SEQ ID NO: 49893 - protein, 420 aa, Vibrio angustum S14
MTLLALGINHKTASVDLREKVAFSPEKLSLALQQLKNHPEVLSGVIVSTCNRTEVYCEISQSGPGVIIDWLTKFHQITAEELMPSLYFHEEQAAARHLMRVACGLDSLVLGEPQILGQVKQSYSESKDNEAVGGTLEKLFQKTFTVAKRVRTETDIGGNAVSVAYAACSLARQIFESLSGATILLVGAGETIELVSRHVVEQGCNSLIVANRTRERAEGIAQEFGAEVISLEEIPDHLHRADIVISSTASPLPIVGKGMVEMALKQRRHQPMLLVDIAVPRDIEQQVGELNDAYLYSVDDLHSIVEKNREQRKVAAIQAEAIVSEESAVFMQWLRSLEAVDSIRDYRQFAEEIKQELLQRSLQAIANGTEPEKALAELSNKLTNKLIHAPTKAMQQVAKNGESEKLAVIREALGLDSYND

SEQ ID NO: 49894 - protein, 336 aa, Staphylococcus aureus subsp. aureus
MAVKVAINGFGRIGRLAFRRIQEVEGLEVVAVNDLTDDDMLAHLLKYDTMQGRFTGEVEVVDGGFRVNGKEVKSFSEPDASKLPWKDLNIDVVLECTGFYTDKDKAQAHIEAGAKKVLISAPATGDLKTIVFNTNHQELDGPETVVSGASCTTNSLAPVAKVLNDDFGLVEGLMTTIHAYTGDQNTQDAPHRKGDKRRARAAAENIIPNSTGAAKAIGKVIPEIDGKLDGGAQRVPVATGSLTELTVVLEKQDVTVEQVNEAMKNASNESFGYTEDEIVSSDVVGMTYGSLFDATQTRVMSVGDRQLVKVAAWYDNEMSYTAQLVRTLAYLAELSK

SEQ ID NO: 49895 - protein, 353 aa, Vitis vinifera
  misc_feature (224)..(224): Xaa can be any naturally occurring amino acid
  misc_feature (352)..(352): Xaa can be any naturally occurring amino acid
MRRGSPIEKSLFCDWLMTINLEWKLIRIHASYIMGSANGLVSVQGKQPLFSFGVISDVQYADIPNGQSFMGVPRYYRHSIHVLQRAVQKWNNLQKLKFVVNFGDIVDGFCPKDQSLNAVQKIVDEFKNFDGPSYHMIGNHCLYNLPRNMLLPLLNIPSFEDRAYYDFSPTPTYRFVVLDGYDISAIGWPSDHPKTLEALKFLREKNPNLDKNSPVGLVGLERRXLMFNGAVGKEQMEWLDCVLQDATKLKQKVVVCCHLPLDPGTLSPEALLWNYDEVMDVIHKYNCVKVCLSGHDHKGGHSIDSHGIHHRVLEAALECPPGSDAFGYIDVYDDRLTLSGTDRMESTDMIFXP

SEQ ID NO: 49896 - protein, 176 aa, Mycoplasma genitalium G37
MDAHFLKSASDLKDCPQDNIPEICFMGRSNVGKSSLINAFFKKKLAKTSATPGRTQLLNYFEYKDKRFVDLPGYGFAKINKNKKDFITNLLTQFLNFRSNLVGVVLIVDSGVVTVQDQEVVKIILQTGLNFLIVANKFDKLNQSERYFSLKNIANFLKVNFDKCVLQVQKHIIILL

SEQ ID NO: 49897 - protein, 484 aa, Physcomitrella patens subsp. patens
MAAHNQASNLTFGCVAALQVVKARDASARRVKMAAVESGLAGVQLTKVRPGADVLKRAKRKSVVFQAVFTESEPEVNVANDISQEIIGAESQYFVQTYARSPVVFVSGKGCKLYDVEGNEYLDMTAGIAVNALGHGDPTWVKAVTEQAGKLAHVSNLFHTVPQVKLAERLVRSSFADRVFMVNSGTEANEAAIKFARKYHYALAKSNGDTAQGATELVAFTNGFHGRTLGALSLTSKIQYRTPFEPLVPGASFVNFGDLEATREIVAGKTAAVFVEPLQGEGGICPATASFLRGLRELCDETGTLLVFDEIQCGLGRTGRLWAHETYDVRPDIMTLAKPLAGGLPIGAVLVTDRVASSIAAGDHGSTFAGGPLVCHAALAVLDRIQAPGFLESVAEKGAYLKSQLNERLGKNSHVKEVRGEGLLVGIQLDVPASPLVASALKEKLLILTAGKGDVVRLAPPLIISKQEIDQAVDILVKCMPSLK

SEQ ID NO: 49898 - protein, 127 aa, Aegilops tauschii
TGEKGMGNSGKPLHYKGSSFHRIIPSFMIQGGDFTLGDGRGGESIYGTKFADENFKLKHTGPGYLSMANAGRDTNGSQFFITTVTTGWLDGKHVVFGKVLSGMDVVYKVEAEGKQNGTPKSKVVIAD

SEQ ID NO: 49899 - protein, 305 aa, Zea mays
MASFFADDGTDDLPRTTSHPFDSDDFGAAAADVAAADGYGGYASFAEGGVEEVDEEITVESDGVPIRHVSGGYSPSPFSPELEPNGGDGPILPPPTEMGRDEGILLREWRRKNAMELEKKEQKERELRAQIIAEAEEFKKAFFEKRIQNCASNMVNNREREKIFVASQEKFHAGADKQYWKSISDLIPHEIATIEKRGKKDKDKKPSITVVQGPKPGKPTDLSRMRHILVKLKHAPPPHMLQPPPPAPAAKEGTKDGSAKGGGKDGAKEGGAAAPANGAKQPAESQETTANGPSEAEKEQPAASE

SEQ ID NO: 49900 - protein, 279 aa, Arabidopsis thaliana
MPVNHRFTFSYRLLFLIFLLSFETAQRLVTGDPNDEACLTNLRRSLEDPANNLRNWTKSFFINPCSGFSSYLHGVICNNGRIYKLSLTNLSLRGSISPFLSNCTNLQSLDLSSNQISGEIPPQLQFLVNLAVLNLSSNRLSGQISPQIALCAYLNVIDLHDNQLSGQIPFQFGLLARLTAFDVSNNKLSGQIPSNLAMRNGNLPRFNASSFIGNKKLFGYPLEEMKNKGLSIMAIVGIGLGSGIASLVISFTGVCIWLKITEKKMEEEEGKISHSMPVY

SEQ ID NO: 49901 - protein, 163 aa, Triticum aestivum
RGRGRGQTPKKRGDERGGGATLGSTAWEAFRRHFSRKRAVDIRRINPKVPKEEAVAISGRLLQILADHGPLTVGSTWNHAKDAAIDGLNSKTHMKILLKWMWGRRIIKLSCTQAGNTKKFLYSPFTAEDTEAAEEPAEEQPKRKGWKGKHPKYQTKKQPATAA

SEQ ID NO: 49902 - protein, 386 aa, Physcomitrella patens subsp. patens
MGRGISHFNPQYVEPTPAHVFKDFPRDNQNKLQNGEIVGRGQFLGPESLTFDAQGRGPYTGVSDGRILRYDGPERGWTTFAYTSKNRSEVCAPKTSLAPNFAFEHVCGRPLGLRFHKETGDLWIADAYLGILKVGPEGGHAEVVLNEIEGVPMKFLNDLDFDDEGNLYFTDSSTRWQRRQFLHSVMEADDTARFIKYNLATKEATVLIDHLRFSNGVAVSKDGTFVVVAECRTGILWRYWLKGSKAGTHELFADLPGWPDNVRCNEAGDFWVALHARRCWSEEFLTKHPWIRYLIIRLPVPVQYVYKLLTGKPSGMILRYGPDGAVKEVLEDQEGKVVKMVSEVEEHDGKLYIGSVLLPYIVIYTLPPPATPATTPAEESTPLSSE

SEQ ID NO: 49903 - protein, 907 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGLWDEISEGLDYVQKEMSASLGDPSKPLLLSVRSGAAVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 49904 - protein, 256 aa, Frankia sp. EAN1pec
MRDRFALDGQVAVITGGGTGIGRGAALALAEYGADVVLAARRVEPLESTAKEVQAAGRRALSLPTDVTSAQQCQQLVDTTVAEFGRFDILVNCAGGAETKSIRRWTEEEWHQVLALNLGSVWFLSRAASVPMLQQGRGAIVNISSGASLLAMPQAAPYGAAKAGVNSLTRSMAAAWTGKGIRVNAIAVGAVRAATLTDDAARYGLDPEAIGLTNASGRLGEPDEIGNAVLFFASDAASFCSGQTLYVHGGPGPAGV

SEQ ID NO: 49905 - protein, 875 aa, Flaveria trinervia
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPEAYKELVENCEILERHYKDMMDIEFTVQENRLWMLQCRTGKRTGKGAVRIAVDMVNEGLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPSLKVGICGEHGGEPSSVAFFDGVGLDYVSCSPFRVPIARLAAAQVIV

SEQ ID NO: 49906 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDQNPRELRPEKGLLSIRKQLDLFANLRPVKVFESLSDASPLKKEYIDNVDFVIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 49907 - protein, 304 aa, Escherichia coli O157:H7 EDL933
MRLPIFLDTDPGIDDAVAIAAAIFAPELDLQLMTTVAGNVSVEKTTRNALQLLHFWNAEIPLAQGAAVPLVRAPRDAASVHGESGMAGYDFVEHNRKPLGIPAFLAIRDALMRAPEPVTLVAIGPLTNIALLLSQCPECKPYIRRLVIMGGSAGRGNCTPNAEFNIAADPEAAACVFRSGIEIVMCGLDVTNQAILTPDYLSTLPQLNRTGKMLHALFSHYRSGSMQSGLRMHDLCAIAWLVRPDLFTLKPCFVAVETQGEFTSGTTVVDIDGCLGKPANVQVALDLNVKGFQQWVAEVLALVP

SEQ ID NO: 49908 - protein, 114 aa, Oryza sativa
AYLGDTIEQVCTYKQAGTGPEFLEHCWPTGVTARGQEVDFVSRFFAPAVGVDEDPVTGSAHCSLIPYWSRRLAKRMLTAQQLSARGGQLRCRLEGDRVSIAGRAVTVMRGQLLL

SEQ ID NO: 49909 - protein, 193 aa, Bifidobacterium longum NCC2705
MAQSDITIDALSKVGQQDAEYLVSLVRSVPGFPKEGIIFRDFMPVLADPKGLKILLKALEEALPVSPSEFDSIAGLESRGFLFGPVMAAHLGKGFIAVRKAGKLPPETIGESYDLEYGTASVEIETDAVQAGKRVLIVDDLIATGGTAKAATDLIEKAGGTVVGFSFVMRLDGLDGLDKLDGKPSSSLIAMPA

SEQ ID NO: 49910 - protein, 121 aa, Zea mays
NESELGDIHVSAREGATDDIVKLLAAGVEVNVRDTEGRSPLHWAVDRGHLSAVEVLANANADLNAKDNEGQTALHYAAVCEREDIAELLVKHHADLRIKDEDGNTAHDLCPSSWSFMNQAN

SEQ ID NO: 49911 - protein, 226 aa, Arthroderma benhamiae
MARIGRILTLVVFAAVGLFLFMGQTVEAKGPKITSKVYFDIEHDGQPLGRIVMGLYGKTVPKTAENFRALATGEKGFGYEGSTFHRVIKDFMIQGGDFTNGDGTGGKSIYGNKFEDENFKLRHTKKGVLSMANAGKDTNGSQFFITTAITAWLDGKHVVFGEVLEGYDIVDKIQVVPKGFQDRPTKDVKIVKCGELDMKEEAEGEGTESPSKPDSEKEQAPVRDEI

SEQ ID NO: 49912 - protein, 382 aa, Escherichia coli O157:H7 EDL933
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPEAKKEDELPFHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIELIEQYRKTAK

SEQ ID NO: 49913 - protein, 423 aa, Candida albicans SC5314
MSSTKQDLPQARAPTLPSKTTPEQRYWRSYITPQLIKENHPITSIEFNPTTPNDFAIASATKIQVFSSKTRQVIKTFSRFKDVVYSGNYRYDGKLLVASDASGLVSIYDSYQPRNLLVSLTPSSHPTHVAKFHPTIGNQLITGSDDRMLRVYDISQTSNGPIIQFDNIDHEDYIRSVNFIPGDSNLIVTGCYDGNVRILDVRDPHRVVAKFDQENPVEDILAVSSNTLVSAGGPYVKIWDLNRMSQIHQLNNFNKSTTCLSNTHTNGLMVGSLDSTIKVFDYTSTNWQVQFGWKFGSGVLSCGVSPINQKHFVAGLTSGLISIRTKKTEPKVKQGIKNDVSGGYARMMKGRDYTGEEEDHIIESSKIITNKTNKSVNELMSSYKKYLGASGSIDDIKPNDLKQEISQCLKAKEICGMLELLGV

SEQ ID NO: 49914 - protein, 724 aa, Saccharomyces cerevisiae
MTKLFSKVKESIEGIKMPSTLTINGKAPIVAYAELIAARIVNALAPNSIAIKLVDDKKAPAAKLDDATEDVFNKITSKFAAIFDNGDKEQVAKWVNLAQKELVIKNFAKLSQSLETLDSQLNLRTFILGGLKYSAADVACWGALRSNGMCGSIIKNKVDVNVSRWYTLLEMDPIFGEAHDFLSKSLLELKKSANVGKKKETHKANFEIDLPDAKMGEVVTRFPPEPSGYLHIGHAKAALLNQYFAQAYKGKLIIRFDDTNPSKEKEEFQDSILEDLDLLGIKGDRITYSSDYFQEMYDYCVQMIKDGKAYCDDTPTEKMREERMDGVASARRDRSVEENLRIFTEEMKNGTEEGLKNCVRAKIDYKALNKTLRDPVIYRCNLTPHHRTGSTWKIYPTYDFCVPIVDAIEGVTHALRTIEYRDRNAQYDWMLQALRLRKVHIWDFARINFVRTLLSKRKLQWMVDKDLVGNWDDPRFPTVRGVRRRGMTVEGLRNFVLSQGPSRNVINLEWNLIWAFNKKVIDPIAPRHTAIVNPVKIHLEGSEAPQEPKIEMKPKHKKNPAVGEKKVIYYKDIVVDKDDADVINVDEEVTLMDWGNVIITKKNDDGSMVAKLNLEGDFKKTKHKLTWLADTKDVVPVDLVDFDHLITKDRLEEDESFEDFLTPQTEFHTDAIADLNVKDMKIGDIIQFERKGYYRLDALPKDGKPYVFFTIPDGKSVNKYGAKK

SEQ ID NO: 49915 - protein, 250 aa, Silicibacter sp. TM1040
MTEKSDSTTHFGFETVPEHEKAGRVQGVFNSVASKYDIMNDVMSVGIHRIWKDAMMDWLAPRPGQRLLDVAGGTGDISFRFLKRAGHGHSTVLDLTTPMLEEGRKRAEAEQMAECLDWVTGDAMALPFKDNTFDVYTISFGIRNVTRPQEALNEAYRVLKPGGRLMVLEFSQLPNDGLQKLYDLYSFNVIPRMGQMIAGDYDSYQYLVESIRNFPDQETFLGMVKSAGFENAKHRNLSMGIAALHSGWKI

SEQ ID NO: 49916 - protein, 275 aa, Triticum aestivum
  misc_feature (31)..(31): Xaa can be any naturally occurring amino acid
  misc_feature (40)..(40): Xaa can be any naturally occurring amino acid
  misc_feature (65)..(65): Xaa can be any naturally occurring amino acid
  misc_feature (86)..(86): Xaa can be any naturally occurring amino acid
  misc_feature (91)..(91): Xaa can be any naturally occurring amino acid
FPGRSKNLKLLNALFWAKKKRTGGGFPHHIXSPHGGFIAXPFSTPSLKWDFRPPLVKGTNVWGHXYGLVTPGFEWSFGGSKTDLPXELIFXIKYLGTDQPTFTLDFSKGASQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIVGELDAHAVHAIKLSTAAAAEGASKSTVDAVTEAFKGLAGNKKAGVC

SEQ ID NO: 49917 - protein, 203 aa, Escherichia coli O157:H7 EDL933
MERTLTTVSYYAFEGLIPVVHPTAFVHPSAVLIGDVIVGAGVYIGPLASLRGDYGRLIVQAGANIQDGCIMHGYTDTDTIVGENGHIGHGAILHGCVIGRDALVGMNSVIMDGAVIGEESIVAAMSFVKAGFHGEKRQLLMGTPARAVRSVSDDELHWKRLNTKEYQDLVGRCHASLHETQPLRQMEENRPRLQGTTDVTPKR

SEQ ID NO: 49918 - protein, 308 aa, Lactobacillus johnsonii NCC 533
MNKVTIVGSINVDNIMHIKKLPQPGETIAMSEFSKAAGGKGANQAVASSRAKNETIFVGRVGDDDNGRFMLEQFKENGINVDHVAVTPNQQTGQAYILLQETGQNSIIIQHGANFDVTAEDVRNAKSQIEDSDFVIAQFETPIEATIEAFKIAREAGKITILNPAPARTDIPEELLELTDLITPNETEAESITGIKVDSEESMKKSSEIFHQMGIKGVIITIGERGSYVSYEDIEEIVPAFKVKAVDTTAAGDTFLGALSSELKPDLSNLRDGVIYASKSSSFTVQKLGAFPSIPTREVVEEALKEKN

SEQ ID NO: 49919 - protein, 437 aa, Nicotiana langsdorffii x Nicotiana sanderae
MAYSCLHTILLCSLLFITSTTAQNQTSFRPKGLILPITKDASTLQYLTQIHQRTHLVPVSLTLDLGGQFLWVDCDQGYVSSSYKPARCRSAQCSLAGAGGCGQCFSPPKPGCNNNTCSLLPDNTITRTATSGELASDIVQVQSSNGKNPGRNVTDKDFLFVCGSTFLLEGLASGVKGMAGLGRTRISLPSQFSAEFSFPRKFAVCLSSSTNSKGVVLFGDGPYSFLPNREFSNNDFSYTPLFINPVSTASAFSSGEPSSEYFIGVKSIKINQKVVPINTTLLSIDNQGVGGTKISTVNPYTILETSMYNAVTNFFVKELVNITRVASVAPFGACFDSRTIVSTRVGPAVPQIDLVLQNENVFWTIFGANSMVQVSENVLCLGFVDGGINPRTSIVIGGYTIEDNLLQFDLASSRLGFTSSILFRQTTCANFNFTSIA

SEQ ID NO: 49920 - protein, 232 aa, Lactobacillus johnsonii NCC 533
MNKTEQDQLKKEAATKAAKMVEPNSVLGVGTGSTVAFFIDALGERKEREGFSLKHIVTTSNRSKKQLEGLGFKVDELADIDQADLTVDGADRVDDNLDGIKGGGGALTLEKNVAINSKKIIWIVDESKLVHHLSGFPLPVEVLPVSAEQNFKRFEAEGLKPQWRLNDEGKRYVTHYGNYIIDLAADPTPVPHGLADYLDHTVGVVEHGLFLDMCDEVIIAHSDGTIEDKKRK

SEQ ID NO: 49921 - protein, 307 aa, Lactobacillus johnsonii NCC 533
MSKKPLIISTDPGIDDIAAMTISLFADELDVKMIVPTWGNVSLAHTLQNTLDLENFLHTKVPVVKGANQPLVRPAISAASVHGETGIAGFKFEKANDDLLEPGLAATKMYEAIKNSPEKVTLLGVGPLTDFALLFKQYPDVVENVAEVYIMGGNIGHGNHSPFAEYNIAGDPEAAQIVFHSGLPVYVAPLEIGDEAHLTQDQMDKIKECGEVGKMLYSMFSNIHEPDGDTRIKIYDPTAVGIMLHPEFFTLKPANVEIELAGRYTYGASVMDFLSKKHNAQIATDVDTEKFAAWFIDSIKTANNGRK

SEQ ID NO: 49922 - protein, 142 aa, Oryza sativa Japonica Group
MLDPWFESKGLVDANQVLAYFAVSKLGEPPVDGITDTNPEGLTAAFGNWAPAVATRLQNGGLTCKVLEKEAFQKQMLEKLIWISAFMLVGARHPGATVGAVEKEYQSEFTLVILMGVPEDRDTVLRARQDLSRAGIVFTRDQ

SEQ ID NO: 49923 - protein, 513 aa, Rhodopseudomonas palustris CGA009
MADAATPPSGFQANLDRAAPLLKQLKADGIGHLIGGEIVAASSGEVFETASPIDNSVLAQVARGTAADIDRAAKAAKAAFPAWRDMAPAKRRKLLHTIADAIEARADDIAVLECIDTGQAHRFMAKAAIRAAENFRFFADKCAEARDGLNTPSDEHWNVSTRVPIGPVGVITPWNTPFMLSTWKIAPALAAGCTVVHKPAEWSPVTADMLARICKDAGLPDGVLNTVHGFGEEAGKALTEHPAIKAIAFVGETATGAAIMAQGAPTLKRVHFELGGKNPVIVFGDADLDRALDAVVFMIYSLNGERCTSSSRLLVQSSIADSFIEKLAARVRALKVGHPLDPATEVGPLIHQRHLDKVCSYVDVARKDGATIAVGGAPFDGPGGGHYVQPTLVTNARSDMQVAQDEVFGPFLTVIPFKDEAEAIQIANDVRYGLTGYVWTADMGRALRVADALEAGMIWLNSENVRHLPTPFGGMKQSGIGRDGGDYSFDFYMETKHVSLARGTHKIQKLGAV

SEQ ID NO: 49924 - protein, 116 aa, Triticum urartu
TGEKGMGNSGKPLHYRGSSFHRIIPSFMIQGGDFTLGDGRGSESIYGTKFADENFKLKHTGPGYLSMANAGRDTNGSQFFITTVTTGWLDGKHVVFGKVLSGMDVVYKVEAEGKQN

SEQ ID NO: 49925 - protein, 116 aa, Populus trichocarpa
MAEEGQVIACHTVDVWKEQFEKGKGTQKLIVVDFTASWCPPCKFIAPVFADLAKKLTNVTFLKVDVDELKPVAAEWEVEAMPTFIFLKDGKLVDKIVGADKDGLPALVEKHSVYTA

SEQ ID NO: 49926 - protein, 392 aa, Arabidopsis thaliana
MRKKMMISDLPHDLESEILSRVPAKSLAKWKTTCKRWYALFRDPSFVKKNFDKAGGREMIVLMNSRVYSNSVNLQGINNRFDPSMEVTGKLIKLNDSKGVDISAIFHCDGLILCTTTESTGLVVWNPCTGEIRCIKPRIFYRCNDRYALGYGNSKSSCHSYKILRSCCYYVDQNLSLMAAEFEIYDFSTDSWRDLGDITRDMIVYSSGVSLKGNTYWVSGSKEKGFFMRYFDFSKEVFGRLPLPYQSFNANHTAALSAVGNEKIAVLQQKILAMSDEMRIWVTNKIDEAKDLSWSNFLLTVDYGKFNLPCLVNVTSFLLDEENKVAVCSDVDTKDGLRSRIYIVGKDFYKEVFKDTRGSDNNWPLLLCYVPSLVSIQENIPNKAEENEIKGG

SEQ ID NO: 49927 - protein, 198 aa, Physcomitrella patens subsp. patens
MSDTPVVVIPRKGYVDGHHGYHHSYHSGLNLLLRLLQAFATAAAVIVMLLATQTEFTRYGEVRGRWRDYPAYKWFIIANAVVFVYALLATLVACCALIARRGPLSYSPSAWLTFLLDFVAASALMSAASAALAVALIARNGQNLQGQHYWPTFCNYVTRFCDYAQGAIIASFCGFGLLALSTLLAASALHHLAWHRLH

SEQ ID NO: 49928 - protein, 381 aa, Arabidopsis thaliana
MMSNLPLDLVEEILSRVPATSLKRLRSTCKSWNNCYKDQRFTEKHSVIAAKQFLVLMLKDCRVSSVSVNLNEIHNNIAAPSIELKGVVGPQMQISGIFHCDGLLLCTTKDDRLEVWNPCTGQTRRVQHSIHYKTNSEFVLGYVNNNSRHSYKILRYWNFYMSNYRVSEFEIYDFSSDSWRFIDEVNPYCLTEGEVSLKGNTYWLASDEKRDIDLILRFDFSIERYQRLNLPILKSDYETEALSVVREKQLSVLLKRNDTLEREIWVTTNDKIDHTTKNLLWIKFLAIDQRTCYHWSCVSFFIDEEKKMAVFCDGYIGGINETSRRMFYIIGEDKYYRELYVGDSPIRSHRPFVFNYVPSLVQIPQATVIPKRRRRKRKNRN

SEQ ID NO: 49929 - protein, 362 aa, Rhodopseudomonas palustris CGA009
MNISTSIPRFHPLTIADLRREGRDAISLSFTVPPELASAYQFVPGQYLTLRTTMDGEEVRRSYSICSGPDDGELRIAVKKVDGGAFSVWATEELKAGDTIEVMTPTGRFGALHAVEETRTYVGFAAGSGITPILSLIKGVLVREAGSRFFLFYGNRTTDQILFRESLETLKDRYLDRLAVFHVLSQEEQDVPVMQGRLDRDKVRLLLTAMVPAASVDHVFICGPTGMSDDVETTCRDLGIAAERIHVERFVSGLGGKPRPKAVVEPGAPPRAIASLIIDGKRREVPVAEGEAILDAALRAGVDLPFACKGGMCSTCRAKLVEGEAKMDLNYSLEPWELAAGFVLTCQAKPTTDRVVVDYDHL

SEQ ID NO: 49930 - protein, 181 aa, Oryza sativa
MASSRRRSEASREERLSKTMTYILRHGAEKEGIPINKDGYIKVSDLLKHPQLSGSNEAEIIRIVDACPKQRFSLKRMNDFSDKEEIFVRANQGHSLPDVKVDMTEISENDVSIESIIHGTFYQAWDTIKVQGISRMGRQHVHFSENSPSSQTPISGMRSSCQVAVYVDVKKALRGKLNLRL

SEQ ID NO: 49931 - protein, 268 aa, Oryza sativa Japonica Group
MRKRERENPCEICGHYHNSEEGERCGVCGHRSGPMAGEPPATLDPAFPTEVLKDFLFLGSYNNASRSEVLKTLSITHILNTVPDCQNLYRNSFTYHCIQDERSLDFDGANRFLEQCERETSRVLVHCMSGKNRSAAIVIGYLMKSRGWRLSQSYQWVKDRRPQVQLTDASQNQLVEYEQKLFGPNVGAPAQSSVPTESFRPLGFGFPKPAGDIQAPVFNQQPVPSIFERVNPSNIPSNFTFGAMEANTPMDDNGAPAPTSGDNPMDSS

SEQ ID NO: 49932 - protein, 413 aa, Salmonella enterica subsp. enterica serovar Paratyphi B str.
MPQQNYLDELTPGFTPLLAIKEASRCLLCHDAPCSQACPAQTDPGKFIRSIYFRNFKGAAETIRENNALGAVCARVCPTEKLCQRGCTRSGIDKPIDIARLQRFITDFEQQTAMQIYQPGSKTRGKVAIIGAGPAGLQASVTLTHLGYDVTIYEKQPQPGGWLRHGIPAFRLPQSVLDQEIARIVEMGVNIKCNCDVGGSLSLAQLKAEYRAVLMTVGMSCGSGLPLFEQASHVEIAVDFLQRARQADGDISVPRSALIIGGGDVAMDVASTLKILGCPSVTCVAREELAEFPASEKEFTSTQALGVSIIDGFTPVAVSGNKVTFHHVRHSGELTLEAENIILAVGQHARLDTFAEIKAQHNIIDTHNYQTDDPAIFAAGDIVKGDKTVVYAVKTGKEAAQAIHHYLEEACSC

SEQ ID NO: 49933 - protein, 455 aa, Physcomitrella patens subsp. patens
MFAGYTKVKSSIMVMGLSVHTTPVEMREKLAVPEAEWPRAIDELSSQNHIEEASILSTCNRFEIYVVAVSWNRGVKEVAEWMSKTSGIPVEDLMEHLFILRDQDATQHLFRVSSGLDSLVLGEGQILAQVRQVLKIGQEVSGFGRNLAGLFKQAITAGKRVRTETNISAGAVSVSSAAVELAVMKLPAGGVSRVSVLIVGAGKMSKLLVKHLISKGCTRMTIVNRSEQRVLDLQNEFPGANIVYESLTELLRCTGEADLVFTSTSSDVPLFTKENVEGLFPASQTSGGVRHFIDISVPRNVAACLSDLPGTRVYNVDDLKEVVAANKEDRRRKAAEAQVIIDDEIKNFEAWRDSLETVPTIKKLRSYAERVRQAELEKCLSRMPEDLTTKQKRALEDLSRGIVNKLLHGPMQHLRSDGADSKTVSEKIENMQALERMFDLGSEVLVVESKTKGKK

SEQ ID NO: 49934 - protein, 766 aa, Magnetospirillum magnetotacticum MS-1
MASNFHSEVSRNADSKGTDALERDTLLMHSSGRPGKIEVVPTKPLATQRDLSLAYSPGVAFPCLHIARDPSLAYDYTAKGNLVAVISNGTAVLGLGDLGALASKPVMEGKAVLFKRFADVDSIDLEVDTRDVEEFIAAVRYLGPSFGGINLEDIKAPECFIIEQRLRELMPIPVFHDDQHGTAIISAAGLINALDLTGRDISTVKVVVNGAGAAGIACIELAKAMGVRHENVTLCDTKGTIYQGRTEGMNQWKSAHAVPTKARTLAEALEGADVFYGLSVKGAVTPEMVASMAPRPIIFAMANPDPEITPEEVKSVRSDAIVATGRSDYPNQINNVLGFPYIFRGALDVRASTINDSMKIAAARAIAALAREDVPDEVDAAYSGRRLRYGPDYIIPVPFDPRLIASIPPAVAKAAMDSGVARKPIIDMGAYKRELSARLDPASAGMQTITEAVKANPKRVVFAEGEEEKQIRAAVAFANAGLGHPILLGREDRIRETMKNIGLPAAESLDIINSRISPRTKAYTDMLYARLQRRGALYRDVQRLVNQERNIFGSLMVQSGDADAMVTGLTRNYWQAFEEIKKVIDPTPGELLFGMTVFVVKGKLVFMADTTVMETPTPQQLADIAVQTAHKARQMGHEPRVAMISYSNFGNPSNERADRVREAVGILDSRKVDFVYDGEMAADVALDPDLLSHFPFCRLKEPANVLVMPGLYSATIASKLLQKLGGVSVIGPILVGLSKPVQITSMDATANDIVNMAVLASYDAVR

SEQ ID NO: 49935 - protein, 549 aa, Geobacillus stearothermophilus
MLTFHRIIRKGWMFLLAFLLTASLFCPTGQHAKAAAPFNGTMMQYFEWYLPDDGTLWTKVANEANNLSSLGITALWLPPAYKGTSRSDVGYGVYDLYDLGEFNQKGTVRTKYGTKAQYLQAIQAAHAAGMQVYADVVFDHKGGADGTEWVDAVEVNPSDRNQEISGTYQIQAWTKFDFPGRGNTYSSFKWRWYHFDGVDWDESRKLSRIYKFRGIGKAWDWEVDTENGNYDYLMYADLDMDHPEVVTELKNWGKWYVNTTNIDGFRLDAVKHIKFSFFPDWLSYVRSQTGKPLFTVGEYWSYDINKLHNYITKTNGTMSLFDAPLHNKFYTASKSGGAFDMRTLMTNTLMKDQPTLAVTFVDNHDTEPGQALQSWCDPWFKPLAYAFILTRQEGYPCVFYGDYYGIPQYNIPSLKSKIDPLLIARRDYAYGTQHDYLDHSDIIGWTREGVTEKPGSGLAALITDGPGGSKWMYVGKQHAGKVFYDLTGNRSDTVTINSDGWGEFKVNGGSVSVWVPRKTTVSTIARPITTRPWTGEFVRWTEPRLVAWP

SEQ ID NO: 49936 - protein, 311 aa, uncultured bacterium
MQLDPQMKAILDQAAAAGAQPFHTMTPAQARAAIDTMFQAFRGQPKEVAQSEDRKVPGPAGDIPIRIYTPAGSGPFGALVYFHGGGWVIGNIETHDVTCRDLAHGTPCVTVSVDYRLAPEHKFPAGPEDCYAATKWVSDNARSLNVDPNRIAVGGDSAGGNLAAAIALMARDRGGPKLAYQLLIYPAIDSADETPSHREFTKDGYILSRADMEWFWGHYLADKDRANPYACPSRAKSLAGLPPAFVLTAEFDPLRDEGEAYGQELRKAGVAVTAKRYDGVCHGFVSMASLLDAGKRAVAECCKELRGAIGR

SEQ ID NO: 49937 - protein, 589 aa, Debaryomyces hansenii CBS767
MSDITLGKYLFERLKQVEVSTIFGLPGDFNLTLLDKIYEVEGMRWAGNANELNAAYAADGYSRIKGLACLVTTFGVGELSAVNGVAGAYAEHVGLLHVVGVPSISSQANQLLLHHTLGNGDFTVFHRMSKNISHTTAFLSDSETAPAEIDRCIRDAYVYQRPVYLGIPANLVDVTVSSSLLEKPLDLSLKPNNAEAEEEAVELTLKLIEESKNPIILVDACASRHNCKQETKELVEITQFPVFTTPMGKGTIDEGGVGGLLEDDPSSIEKVKKKLDYGNSVSSRFGGVYVGNLSHPEVKEAVENADLILSIGSLLSDFNTGSFSYSYKTKNIVEFHSDYTKIRQATFPGVQMKEALQHLLKKVGQAALKYKPQPVPKVKLINTPASRDSKLTQEWLWTRVSSWFKEGDIIITETGTSAFGIVQSRFPNNTTGISQVLWGSIGFTVGATLGAVMAAEEIDPAKRVILFIGDGSLQLTAQEISTMIKWNTKPYLFVLNNDGYTIERLIHGENATYNDVQPWKNLDLLPLFSAEDYDAIRISTIGEAEDIFRDKEFEENTKIRMVEVMLPRMDASTNLIKQAEYLAKTNAAN

SEQ ID NO: 49938 - protein, 141 aa, Arabidopsis thaliana
MGDSSVSTSSWAAIDSANSFQVSSVMGESSGSSSSLAAINSSNIGFQLLKKHGWKEGTGLGIAEQGILVPLQAEPKHNKRGLGAKQPAKRKVAQPQAKDEEVSKQSKKLSKKMRKMMEHEKHLQEKEFERAFFREFWPDNV

SEQ ID NO: 49939 - protein, 526 aa, Physcomitrella patens subsp. patens
MQATQLLLEEPIRLASILEPSSPTAFSALTKIIGTLGPQSRDVETIEALLKAGMSVARFDFSWGNDAYHQETLENLKKAVRNTRRLCAVMLDTIGPELCVLNKEEHVIELQEGATVVLTADETRGASAEVLPLNYDGLASAVTKGDTIFLGQYLFTGSETTSVWLEVVETQGKDVVCTVKNTATLTGSLFTAHMSQVRIELPTLSEADLKTMATWGVKNQIDFVSLSYTRHPDDVRACREYLDKLGDLRQTQIFAKIENYEGLAHFDEILEEADGIILSRGNLGIDLPPEKVFLFQKVALQKCNAAGKASIVTRVVDSMVDSPRPTRAEATDVANAVLDGTDGIMLGAETLRGLYPVETITTIRKICAEAEKVFNQAVYFKRTIKAVREPMQHLESIASSAVRAASKVRASVIVVFTSSGRCARLIAKYRPTMPVLCVVIPRLTTNHLKWSFTGAFQARQCLAVRGLFPMLADPRHSSDSASTTNESILKVALDHGKAAGIVKAHDRIVVCQKVGDSSVVKIIELD

SEQ ID NO: 49940 - protein, 446 aa, Thermosynechococcus elongatus BP-1
MEAAEMGGTCVNRGCIPSKALLAAAGRVRELRQASHWQALGIQLGQVNVDRAGVAAHAANLVQKIRSDLTNSLKRLGVDILIGRGKIAGSQKVSITTPTGEKIITAKDIIIATGSVPWVPPGIEVDGKTVYTSDDAIKLDWLPQWVAIIGSGYIGLEFADIYTALGSEVTMIEALDQLMPTFDPDIAKQAQRILIAGRDIETYSGTLAKRVIPGSPVVIELADGKTQEVVDVLEVDACLVATGRIPATQDIGLESVGVSTDKRGFIPVNEYLAVTKKGKPVPHLWAIGDATGKMMLAHAASAQGIAVVETIVGRPRQVDYRSIPAAAFTHPEMSFVGLTEPQARELGEKEGFEVQVARTYFKGNSKALAETETDGLAKVIFRADTGELLGAHIFGLHAADLIQEAANAIRDRQTVSHLAFNVHTHPTLSEVLDEAFKRAHEMVTHR

SEQ ID NO: 49941 - protein, 373 aa, Carboxydothermus hydrogenoformans Z-2901
MKLFEYQVKKIMREFGILVPRGEVFFDLEQAKNHLEKVGEGVIKAQVLTGGRGKAGGVKIFSNPAEGFELAEAILKMTIKGEKVQAILIEEKIPIEQELYLSIFVDGRIKKPVVIASKAGGVDIEEVPEEEILKLPVDPLIGVRNYHGNLVAQKLGLTGDLGKQLATLLINLYRIFETYQAELVEINPLVISREKLIAADGKMTVDDDARFRWPADLPFNEEKTPLEKRAEEIGVSFVELDGDIAVMANGAGITMATLDLIAYFGGRPKNFMDAGGGANAEQMAKALDLLISTNPKAILINIFGGITRCDEVAKAYLTVKQEREITVPVVIRLVGTNEDIGVKMLQEAGVESFSSLREAVIKAVELAKVGGDN

SEQ ID NO: 49942 - protein, 448 aa, Candida albicans SC5314
MGKFLQLLSHPTELKAVIQLFGFRQPLHPGKRDVNDKELVRCYELLNLTSRSFAAVIEELHPELRDAVMIFYLVLRALDTIEDDMTIKSSIKIPLLREFDTKLNTKNWTFDGNGPNEKDRTVLVEFDKILNVYHRLKPQYQDIIKSITFKMGNGMADYILDEEFNVNGVATVEDYNLYCHYVAGLVGEGLTNLFVLANFGDKTLTENNFAKADSMGLFLQKTNIIRDYHEDLQDGRSFWPREIWSKYTENLQDFHKVKTPAKEFAGVSCINELVLNALGHVTDCLDYLSLVKDPSSFSFCAIPQVMAVATLAEVYNNPKVLHGVVKIRKGTTCRLILESRTLPGVVKIFKEYIQVINHKSSVRDPNYLKIGIKCGEIEQYCEMIYPNKQALPPSMKSLPENKFTKIVASRESIDLSVQRRIEQENFNCNVVLFGIGALILSLIYFVLY

SEQ ID NO: 49943 - protein, 254 aa, Oryza sativa Japonica Group
MLSQFSSSFLEGISTHVDPKLPFISLSKGLELNTLRTMSQIIPQALGNPRQPFIVLSGPSFAIELMNKLPTAMVVASKDKKLAAAVQQLLASPNLRISTSNDVTGVEIAGALKNVLAIAAGIVEGMHLGNNCMAALVAQGCSEIRWLATKMGAKPTTLSGLSGSGDIMLTCFVNLSRNRNVGLRLGSGEKLDEIMNSMNQVAEGVSTAGAVIALAQKYHVKMPVLTAVARIIDNELTPKKAVMELMNLPQVEEV

SEQ ID NO: 49944 - protein, 202 aa, Acidovorax sp. JS42
MSALETQALGMIPMVIEQSGRGERSYDIYSRLLKERVIFLVGEVNDQTANLVVAQLLFLESENPDKDISFYINSPGGSVTAGMAIYDTMQFIKPDVSTLCCGFAASMGAFLLAAGAKGKRYSLPNSKIMIHQVLGGARGQATDIEIHARDILRTKEQMNRILAERTGQPIEKVKADTERDYFMTADEAKDYGIVDQVIAKRP

SEQ ID NO: 49945 - protein, 606 aa, Arabidopsis thaliana
MVERKKRKQIQRNNSESNRNQKRRISHDKINRDELVVYRILCPIDVVGGVIGKSGKVINAIRHNTKAKIKVFDQLHGCSQRVITIYCSVKEKQEEIGFTKSENEPLCCAQDALLKVYDAIVASDEENNTKTNVDRDDNKECRLLVPFSQSSSLIGKAGENIKRIRRRTRASVKVVSKDVSDPSHVCAMEYDNVVVISGEPESVKQALFAVSAIMYKINPRENIPLDSTSQDVPAASVIVPSDLSNSVYPQTGFYSNQDHILQQGAGVPSYFNALSVSDFQGYAETAANPVPVFASSLPVTHGFGGSSRSEELVFKVLCPLCNIMRVIGKGGSTIKRIREASGSCIEVNDSRTKCGDDECVIIVTATESPDDMKSMAVEAVLLLQEYINDEDAENVKMQLLVSSKVIGCVIGKSGSVINEIRKRTNANICISKGKKDDLVEVSGEVSSVRDALIQIVLRLREDVLGDKDSVATRKPPARTDNCSFLSGSSNAGYTLPSFMSSMASTSGFHGYGSFPAGDNVLGSTGPYSYGRLPSSSALEILIPAHAMSKVMGKGGGNLENIRRISGAMIEISASKTSHGDHIALLSGTLEQMRCAENLVQAFVMST

SEQ ID NO: 49946 - protein, 344 aa, Glycine max
LTIYIYIGNSSESEVKGLKILNMKISILLCVVLLGFLGVCQGGSLRKKFYRDSCPQAEDIIKTKTQQHVSANPDLPAKLLRMHFHDCFVRGCDASVLLNSTASNTAERDAIPNLSLAGFDVIDDIKSAVEAKCPKTVSCADILALAARDAVSVQFNKPMWEVLTGRRDGTVSNSNEALANIPAPFFNFTQLKESFAGKGLTLHDLVVLSGAHTIGIGHCNLFSNRLYNFTGKGDQDPSLNTTYAEFLKTKCQSLSDTTTTVEMDPGSSTKFDSDYYPNLLQNKGLFQSDAALLTQEQSEDIAKELVDQNKFFTEFAQSMKRMGAIEVLTGSAGEIRNKCSVVNS

SEQ ID NO: 49947 - protein, 523 aa, Cryptococcus neoformans var. neoformans JEC21
MASRSPTDDQRLLDFRNATNFRSVKRADPSIIAILETSVYSVIYHYDERSGRWEKQKQEGPLFVVKREKSPEYLLYMLNRQTVKNPAIPLVPGEMKLTALDDGMLQVARRGDKTRIGVWFSEGHDIVQKFRATILGIVGEPSKRPEASFSPTPQAPQSAPSTAAPAEDGLSKLFAGLMKPSTAQPSVPQQSISSQQDNVYPTSVAVPVSQPIIPSPAPALAPVPPPTQPTVNIEASVSVPLAFAAAPVAAPAPAASEPTKYETADDLLASILGTAPPAPIIKSSSIAQQTVPQQPPAASAQYRQVSPLSYGSAPTPIHQATSPARAYTPQQQAYGQQANELTSPVQQPLAESHVRKSSKVGDATFAQAAQAAAANSALTSNPPMHALSSSSHYSASNDQVQAQGQSHARSHSQTSPKYSSYQSYQPIQRAYQRTSTPSSYRNGAESRTFMAEAMVDATVHKEQNDDVRIWGIELDAKKRKLEFRRRLVDLMMTDEMFVDNVWVAYLERMSAIRSSNSGQWNEG

SEQ ID NO: 49948 - protein, 374 aa, Arabidopsis thaliana
MMTLQSSPMSVLTEDLVEDILSRVPATSLVRLRSTCKQWNAILNDRRFIKKHFDTAEKEYLDMLLRSLRVSSMSVNLHGLHDNIDPSIELKRELNLKGLLCNSGKVESFEVFHCNGLLLFTNTSTIVVWNPCTGQTKWIQTESANTRYHKYALGYENKNLCRDYKILRFLDDGTNFELEIYEFNSSSWRVLDSVEIDFELDIGSQGMSVKGNTYWIVIDDHEVDGELVNCFLTSFDFTRERFGPHVCLPFQTSWYSDVISLSSVREERLSVLFHEEDSLTMEIWVTNDITDTIVTSWSKFLRVDLYTHRFYNGVTFFIDEENKAAVFSEDVPDDSDDIHSIVYIIGQDRLRIVDLEDGPFWPQMFCYVPSLVQI

SEQ ID NO: 49949 - protein, 256 aa, Rhodobacter sphaeroides
MRYAVQGGKRLRGFLVLESARLHGIAPEAAVSAAASIEALHAYSLVHDDMPCMDDDDLRRGLPTVHRKWDECTAVLAGDALQTLAFELLADPALGPAAVRIELVASLAKASGAEGMVLGQALDIAAETAAVPLTLDQITHLQAGKTGALIRWSAEAGAILGQADRVPLRRYATALGLAFQIADDILDVEGDAEKAGKRLQKDAEAGKATFVSLLGLDGAKARARALVEDAEAALAPYGPEAGTLIEAARFVISRES

SEQ ID NO: 49950 - protein, 436 aa, Lactobacillus johnsonii NCC 533
MKRQISFGQALATVVGTVIGGGVFFKIGSISHETGTSSLTLFVWILAGIVSIASGLTVSEIAAALPVTGGSIKYIEYTYGKVWGFLFGWAQMLVYFPANIAALSVIFGQQFVVLFNLPAKYATLIGLLLAIFLMGLNFISTKFSTRMQSVMTILKAIPIALIVLFGLFNSSKVDINLFPLSAGHNTSFWTGLSGGLLAALFAYDGWINVTNLAGEIEKPEKNLSRAIIIGLSAITLIYVLVNYAFLTAIPFKEIVGNQNTAYLASLKLFGSLGGKLVTIGILISVYGAINGFMLTGMRIPYTLAKNKMLPFSDKISRTNVNTGVPTLSALIILVVSLIMILLGTFDLLTNMLVFVMWTFTTLISIAVVILRYREPKLERPYVVPWYPIVPIISIGGGLFIVISTVINEFWLSITGIGLTLLGLPIYYYMKKQNNRQ

SEQ ID NO: 49951 - protein, 437 aa, Cryptococcus neoformans var. neoformans JEC21
MASRSPTDDQRLLDFRNATNFRSVKRADPSIIAILETSVYSVIYHYDERSGRWEKQKQEGPLFVVKREKSPEYLLYMLNRQTVKNPAIPLVPGEMKLTALDDGMLQVARRGDKTRIGVWFSEGHDIVQKFRATILGIVGEPSKRPEASFSPTPQAPQSAPSTAAPAEDGLSKLFAGLMKPSTAQPSVPQQSISSQQDNVYPTSVAVPVSQPIIPSPAPALAPVPPPTQPTVNIEASVSVPLAFAAAPVAAPAPAASEPTKYETADDLLASILGTAPPAPIIKSSSIAQQTVPQQPPAASAQYRQVSPLSYGSAPTPIHQATSPARAYTPQQQAYGQQANELTSPVQQPLAESHVRKSSKVGDATFAQAAQAAAANSALTSNPPMPKDSLTLAHILRRLQSIQATSLTSLSNALTSARQHPALIVTAQNLVLSWRKPW

SEQ ID NO: 49952 - protein, 288 aa, Rhodobacter capsulatus
MFSERLKEVQDGVEAAMAAAIGRLPAGDLRDAMAYAAQGGKRLRAFLAIESAAIHGISMEQAMPAALAVEALHAYSLVHDDMPCMDNDDLRRGLPTVHRKWDEATAVLAGDALQTLAFELCTDPVLGSAENRVALVAALAQASGAEGMVYGQALDIAAETAAVPLTLDEIIRLQAGKTGALISFAAQAGAIIAGADRALLAAYATALGLAFQIADDILDVEGDEEAAGKRLGKDAEAHKATFVSLLGLPGAKARAADLVAEAEAALAPYGEAAATLRACARYVIERDK

SEQ ID NO: 49953 - protein, 406 aa, Triticum aestivum
  misc_feature (138)..(138): Xaa can be any naturally occurring amino acid
  misc_feature (149)..(149): Xaa can be any naturally occurring amino acid
MAWRRLASRSRRCPTIPAAPRPAAPRPRPPAGPAAATPPLRRLLLPLSPPGFAAAAASSPARLLHAAAVRGGSRWLASDASASAAREPSAELVEVPLAQTGEGIAECELLRWFVSEGDHVDEFQQLCEVQSDKATIEXITSRFKGTVHXIQFAPGDIVKVGETLLKMIVNGSQVVPHDSLASSPDIQPGADTSTSPSREGNAPRGSLSTPAVRHLVKQYGLNIDDIQGTGKDGRVLKEDVLNYAARKGLLQEPPSASEENVGQVELEGGKPLLDPQFYEDKRIRLRGYQRAMVKSMTLAAKVPHFHYLEEINCDALVQLKASFQKENKDHDVKHTFLPFLIKSLSVALSKYPLLNSSFIDETNEVILKGFHNIGVAMATEQGLVVPTIKKVQSLSILEVSNNSFLP

SEQ ID NO: 49954 - protein, 289 aa, Rhodovulum sulfidophilum
MFQSSLKSAAERIETRLTEALAGAADQPVTQAMRYAVSGGKRLRGFLVLESAALYDIAPEAAVDAAAAVEALHAYSLVHDDMPCMDDDDLRRGQPTVHVKWDDGTALLTGDALQTLAFELLSAPACHPDPAVRIDLVASLARASGIDGMVLGQAQDIAAETAGRSLTLDEITELQANKTGALIRWSAEAGARLARADIAPLTAYSTALGLAFQIADDILDVEGDAAKTGKRVHKDAEAGKATFVSLLGLDGARARALALVEEAEAALDPFGGRADPLKAAARFVISRES

SEQ ID NO: 49955 - protein, 194 aa, Brassica rapa
KIPLYASNFARSSSGSSKSWITGLLALPAAAYMVQEQEVLAAEMERTFIAIKPDGVQRGLISEIVARFERKGFKLVGIKVVVPSKDFAQKHYHDLKERPFFNGLCDFLSSGPVIAMVWEGEGVIRYGRKLIGATDPQKSEPGTIRGDLAVVVGRNIIHGSDGPETAKDEINLWFKPQELVSYTNNAEKWIYGDN

SEQ ID NO: 49956 - protein, 403 aa, Methanopyrus kandleri AV19
MVVDKHARDAIRSGALSVFAPAVRRVRGRFRPGDVVKIETATGDFLGYAFAQTSDRDVRSGRAPGIVARIFDRKGEYPERSPDEIVLERIERRYRFRKRWKVDAHRDHMRVVFSEADDVPGLILDKFNDIAVFQTTCPAIERIILRNAAELLEILDVDTLYEKNDSRKRRQLGMEVRKRVVAGEERVETVVEEYGVRFAVNVEEGQKTGFYIDQVENRAKVQELVDGGRVLDVFTYVGGFAIHAAVGGAEEVVGIDKFDRVVQAAYRNADLNDVRDRVKFLVGDAFALLEKFERRGEEFDVVVLDPPAFVTSKEHLNRGRRAYFDVNYKALGLVRDGGLFVTCSCSHFLEPSDFVRLVNEAAARRSVRLRMLGPLRGQPPCHPIVPGNPDTRYLKAMFCAVEH

SEQ ID NO: 49957 - protein, 620 aa, Escherichia coli O157:H7 EDL933
  misc_feature (143)..(143): Xaa can be any naturally occurring amino acid
MDSHTLVQALIYLGSAALIVPIAVRLGLGSVLGYLIAGCIIGPWGLRLVTDAESILHFAEIGVVLMLFIIGLELDPQRLWKLRAAVFGGGALQMVICGGLLGLFCMLLGLRWQVAELIGMTLALSSTAIAMQAMNERNLMVTXMGRSAFAVLLFQDIAAIPLVAMIPLLAASSASTTMGAFALSALKVAGALVLVVLLGRYVTRPALRFVARSGLREVFSAVALFLVFGFGLLLEEVGLSMAMGAFLAGVLLASSEYRHALESDIEPFKGLLLGLFFIGVGMSIDFGTLIENPLRIVILLLGFLIIKIAMLWLIARPLQVPNKQRRWFAVLLGQGSEFAFVVFGAAQMANVLEPEWAKSLTLAVALSMAATPILLVILNRLEQSSTEEAREADEIDEEQPRVIIAGFGRFGQITGRLLLSSGVKMVVLDHDPDHIETLRKFGMKVFYGDATRMDLLESAGAAKAEVLINAIDDPQTNLQLTEMVKEHFPHLQIIARARDVDHYICLRQAGVEKPERETFEGALKTGRLALESLGLGPYEARERADVFRRFNIQMVEEMAMVENDTKARAAVYKRTSAMLSEIITEDREHLSLIQRHGWQGTEEGKHTGNMADEPETKPSS

SEQ ID NO: 49958 - protein, 403 aa, Zea mays
MGALSRPEEVLALVKLRVAAGQIKRQIPPEEHWAFAYSMLQKVSRSFALVIQQLGPELRNAVCIFYLVLRALDTVEDDTSIPTEVKVPILQEFYRHVYNRDWHYSCGTNHYKVLMDKFHLVSTAFLELGQGYQKAIEEITRRMGAGMAKFICKEVETVDDYDEYCHYVAGLVGYGLSRLFYAAGTEDLAPDSLSNSMGLFLQKTNIIRDYLEDINEIPKSRMFWPREIWSKYADKLEDFKYEENTEKAVQCLNDIVTNALIHAEECLQYMSALKNHAIFRFCAIPQIMAIGTCALCYNNVHVFRGVVKMRRGLTARIIDETNSMSDVYTAFYEFSSLIESKIDDNDPNAALTRRHVNSIKQTCKSSGLVKRRGYHLDTSPYRPMLIMIVLLLVAILFGALYTK

SEQ ID NO: 49959 - protein, 312 aa, Methanopyrus kandleri AV19
MRLKRLSTNHLLSIADLDREDVETVLRVAERFKERYLAGERVIPILEGKTLGLIFEKPSTRTRVSFEVAMHQLGGQAFTYTKQELQLGRGEAIKDTAAVLSRYLDGVMIRARRHEDIEEFARYSEVPVINGLSDLEHPCQALTDAFTIREKLGRGPHTVAFVGDGNNVCSSLALVCATLGWDFVHAVPEGYECPDRVWREVERRAEESGSETRVVRDPKEAVREADVVYTDVWVSMGDEAEREERLRVFRPYQVNEELMSHAPEHAIVMHCMPIQRGYELTDDVADSERSVIYDQAENRLHVQKAILALLMG

SEQ ID NO: 49960 - protein, 273 aa, Brassica napus
GWCLLRGGRGFGGGRGDRGGRGGPRGRGGRRGGRPTEEEKWTPVTKLGRLVQAGKIQKLEQIYLHSLPVKEYQIIDLLVGPTLKDEVMKIMPVQKQTRAGQRTRFKAFVVVGDTNGHVGLGVKCSKEVATAIRGGIILAKLSVIPVRRGYWGNKIGKPHTVPCKVTGKCGSVTVRMVPAPRGAGIVAARVPKKVLQFAGIDDVFTSSRGSTKTLGNFVKATFDCLQKTYGFLTPEFWKETSFKKSPYQEYTDLLAEKGIATKAITEVEDQAAS

SEQ ID NO: 49961 - protein, 482 aa, Nocardioides sp. JS614
MPWAAGREVNARDRTGTNLVNGNRTFAVEDPATLELIAEVADHGETEARAAVDRAHEAFAGWSGTSPRQRSDVLRRAYELMLRDEGRLSALIARENGKSLADAASEVVYAAEFFRWYAEEVVRTEGSYGEAPAGGVRTIVHHKPVGVAALVIPWNFPAAMATRKIAPALAAGCTVVLKPAAETPLTAIAIADLLAEAGLPAGVVELVTTTHAGAVVTAWLEDDRVRKVSFTGSTGIGRLLLHQAADRVVNTSMELGGNAAFIVTEDADLVDAVAGAMIAKFRNGGQACTAANRIYVHRDVADAFVALVGAQVEKLSVGAANDGNMIGPLISAAAVSRVGAAVDRAIEEGARVAARAQLPDAPGYFYPPTVLTDVPSTSSILAEEIFGPVAPIATWDDEQELLRQVNGTEYGLAAYVYTGHLERGLRLGERIEAGMVGINRGIVSDPSAPFGGVKQSGLGREGAREGLREFQETQYLSISWDD

SEQ ID NO: 49962 - protein, 408 aa, Leptospira interrogans serovar Lai str. 56601
MANINENYLKLKAGYLFPEISKRVKIYSEKNPSAKIIRLGIGDVTLPIVPSVVDAMVEASKEMGTVGGFHGYGPEQGYSFLLKSIADHDYGSLGIKIDESEIFVSDGSKCDCGNIQEIFSTDSKIAVADPVYPVYVDTNVMAGRTGEIGPDGRYSNLIYMPATKENGFQPEIPKEKADIVYLCYPNNPTGTVTTKESLKAWVEYAKKNNSIILYDSAYEAFISEPGVPRSIYEVEGAKEVAIEFRSFSKTAGFTGLRCAYIVIPKELKGKTRSGEEVSLNSLWNRRHTTKFNGVSYVTQKGAEACYSPQGKKEIQTSIAYYMANASKIRDGLKKAGYEVFGGVNAPYIWLKTSDNLSSWDFFDKLLNKAQVVGTPGSGFGPAGEGYFRLSAFGKKEDVEEAIARITSL

SEQ ID NO: 49963 - protein, 172 aa, Thermosynechococcus elongatus BP-1
MKHTLSVLVEDEAGVLTRIAGLFARRGFNIESLAVGPAEQIGISRITMVVPGDDAVIEQLTKQLYKLINVLKVQDITTIPCVERELMLLKVNATASTRSEILELVQIFRAKVVDVSDDSLIIEVSGDPGKMVALVQMLNKFGIREIARTGKIALVRESGVNTEYLKSLEARV

SEQ ID NO: 49964 - protein, 294 aa, Carboxydothermus hydrogenoformans Z-2901
MEKYLEKTKVLIEALPYIKKFYGKTIVIKYGGHAMVSDQLKEAVINDLVLMKFVGINPVVVHGGGPEISRMLNKLNIKSNFINGLRVTDEATLEVVEMVLVGKVNKEIVGLIEKAGGKAVGLSGKDAGLIKAHKKLAKNPEPTGEEYLDLGYVGEISEVNPEILLTLIDKGYIPVVAPVGSNGSGEFYNINADEVAAEVAVALKADKLIVLTDTPGILLNEKDENSLLSKATIAEVKELINRGVIRGGMIPKAESAISAIKRGVGSVHIIDGRIAHSLLLEIFTDAGVGTMLTP

SEQ ID NO: 49965 - protein, 682 aa, Rhodococcus sp. RHA1
MTSNLDSAAKKLRKNVSGVSGEAASVSPLQKAAQGLIGTVTDKAMSTVSDKVQGAAGRLTDYAEGGGGSLLSAVTGTGNGNGNGDGDGNEKGDGKSLFSGLTDKVKDTASNLKDAVTGGGGGGKGKKLKLTNIVETIDVGVPVQLAYNQWTQFADFPSFMKKVERVEQEADEKLEWKAQIFLSHRTWEASILEQVPDERIVWRSKGAKGFIDGAVTFHEVTPDLTRIVLILEYHPKGLFEKTGNLWRAQGRRARLELKHFGRHVMTQSVLHPDEIEGWRGEIRDGKVVEPEESEDNNEEPTDDETAAATGEQDRSDEETAEDEEPEEESEEEPEDEAGEYEEEEPEDEAGEYEEEEPEEEPEEEEPEEETGEYEEEEPEEETGEYEDEESEEEPEEEEPEDEAGEYEEEEPEEEEPEEETGEYEEEEPEEEPEEEEPEDEAGEYEEEEPGEEEPEEEPEEENPEDEAGEYEEEEPGEEEPEEEPEEENPEDEAGEYEEEEPGEEEPEEETGEYEEEEPEEETGEYEEEEPGEEESEEEEEEPEPRRRRPRTAAAKRTPAKRTPAKKAPAKKAPAKKAAAKKAAAKKAAAKKAAAKKAAAKKAPAKKAPAKKAAAKKAAAKKAPAKKAPAKKVAAKKAAAKKAPAKKTAAKKAPAKKVAAKKAPAKRTPAKKATPRRRTGARA

SEQ ID NO: 49966 - protein, 907 aa, Triticum monococcum
MYTKGPPLDVLRASISSAPSTSSHGSAQDDCDSLGDVYVWGEVVCDNSARTSSDTVIRSTGKTDFLLPKPLESNLVLDVYHVDCGVRHASLVTRNGEVFTWGEDSGGRLGHGTREDSVHPRLVESLAACNIDFVACGEFHTCAVTTTGELYTWGDGTHNVGLLGHGTDVGHWIPRRISGPLEGLQIAYVSCGTWHTALITSMGQLFTFGDGSFGVLGHGDLKSISCPREVESLSGLKTIAVACGVWHTAAIVEVIVTQSSATVSAGKLFTWGDGDKHRLGHGDKEARLKPTCVASLIDYDFYRVACGHSLTVGLTTSGKVWTMGNSVYGQLGNLNSDGRPCLVEDKIASEHVLQIACGSYHVAVLTSRSEVFTWGKGANGRLGHGDIEDRKVPTTVEALRDRAVRHIACGANFTAAICLHKWVSGADQSQCSSCRQPFGFTRKRHNCYNCGLVHCNACTSRKALRAALAPSPGKLHRVCDSCYSKLKNASSSANKKDLAPGESNGEARVGKSILSSNMDMIRSLDSKAAKQGKKTDALSFLRNPQVSSLLQLRDIAFSGGADPNRPAVPRAARTPAARSVTSSRAVSPFSRRSSPPRSTTPVPTTHGLSLSKSATDNLVKANELLSQEVERLRAQVDSLRNRCDHHELELHKSAKKVQEAMTLVAEESAKSKAAKEVIKSLTAQLKDMAERLPPEHGAYDFNEAKQVHVPNGVEPHVATYSSMNGKVHQARNELLNAPSPNSGRSPHSNGGISNQHKLLGNISENSEGSTHSLRITSPHGSDRPHRRAHSNSDEMLSASSRGDDNVSIDARSLQNGDDSYKPRGTISISSNQVQAEWIEQYEPGVYITLTTLRDGTRDLKRVRFSRRRFGEHQAENWWNENREKVYEKYNVRSSERVSSAASTRSAY

SEQ ID NO: 49967 - protein, 579 aa, Lactobacillus johnsonii NCC 533
MSKTLKGIAASDGIAVAPAYLLVEPDLSFSKTSVSDVDAEVARFKKVVEESTKELEKVRDKAKESLGPEEAQVFDAHLLFLSDPEFTGAIETEIKDQKINAEAALDETAQKFITIFEGMTDNAYMQERAADVRDVSKRLMAHLLGKKLPDPAAIDHEVVVVAYDLTPSDTAQLNKKYVKGFVTDVGGRTAHSAIMARSLEIPAVVGTETITKDVKDGDMLIADGLDGDAIINPTDAQIEEYTKKGEAFAKQKEEWKKLKNEPSVTANGKKFIIAANIGTPNDMKGVKENGAEAIGLYRTEFLYMDSKDFPSEEAQFDAYKKVIEDMDGKQTIIRTCDIGGDKHLDYWDLPEEMNPFLGVRAIRLSMQYKDIFRTQLRALLRASAYGPLGIMFPMIGTLAELREAKQILAEEKDKLAKEGVKIGDDLQVGMMIEVPAAAVLADQFAKEVDFFSIGTNDLIQYTMAADRGNDNVSYLYQPYNPSVLRLIKHTIDGAHENGIWCGMCGEAAGDDIMFPILLSMGLDEYSMSATSILRIRSLMKKINTEDIKELANKACFVSETADENKKLVEETMKKLNILD

SEQ ID NO: 49968 - protein, 434 aa, Carboxydothermus hydrogenoformans Z-2901
MSRVNLGYLTEQIKEHEFLKPWGVVRQVIGLTVEAHGLKVSVGETVEILAGNARVLAEVVGFKEENAILMPLGEINGISLGSLVRPLRRQLQITVGKSLLGKVLDGLGRPLNADKIYGRHFSLDRKPPKPLHRRRIKKPFATGIKAIDGPLTCGEGQRLGIFAGSGVGKSTLLGMIARYAEADVNVIALIGERGREVLDFIENDLGEGIKKSVLVVATSEQPALFRVKGAFVATAIAEYFREQGKKVLLMMDSLTRFAMAQREIGLAAGEPPSSRGYTPSVFALLPKLVERAGNDDKGSITAFYTVLVEGDDFNEPIADAVRGLLDGHIVLSRQLAGKGHYPAIDLLASNSRLMPELVDEQHLALTLKMREILDIYRQNEDLILIGAYKPGTNPLLDRAIQLVPKINQFLQQKQNEKVDFTTTKEMLKTLFVEE

SEQ ID NO: 49969 - protein, 407 aa, Triticum monococcum
MAAVAMADGGGKKPYVVAVAIQAINTGTFVVSKAAFDSGMYTYIFVFYRLAAATALLVPIALINCACRRSQSTTSTPAQAMSCRLLFKLFLCAFLGSAGLTLQALTKFVKKSCQEVGGFTSLLSSSLLQGKAEHLHPQVYHASLKQTSATVASAATNSMPVVTFLLALVLRMETIKLRRRSGLGKLAGVALCLAGVLVIAFYVGPSIRPLAHHPVFAHKTQSVGNGAWIRGTFLLILSCTTWSLWITLQVPLLIEYPNKLMATAMQCLFSALQSFVVAVVVEKDFTKWKLGLDIGLLAAFLGTGALMYLQAWCAEMSGPVFVVMWSPLAFIFTIFSSSFFLGEVVHLGSILGGILLVGGLYSVLWGKSNERKNMILPVMPEKSQGQGDGDGATTQEKHGETNLTSQV

SEQ ID NO: 49970 - protein, 792 aa, Klebsiella pneumoniae subsp. pneumoniae MGH 78578
MSNNGSSPLVLWYNQLGMNDVDRVGGKNASLGEMITNLSGMGVSVPNGFATTADAFNQFLDQSGVNQRIYALLDETDIDDVSALAKAGAQIRQWIIDTPFQSELENAIRDAYDLLSADDAEASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAAGRPAIVRRTMGSKKIRMVYAPTQEHGKQVRIEDVPQAQRDIFSLSNEEVQELAKQAVQIEKHYSRPMDIEWAKDGHTGKLFIVQARPETVRSRGQVMERYTLHAQGQIIAEGRAIGHRIGAGPVKVIHDISEMNRIEPGDVLVTDMTDPDWEPIMKKASAIVTNRGGRTCHAAIIARELGIPAVVGCGDATDRIQENQNVTVSCAEGDTGYVYAELLDFSVKSSSVGDMPDLPLKVMMNVGNPDRAFDFACLPNEGVGLARLEFIINRMIGVHPRALLEFDDQEPGLQNEIRELMKGYDSPREFYVGRLTEGIATLGAAFYPKRVIVRLSDFKSNEYANLVGGERYEPEEENPMLGFRGAGRYVSESFRDCFALECEAMKRVRNDMGLTNVEVMVPFVRTVAQAKAVVEELERQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLGLAELKK

SEQ ID NO: 49971 - protein, 106 aa, Glycine max
  misc_feature (75)..(75): Xaa can be any naturally occurring amino acid
DDELLVPLKFVLLNIGKKGKEAWPPWFKAYKHEVFSRGKPDDERKISKGSGNPKKKLRDYFFPTAIYCAKKGDFXKVSPPLQLVGPPFYEPPGKGKYVCLPPAWGN

SEQ ID NO: 49972 - protein, 399 aa, Bacillus thuringiensis serovar konkukian str. 97-27
MAVEVVMPKLGMAMKEGVITSWNIKAGDYVSKGELIASINSEKIETEIEAPADGTVLDIAVSEDEGVPPGTVICYIGKSNEKVEVYESTNVVEEKTSNPEPKKVPHPDPYVIDVTKQRVKISPVAKKIAKTENLDIKSLLGTGPGGRITKVDVLKALEERVAISEVLEQEESKVVPVTGMRKAIANRMHASLQNSAQLTLTMKVDVTDLVALHKDVAEVVQKRYDNKLTITDFVSRAVVLALKEHKEMNSAYIDDAIHQYKHVHLGMAVALEKGLVVPAIRFANNLSLVELSKEIKNMAQKARAGNLSSDDMQGTTFTISNLGSFGIEYFTPVLNTPETGILGVGAIEHVPVYKGKKLRKGSMLPLSLTFDHRVLDGAPAAAFLRTIKRYLEEPVTILL

SEQ ID NO: 49973 - protein, 557 aa, Cryptococcus neoformans var. neoformans JEC21
MALSQHVDADKLIEECKDHPIKRHLSHKAALYDIPYTSRYEVEDEVPRYRLPSKGVNGRATYQLLHDELMLDGNPNMNLASFVHTWVPDECNRLVQENINKNLVDQDEYPAAQQIHERCISMLSHLWHAPKEATAMGTATTGSSEAIMLGGLALKRRWQEKMKAAGKDIHNPGPNIVMGAEAQVALEKFARYFEVEARLVPIKPESSYVMDPKDVLKYVDENTIGVFVILGSTYTGAFESVKDVAQELDKYEAETGISVPIHVDAASGGFVAPFAYPHYQWDFQIPRVHSINASGHKYGMSTVGVGWIIWRSMEYLPKELIFELHYLGATDYSFNLNFSRPAHPILAQMFTFLNLGFEGYKRIMDKNLTVARLISRALEHSGYFICLSKIHHPKALTESSSSAEQSNILPAVADAANTVLHGKKTTVDDAEYYCEGLPVVSFMFTDEIKKKYPGVKQAWIQMQLRSIGWIVPNYPLAPDCEKTEILRVVVRESLSGDLARKLIHDILQVTEDLLNDAGPSYSMSTATRRHENLDHGKLDNIDAVHIKQHTSTYSKPC

SEQ ID NO: 49974 - protein, 285 aa, Arabidopsis thaliana
MAERGGERGVERGGERGDFGRGFGGRGGRGDRGGRGRGGRGGRRGGRASEEEKWVPVTKLGRHVAAGHIKQIEQIYLHSLPVKEYQIIDMLIGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGNFVKATFDCLQKTYGFLTPEFWKETRFSRSPYQEHTDFLASKALSTSKPDPVVEDQA

SEQ ID NO: 49975 - protein, 222 aa, Bifidobacterium longum NCC2705
MSNIAIAPSILSADFCNLERDLKAIANADLVHVDVMDHHFVPNLTLGEPIVGRICQVTDLPVDVHLMIEDPDRWAPEYAKLGAASVSFHMGATHAPVRLARQLREMGCKACFAVRPAEPVEPIFDILDEFDMVLIMTVEPGFGGQKFLDNQMSKVRRLRDEITRRGLKTRIQVDGGVSPKTAHIVAEAGADVLVAGSAVYGAENPAQAIDDIRTKAEAAFKA

SEQ ID NO: 49976 - protein, 516 aa, Glycine max
LVLLSLLSIVISIVLFITHTHKRNNTPRGPPGPPPLPLIGNLHQLHNSSPHLCLWQLAKLHGPLMSFRLGAVQTVVVSSARIAEQILKTHDLNFASRPLFVGPRKLSYDGLDMGFAPYGPYWREMKKLCIVHLFSAQRVRSFRPIRENEVAKMVRKLSEHEASGTVVNLTETLMSFTNSLICRIALGKSYGCEYEEVVVDEVLGNRRSRLQVLLNEAQALLSEFFFSDYFPPIGKWVDRVTGILSRLDKTFKELDACYERSSYDHMDSAKSGKKDNDNKEVKDIIDILLQLLDDRSFTFDLTLDHIKAVLMNIFIAGTDPSSATIVWAMNALLKNPNVMSKVQGEVRNLFGDKDFINEDDVESLPYLKAVVKETLRLFPPSPLLLPRVTMETCNIEGYEIQAKTIVHVNAWAIARDPENWEEPEKFFPERFLESSMELKGNDEFKVIPFGSGRRMCPAKHMGIMNVELSLANLIHTFDWEVAKGFDKEEMLDTQMKPGITMHKKSDLYLVAKKPTT

SEQ ID NO: 49977 - protein, 371 aa, Aquifex aeolicus VF5
MRKTAILALEDGSYFVGYSFGAEGETGGELVFNTSMTGYQEILTDPSYKGQIVVMTYTQIGNYGVNDEDIESKSVQVNGFVVKEAFFRYSNWRAKKSLDEYLKENNVVGIYGIDTRALVKKIREKGSMKGVISTVEKDPKKLVQKARELPDISEQNLVEEVSAKDIYYWNQGDYDPRRGFLYRENEKPLVAVIDFGVKFNILRRLVSEGAKVVVVPPENAKEAIEKINPDAIFLSNGPGDPERVISGIRLTREYMEKKPIMGICLGCQIIGLALGGKTYKLKFGHHGGNHPVKDLRTGKIEITAQNHNFAIDPESLPEDVEVTHLNLLDNTVEGIKHKHLPIFAVQYHPENSPGPHDSYYLFKEFVKMAQG

SEQ ID NO: 49978 - protein, 466 aa, Bifidobacterium longum NCC2705
MAAAGTPKDDTGLERKMESRHLTMISLGGVIGTGLFVSSGYAIHQAGPLGAILAYAAGSLLVYCVMVSLGELSVAMPYAGSFHMYAKRFIGPGTAFTIAILYWLNWAVALASEFTAAGLLMQRWFPHSPSWVWSAVFIVVVFALNIMSVRLYGEAEFWFASIKVFAIIAFIVIGLLAIFGAIPIAGHDSAPLLGNFVAGGWFPSGIAPIFSTLLTVVFAFSGTEVVGVAAGETKDPSRAIPKAVHTTVLRLAIFFIGSILVMAALIPWHQAGVDTSPFVLVFQSIGMPFAGDIMNFVVLTAVLSAANSGLYVCSRMVWSLAKERLIPERFARTNFRGVPVWAVLFSMAGSLLALLSSVIAASTVYLVLVAVSGLATLVVWFSVCVCHIRFRREWARDGHSADELGYRAPGFPVLPWLAIVMCIGALVLVVLDDTQRSTLYCMIPFVACCYAAYYALERQRKRENNA

SEQ ID NO: 49979 - protein, 495 aa, Pseudomonas aeruginosa UCBPP-PA14
MSIAIDPSVSAFLRSPHGLLIEGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 49980 - protein, 356 aa, Coccidioides immitis RS
MSHLGRPDGRPNDKYSLAPVAPELEKLLGTPVKFVHECVGREVEETVSSANNGQVILLENLRFHPEEEGSYKDQEGKKVKADKNKVEEFRKALTALGDVYINDAFGTAHRAHSSMVGINLPEKASGFLVKKELEYFAKVLENPQRPFLAILGGAKVSDKIQLIDNLLSKVNSLIICGGMAFTFKKVLDNMKIGNSLFDEPGSKTVNQIMEKAKQNNVEVVLPVDFVTGDKFAADAKVGYATDADGIPEGWMGLDCGEKSVELFKAAINEAKTILWNGPPGVFEMDSFANATKKTLDAAVASAQEGKVVIIGGGDTATVAAKYGVENKLSHVSTGGGASLELLEGKELPGVSALSNK

SEQ ID NO: 49981 - protein, 510 aa, Physcomitrella patens subsp. patens
MRASGDVEFLLPVDSEHKAKVVKVFSFAQPHMRSFHLSWISFFVCFLSTFAAPPLIPIIRDNLNMTKSDIGQAAVASVSGSILSRLMMGTVCDLVGPRYGSAFLIMVNAPAVFSMGVVDDAEGFMICRFFIGFSLATFVSCEYWVSSMFTSKIVGTVNGLAAGWGNLGGGVTQIMMPLIFALFRDSFHHPDFTAWRLAFFVPGSMHIILGLLVLCLGQDLPDGDHAQLQKQGGDVKQGFLRVLYFASTSYKTWIFFILYGYSFGVELTVDNIIAEYFYDRFNLNLNTAGLIAAASGLMNIYSRPAGGYLSDVAGRYLGMRGRLWFLWTVQSLGGLLCIILGKMSNLTGAIISMILFSIFVQAACGATFGIVPFVSRRSLGVIIGLTAAGGNVGSVLTQSLFFTSSSYHTEEGLVYMGIMIVCCTLLVTLIWFPQWGSMFFPPSKSASEEDYYVSEWTAQEQEQGLHLPSLKFATNSRSERGNHAGASSSDPEGDQPPAELGLSMWKSYSH

SEQ ID NO: 49982 - protein, 613 aa, Oryza sativa
  misc_feature (261)..(261): Xaa can be any naturally occurring amino acid
  misc_feature (270)..(270): Xaa can be any naturally occurring amino acid
  misc_feature (472)..(472): Xaa can be any naturally occurring amino acid
MDKGALVVQVMDDSSNGGVGAAAAGGSFSSLRAYGRALAQTPRRLARRACAATSPGEEMSRVRARSGARMARRLRWHDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLVAVGVILLISVCICYSTKESSVVNMVLTAVHVAFILFIIVMGFWRGDTRNLTRPXVDLTHNPGXGFFPHGAAGVFNGAAMVYLSYIGYDAVSTMAEEVERPSRDIPVGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFPGVFTAALALFTELDVLLNLVSIGTLFVFYMVANAVVYRRYVAADDDDADHRRAXWPTLVFLAAFSLVALCFTLLWQFAPAGRARTGLLAACGAAAVATVGAFRALVAEARRPELWGVPAMPWVPAASAFLNVFLLGSLDRPSYVRFGFLTAAAVLVYVLYSVHASYDAEEGGGAGAGAAALDGAKVQDEAADFKV

SEQ ID NO: 49983 - protein, 591 aa, Leptospira interrogans serovar Lai str. 56601
MDRSVERNDRISGYENWSSKTNLHRFYRNFLQRSQEKSLNSHSTNFRFHRYQLNRKSEISIRRGHPWIFGGNLSSATSHFVNGQWLNLVSTTNVPLATGIYSTTGLIRIRVIQFLPSFSKEKMRENLIYALKKRNELRKITNAYRILHGENDFFPGITIDRLNTTWVVRIYSSSLLVYGRWLVWNLFDICKNSKLGEPQPKRILFDPPEKTGEDKIGLKKKDPADHSQTFTPSKLDKSNFNQNLTSEKSNFKKISSSETLEKEILDNFNLENDLSTFSQNTNLSDNDSKEILKYPKQNSNLSNSDPFKTSQENIFYNSILKKQNLESTINLIHERLWRGNRQSTRNRSNFTKEKTKHSIQKEIYHSDKYKIRETIRLYEVNFPIELPGQKGGIFLDLRNLRRFLLEKKELSKNKNCLHLFSHTGLTSICMEIAGASSVISVDGSKEALDSFQRVLSLNKNKGNCKHRFLRKNIFKELEEILQNKSFGLIVIDPPNLTPDEKSKSNALKSYSYLFANSLSSLEESGTIILCSCSGRIKTQELESLAKNILQSKGWKFERFTSLKPEVDHPIRKNFPEGNYFKVHIYENCKKN

SEQ ID NO: 49984 - protein, 480 aa, Klebsiella pneumoniae subsp. pneumoniae MGH 78578
MTLSFTTHWRDELPDFYTSLSPTPLDNARLIWRNAPLAQQLGVPDALFAPESGAGVWGGEALLPGMSPLAQVYSGHQFGAWAGQLGDGRGILLGEQQLADGRRYDWHLKGAGLTPYSRMGDGRAVLRSTIRESLASEAMHALGIPTTRALAMVTSDTPVYRERVEPGAMLMRVAESHVRFGHFEHFYYRREPQKVQQLADYVIRHHWPQLQDEADKYLLWFRDIVMRTAQTIASWQTVGFAHGVMNTDNMSILGLTIDYGPYGFLDDFQPDFICNHSDYQGRYSFENQPAVGLWNLQRLAQSLSPFISAEALNAALDEYQHALLTAYGQRMRDKLGLFSQQKGDNDLLDGLFALMIREKSDYTRTFRLLSHSEQLSAASPLRDEFIDRAAFDSWFAGYRARLRDEQVDDAQRQQRMQGVNPALVLRNWLAQRAIEQAEAGDMGELERLHAALADPFTDREDDYVRRPPDWGKRLEVSCSS

SEQ ID NO: 49985 - protein, 630 aa, Acidovorax sp. JS42
MPPRSPFFIVPTQGLSRRRFVQGLAAGGVLAGLSTPAFKAFAQQGSATRGAAPVLKGTDFDLVIAESPVNFTGKPGVATTINGSLPAPTLRWREGDTVTIRVTNKLREATSIHWHGIILPYQMDGVPGISFNGIAPGETFTYRFKVQQSGSYWYHSHSGFQELTGMYGAIIIDPAGAETIHADRDHVLLFSDWTDEDPMRVFTKLKSQSDYYNYNQPTVFDFFRDASREGTAAAIDKRKMWNEMRMNPTDLADLSAATLTYLANGVTPAGNWTALFRPGERVRLRMVNGAGNTFYDVRIPGLKLTVVHVDGVDVEPVTVDEFRFGPGETVDVIVQPRDDAYTIFAQAMDRTGYARATLAVREGLQAPVPALDPVEWLTMNDMMGGMMGGMDHGGSGQAMEMTGMTGMTGMTGMGSGSMSGMDHGAMAGMNHGAMNHGGMAMDHSQHAAAAGGLAVPSTTARHARTEYGASTDMRVDMARTNLDDPGIGLRNNGRRVLTLADLHTPSGPLDKRGPGREVELHLTGNMERYAWSLDGLEFGKSTPVHFKHGERLRVILHNDTMMTHPMHLHGMWSELESPDGRFLARRHTLPVQPAQRISFLVTADALGRWAWHCHLMFHMDAGMFREVVVS

SEQ ID NO: 49986 - protein, 588 aa, Oryza sativa
MSAAVGGAEFHGFRGGGGGAAQLQRSRMLGRPLRVATPHAAAPAGGGGSSSASIRAVSAPLKKDASEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVISTVIKNMGSSLGACGDLNRNVLAPAAPYVRKDILFAQETAENIAALLTPQSGAYYDLWVDGEKIMSAEEPPEVTKARNDNTYGTNFPDSPEPIYGTQYLPRKFKIAVTVAGDNSVDILTNDIGVVVVSDSAGEPVGFNIYVGGGMGRTHRVETTFPRLADPLGYVPKEDILYAIKAIVVTQRENGRRDDRRYSRMKYLIDNWGIEKFRAEVEKYYGKKFEDSRPLPEWQFNSYLGWQEQGDGKLFYGVHVDNGRVAGQAKKTLREIIEKYNLEVSITPNQNLILCGIDQAWKDPITAALAQSGLLEPKDVDPLNITSMACPALPLCPLAQTEAERGILPILKRIRAVFDKVGIKDHESVVVRITGCPNGCARPYMAEVGFVGDGPNSYQIWLGGTPNQSTLAEKKMCL

SEQ ID NO: 49987 - protein, 2210 aa, Nostoc punctiforme PCC 73102
MNNISKKVDKDKLEQLNSSQRILLALDEAVKKLKDVERAKTEAIAIVGLSCRFPGGVTNPEEFWQLLIDGVDAITEIPSQRWHLEDYYHPNPDTPGKMYSRYGGFLQQVDQFDAQFFGISPREAIKLDPQQRLLLEVTWEALENAGIIPQEQVNGQTGVFIGITTNDYARLITPGGDLSQIDPYYLTGNPLNAVAGRLSYTLGLHGPCMAVDTACSSSLVAVHLACQSLRNQECDRALAGGVNLILSPENNIGLSKAKVLSADGRCKTFDSEADGITRGEGCGVLVLKRLSDAVADGDRILALIRGSAVNQDGASSGFTVPNRNAQENLIRQTLTRANVKPEEVDYVEAHGTGTSLGDPIEVRALAAVLGAGRTAENPLKIGAVKTNIGHLESAAGIAGMIKVILSLQHQQIPPHLHLKQLNTHINWDELPVSVTTQATPWPVGNKQRLAGVSSFGASGTNAHVILAEAPTNNSLSKPQNAKFIERPQHLLNLSAKTEKALRELVQRYINYLQSNPEKSLADICFTANTGRSHWKYRLSILADSTMSALAQLTTWALGQDLPGVVLGEAESTSKKIAFLFTGQGSQYAGMGQKLYQTQAKFRQIIDQCDQILQPYLDKPLLEVLYPQPDTNSPIDNTAYTQVALFALEYALYQLWQSWGIKPDVVMGHSVGEYVAACVAGVFSLQDGLKLIAARGQLMQALPENGAMVAVMTTAEQLQPLLAAYKEKVAIAAVNAPQSLVISGEKSAISAITSQLETAGIKTKPLQVSHAFHSPLMQPMLADFLQVASQIKFSPPQLKLISNVTGELATTEIATAEYWCRHILNPVEFAASMVTLQQQKVAICVEIGPKPILLGMGRQCNPTVEGLWLPSLRSRQDDWQVMLLSLAQLHCHGVAVDWLLFDADYSRVRLHLPTYPFQRQRFWIETVDGQRDQPALISRNGKGRKIIHPLLGQRLPLATSQSIHFESQISAASPTFLQDHCIYDATILPATAYIEMALSAGAIVFKTDRVQLEAVSIQQALVFSGDEPKTLQVVLTPENTRVYSWQVLSYLEDESNVDNWTLHASGKVGLGNAETHSAAVDLAGLLSEDSTEISVKEYYQSLHDRGFDYGEQFQAIARLWQGETQAVGSVRLPLPLTADASKYLLHPVLLDACFQILGTNFPDNGQQDVYLPVGVEQLQVYQRAGNSLWSRVEKIEFQDVKQQHLQADLSLVNDAGELVAKITGLSFRRITQKAFQRILAKVLPAPQTTDNWLYQIAWQRQNLEPASSNKQPSSWLIFADQGGLGQKLAQLLTAAGDRCIMVSAGAVYQQLQADRYQINLAHPEDFGRLIQDNPCQGIVHLWSCDATTEPQLTSCGSVLFLLQAIYNAKLPALPSLYLVTKGTQTVGGQLTPLQVQSATLWGLGRVIALEHPELHCVRLDINPDAPEDHIPSVAQELLVPSREDQIAYRQGLRYVARLVRSDVAREADVNSQAFQLQISEYGVFENLTLAAMQRRQPGPGEVEIAVRAVGLNFRDVLNALGMLREYTEQMGITDAKELPFGGECSGIVVAVGENVSHLQVGDAVIAAQTIGSFASFVIVRSEFVVRKPENLTFEEAATIPTAFLTAYYGLYQQAQLKSGERILIHAAAGGVGQAAVQLAQRVGAEVLATASPRKWEHLRATGVKQVMNSRSLEFADQIREITSGQGIDVVLNSLNGEYIPKSLEVLSDRGRFIEIGKIGIWDAEQVKDSRPDVGYIPFDLLDISLENPSLIGEMLGELMAEFQQGSLKPLPVSVFSIQDVANAFRYMAQSKHIGKVVVSIPQRQMPKETTIQADSSYLITGGLGALGLQVAQWLVEQGAQNLVLMGRRGVSPENQPAIEQLEQAGARVLVVTADVSQQEDVSQMLATLNASMPPLRGIIHAAGLLADGMLLRQTWENFELVMAPKVAGAWNLHTLTKELDLDFFVCFSSVSALLGSPGQGNYAAANAFMDALAHHRQALGLPGSSINWGPWADAGMAAALSSREQARWAAQGVQPIPLEPGLQILAKVVQQNLAQVGVLPVDWSKFTAQFPSDVELPFLAEFTNAISKVTPQVAELRQQLEAAAPKQRPILLMNYVRSQIAKVLNLTSTEEIDPKEGFLQLGMDSLMAVELRNRLQSSLGCSVPASLIFDYPTVDALVSYLIQELWTDRPPEPSTENSPPPAQGIAESELEELSDSEAEALLLSKLDNLKY

SEQ ID NO: 49988 - protein, 269 aa, Chlamydomonas reinhardtii
EFAKKYDMKKLLGRGEYSKVVECINMVDHKRYAVKILEKANTEREGAPGALSRVVAVTRMLAGFSHTVRVHEVLEDKHCYYLVLELCKGGELFDHILAKVGGHYSEAEAAAVMRVLLDFTEHAHREGIIHRDLKPHNILLLNEHVLDSPIRIIDFGTSDYCADGERLTHRVGTPHYIAPEVLKEDYDKTADIWSLGVILYILLSGSMPFGGPNPETITKMVAAGERKYSMESEVWKGVSGEAKDFLAAMLQMDPAKRATLQQLKNHPWF

SEQ ID NO: 49989 - protein, 389 aa, Arabidopsis thaliana
MTKISDLPRDLAEEVLSRVPVTYLRAIRFTCKKWNTLTKRRSFTKKLIGQEKAEAKVKEFHAIMTLNSRLHLMSVNLDGIHKDENVESSIKQKGKLISLTVADPDRIVISQVYHCDGLLLCITNEINSRLVVWNPYSGQTRWIEPRTSYREWDIYALGYESKNNAKRSYKILRYLDAYEDMGDMSVEPRTRVCEFEIYSLDTNSWKVIEVTTDWDLCFLHRGVTLKGNTYWFAREKIPPPPRERVIEDIPLEKFGSRLPLPFRPCVDDTITLSSVREEKLAVLYQRWDITWTGIWISNKIEPNAVSWSKLFFPMGRIRPLEAASGTFFVDEENKLVVLFDKGESILNPTRNTAYIVGEDGYIKPVDLGESVHKYCFPLACSYVPSSVQI

SEQ ID NO: 49990 - protein, 303 aa, Bacillus thuringiensis serovar konkukian str. 97-27
MKRWQMEWLLVSVALVWGANYTIGKYGVAFMSSIQFNSLRFLVASPVLLLITFLMERSLRIERKDWLRLVAVGIVGTTMYQTMFMLSVKYTSATNASLLIAMSPIFTGILAVLHKQERFSMKVQIGSIVAFIGAAFVLLTGHTGGATYEYAWLGNIIGLVAAIAWGWYPILAQPLITKYSAMRVTSWSTLIGIVPLVIYCLFNVNTLTWPVDMLSWGSLAYSIIFATIFGLAMWYVGISQIGSTKVMVYMYLVPLFAVIFAAVTIGEQINMMQLVGGLIIFIGLYVVKKGGIKKPALNLKKVS

SEQ ID NO: 49991 - protein, 121 aa, Zea mays
MRIREPKTTTLIFASGKMFARIVQKLGSPARFKDFKVQNIVGSCDLKFPIRLEGLALASGLSATYEPEIFPGLVYRMVDPKVVILVFVSGKIVLTGAKVREEICAAFEKIHPMLVQFRKRS

SEQ ID NO: 49992 - protein, 422 aa, Bacillus subtilis
MSYQALYRVFRPQRFEDVVGQEHITKTLQNALLQKKFSHAYLFSGPRGTGKTSAAKIFAKAVNCEHAPVDEPCNECAACKGITNGSISDVIEIDAASNNGVDEIRDIRDKVKFAPSAVTYKVYIIDEVHMLSIGAFNALLKTLEEPPEHCIFILATTEPHKIPLTIISRCQRFDFKRITSQAIVGRMNKIVDAEQLQVEEGSLEIIASAADGGMRDALSLLDQAISFSGDILKVEDALLITGAVSQLYIGKLAKSLHDKNVSDALETLNELLQQGKDPAKLIEDMIFYFRDMLLYKTAPGLEGVLEKVKVDETFRELSEQIPAQALYEMIDILNKSHQEMKWTNHPRIFFEVAVVKICQTSHQSAADLPEVDMLMKKIQQLEQEVERLKTTGIKAAAESPKKEAPRVPKGGKSNYKAPVGRI

SEQ ID NO: 49993 - protein, 373 aa, Aquifex aeolicus VF5
MDRLEKVSPFIVMDILAQAQKYEDVVHMEIGEPDLEPSPKVMEALERAVKEKTFFYTPALGLWELRERISEFYRKKYSVEVSPERVIVTTGTSGAFLVAYAVTLNAGEKIILPDPSYPCYKNFAYLLDAQPVFVNVDKETNYEVRKEMIEDIDAKALHISSPQNPTGTLYSPETLKELAEYCEEKGMYFISDEIYHGLVYEGREHTALEFSDRAIVINGFSKYFCMPGFRIGWMIVPEELVRKAEIVIQNVFISAPTLSQYAALEAFDYEYLEKVRKTFEERRNFLYGELKKLFKIDAKPQGAFYVWANISDYSTDSYEFALKLLREARVAVTPGVDFGKNKTKEYIRFAYTRKIEELKEGVERIKKFLEKLS

SEQ ID NO: 49994 - protein, 106 aa, Brassica napus
KPLAGIQQLLAAEQEAQHIVNAARTAKMARLKQAKEEAEKEIAEYKAKTEQDFQRKLEETSGDSGANVKRLEQETDAKIEQLKKEASRISNDVVAMLLKHVTTVKN

SEQ ID NO: 49995 - protein, 326 aa, Nicotiana tabacum
MGFKVFFFFAILFFSAVSAFAEDNSGLVMDYYKDSCPQAEDIIREQVKLLYKRHKNTAFSWLRNIFHDCFVESCDASLLLDSTRRMLSEKETDRSFGMRNFRYIETIKEAVERECPGVVSCADILVLSGRDGIVALGGPYVPLKTGRRDGRKSRADILEQHLPDHNESMSVVLERFANVGINAPGVVALLGAHSVGRTHCVKLVHRLYPEVDPQLNPDHVPHMLKKCPDPIPDPKAVQYVRNDRGTPMKLDNNYYRNILENKGLMLVDHQLATDKRTKPYVKKMAKSQDYFFKEFARAITILTENNPLTGTKGEIRKQCNLANKLH

SEQ ID NO: 49996 - protein, 352 aa, Aquifex aeolicus VF5
MNRWQGIIKQYKKYLPVDENTPIVTLYEGNTPLIEADNLARAIGFKGKIYLKYEGLNPTGSFKDRGMTLAISKAVEAGKRAVICASTGNTSASAAAYAARAGLRAYVLLPKGAVAIGKLSQAMIYGAKVLAIQGTFDDALNIVRKIGENFPVEIVNSVNPYRIEGQKTAAFEICDTLGEAPDYHFIPVGNAGNITAYWKGFKIYYEEGKITKLPRMMGWQAEGAAPIVKGYPIKNPQTIATAIKIGNPYSWKSALKAAQESGGKIDAVSDSEILYAYKLIASTEGVFCEPASAASVAGLIKLVREGFFKGGEVVTCTLTGNGLKDPDTAIKVCEEPITVPPDFDEVVKVLGF

SEQ ID NO: 49997 - protein, 533 aa, Oryza sativa Japonica Group
MAADTSKPFFPAAPNPALLPSGRKPSRLSPEASYWRSFRASELTPANEFNVTHLAFSPSSAPTLAASLSTSVLLFSGDPLSPLPRIPASQDVAFSPSFRSDGSLLAVGDKKGVVRVFRADKKQSSGALRTLTAHTAETRVVRYPVAGGDKVHLFTAGDDALLAYWDVPSETPVFAAPAAHRDYIRAGAASPADHNIFATGSYDRIVKLWDARMGKTSTLSFSHGELVESVLFLPSGGLLATAGGNVVRIWDVIGGGRLLHSVESHVKTVMALALAKMTNTGETRLLSAGSDGYVKSFDYGELKLTHSMRYPKELLSLACSPCGTVLVAGSSKGTIYMGRRKKKSTGEDEEEGKGVGGELDWAPTKPEKRRLAPSNYRYFLRGQNAKAKEGDLVIEKPKKVKVAEHDKLLRKFRHKDALVSALARNNPRSIVAVMEELVSRRKLVRCIENLDTEELVLLLLFLHRNATLPRYARFLMGVANKVLEMRADDIRSDENLRGCVRNLKRMAAEEIQIQHTLQGIQGMISPMLALASR

SEQ ID NO: 49998 - protein, 419 aa, Triticum aestivum
PSLSPTMTEGNIAKWVKKEGDKVSPGEVLCEVETDKATVEMECMEEGYLAKIVCGDGAKEIKVGEIIAITVEEEGDIEKFKDYKASSSAAAPAESKPQSEPVEPKEEKKEVSKAPEPTATKTEESSQSGDRLFSSPVARKLAEDNNVPLSSLKGTGPDGRILKADIEDYLSSAAKGSKKEAAAAPGLGYVDLPNTQIRKVTANRLLQSKQTIPHYYLTVDSRVDKLIKLRSELNPMQDASGGKKISINDLVIKAAALALRKVPACNSSWMNDFIRQYHNVNINVAVQTEHGLFVPVVRDADKKGLATIADEVKQLASRAKDNSLKPEDYEGGTFTVSNLGGPFGIKQFCAIVNPPQSAILAIGSAEKRVIPGAAEGQYEIGSFMSATLSCDHRVIDGAMGAEWLKAFKGYLEDPTTMLL

SEQ ID NO: 49999 - protein, 1161 aa, Physcomitrella patens subsp. patens
MESMSTVAPAPSTAATEEVGPEVAILFVGVALFLGMVSRHLFKGSRIPYTVVLLLLGIGIGGLEYGVKNLGVLGDSIRMWSNIDPDLILFLFLPALLFESSFAMDFHQIKRCFFQMLLLAAPGVLISTFLLGVATVKVFPYNWNWSTGLLLGGLLSATDPVAVVALLKELGASKKLSTLIEGESLMNDGTAIVVFRLFLQMVLGKHFSAGDVVSFLSRVVFGAVALGLLFGIVSVIWVGRVFNDTVIEITLTLTASYMAFFVAEESASVSGVLTVMTVGIFFTAFARTAFTGESAQSMHHFWEMISYIANTLVFLLSGVVIAESILRSQDKIQGRDWGYLLLLYLFVQISRAMVVGLLYPGLKYFGYGINWKEAIVLIWAGLRGAVALSLSLSVAQVGQHDPTQNTYLSKLTEARFVFFTGGVVLLTLIINGSTTQFLLLFLKMDTITETKSRMLEFAKYEMYSKALEAFGELGDDEELGPADWNTIRKYVSCLSYEENKPTHPHGPPSFALPDGEYAKQQMTDTRTRFLNGKKLFASAGLQAAYWNMLDEGRITQTAALILMQSIDEALDKVKHHTALQDWEGLRPHIHFPGYLKYFSWRSTSVLPRRASTYFLIQQLELACYIAAAFLRAHRMTRNHLRDFIGESEVTEAVIQESEAQAQHARLFLEDVRLSFPQVLRAVKAKQVTHAILLHLTTYVESLENAGLFESKEAVHLHDAVQIDLKKLLRDPPIVEMPSAEQTLQNQPFIGAMPTSVQKPLLDVSKEYMKLQGSVIYREDMKSDGIWLITNGVVKWSKKAVGGQRLRQPTFSFGSTLGLYEVLTGKPYLCDVVADSVVHCFFVERSRILFIQKERADLEDFLWQESALAVAKIVLGPQFDMATLQDIRALVMEGSSMRIFLRGEVFELRHKEMGLLLEGFVRQENSTELITAPAGLTAKILLPSPTGSWSNISLQQPTVFHAEARSRVLLFESSKVGEILSQGSSQLLAVPRKTSRSMLRLSSKTSTNTRTKVDRHSSHNEIRIASDHSIPIAQAWGSGSSCVPDKYTAKALEISVFGSEVDVRDKRRADEIPLDAQSRFTQSHSNLVKRVSLMMQERFDNKQTSMPKRKIASQENMTVPMSLLPHQSEPKPDDSSDDSDKEEHIVRIDSPSFLFHNSRREL

SEQ ID NO: 50000 - protein, 187 aa, Lactobacillus johnsonii NCC 533
MNLPNKLTMFRIFMIPVFMLVLIFNWPAGSATFLGAHIYWSHVLAAVIFAVASITDFLDGHIARSRNLVTNFGKFADPLADKMLTMTAFVFLISLNLAPAWVVAIIVCRELAVTGLRLILAENKGQVLAAKMPGKIKTTTQMLSIIFLLLGDVYYIGTILLYICLIFTIYSGYDYFKQSGDVFKGEI

SEQ ID NO: 50001 - protein, 542 aa, Zea mays
MSAAQLLRHSRKLRSLQNAVGCENFSFVRHFSSGSGSFIARENGIGKRTRGTRFSQHNQPAKQLETFSAGVNGSCTWRIASNSLTPSAASWLSGSFSCGQVVSARPFSSSADLPPHQEIGMPSLSPTMTEGNIAKWLKKEGDKVSPGEVLCEVETDKATVEMECMEEGYLAKIIHGDGAKEIKVGEVIAITVEEEGDIEKLKDYKPSSSAEPVAPAEPKAEPEPSQPKAEEKKPTQAPEAKTPKIEEASQSGDRIFASPLARKLAEDNNVPLSSVKGTGPDGRILKADIEDYLASVAKGGLRESFADPGLGYVDIPNAQIRKVTANRLLASKQTIPHYYLTVDARVDKLVQLRGELNPLQDASGGKKISINDLVIKAAALALRKVPQCNSSWMNDFIRQYHNVNINVAVQTEHGLFVPVIRDADKKGLGAIAEEVKQLAQKARDNSLKPADYEGGTFTVSNLGGPFGIKQFCAIINPPQSAILAIGSAEKRVIPGSADGQFEFGSFMSATLSCDHRVIDGAIGAEFLKAFKGYIENPTSMLL

SEQ ID NO: 50002 - protein, 242 aa, Pseudoalteromonas tunicata D2
MNKVAVVTGGSKGIGLAIVQTLLAQDYQVYNLDITPSDVGFFVPCDVSQVAEVTHAIEAIAIKTSRIDCLVSNAGVHFSATIENTSEHELDRIFSLNVKGAYAAIKATLPSMKAQKNGSIILISSDQALIAKRNSFAYNLSKAALASIAKTTALDYAQFNIRANAVCPGTIETPLYHAAIDNYCAKSGANKQQIHQEEAALQPLGRLGQPQEVANLVAFLASDAASFITGSLQVIDGGYTAQ

SEQ ID NO: 50003 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 50004 - protein, 334 aa, Corynebacterium glutamicum ATCC 13032
MTIRVGINGFGRIGRNFFRAVLERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 50005 - protein, 494 aa, Bacillus thuringiensis serovar konkukian str. 97-27
MLTKNIELKPKVKAFLNEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGSAIVNHHDIDKVAFTGSTVTGKYIMRQSAETIKHVTLELGGKSPNIILEDADLKEAINGAFQGIMYNHGQNCSAGSRVFVHRKHYETVVNELVKMANNVKLGAGMEKETEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 50006 - protein, 565 aa, Populus nigra
MVSEASKKKAAQKKAAAAAKRGGKAVATSSKTAAATAAASDSQNEGVDKLSNGFGALQISDRTCTGVLCSHPLSRDIRIESLSVTFHGHDLIVDSELELNYGRRYGLLGLNGCGKSTLLAAIGCRELPIPDHMDIYHLTREIEASDMSSLEAVISCDEERLKLEKEAEVLAAKDDGGGEALDRIYERLEAMDASTAEKRAAEILYGLGFNKKMQEKKTRDFSGGWRMRIALARALFMNPTILLLDEPTNHLDLEACVWLEETLKKFDRILVVVSHSQDFLNGVCTNIIHMQNKKLKIYTGNFDQYVQTRSELEENQMKQYKWEQDQIASMKEYIARFGHGSAKLARQAQSKEKTLAKMERGGLTEKVARDKILVFRFVNVGKLPPPVLQFVEVTFGYTPDNLIYKSIDFGVDLDSRIALVGPNGAGKSTLLKLMTGDLVPLDGMVRRHNHLRIAQFHQHLAEKLDLEMSALQYMIKEYPGNEEERMRAAIGKFGLTGKAQVMPMKNLSDGQRSRVIFAWLAYRQPHLLLLDEPTNHLDIETIDSLAEALNEWMGVWFLLAMISGS

SEQ ID NO: 50007 - protein, 296 aa, Yersinia pestis CO92
MKCLKAVIPVAGLGTRMLPATKAIPKEMLPVVDKPLIQYIVDECVAAGVKEIVLVSHSSKNAIENHFDTSFELEAALESRVKRQLLKEIKNICPADVTIMQVRQGHAKGLGHAVLCAKSMVGDNPFIVMLPDVLLDDSTADLSKENLASMIKRFEETGHSQIMVEPVPKADVSKYGIADCGHVALAPGESTLMTAVVEKPSIAEAPSNLAVVGRYVLSKNIWPLLEKTPRGAGDEIQLTDAIAMLMQQEPVEAFHMTGKSHDCGDKLGYMKAFVTYGVRHHTEGEKFTAWLKQQLD

SEQ ID NO: 50008 - protein, 247 aa, Chlamydomonas reinhardtii
VDKSRYAAGDNSLEREIQVLLKVDHPNCIKLFDVYITPRKVYLVTELVTGGELLDRVTEKGNYTEKDASSLIRQILSGVAYLHKQGIVHRDLKLENMVMLNERDDSPVKIADFGLSKFFSPETVLSTMCGSPQYVAPEVLGVGDGLKEYSPAVDMWSVGVILFILLSGYSPFDDDNDAVLFEKIKKGNYDADDPIWENISPEAKDVVAKLLTVDSGKRLTADQALAHPWVQGQTPTTVDEGECGPRG

SEQ ID NO: 50009 - protein, 297 aa, Yersinia pestis CO92
MTKLKAVIPVAGLGMRMLPATKAIPKEMLPIVDKPLIQYVVNECVAAGINEIILITHSSKNAVENHFDTSYELEAMLEARVKRQLLDEVQSICPPGVTIMHIRQGHPEGLGHAVLCAKPLVGDSPFVVLLPDVLIDDEQSDLTRDNLAQLVQRFEETGVSQVLVHSVDPETLSNYSVVSCEKSTLLPGESSRINAMIEKPQSSADLQSNLSAVGRYVLSAHIWPLLEQTKPGAWGRIQLTDAIDALAAVEAVDAVALTGKSYNCGEKLGYMQAYVAYGLRHPQQGAEFKAWLKDFVA

SEQ ID NO: 50010 - protein, 159 aa, Corynebacterium glutamicum ATCC 13032
MAKEGLPAVELPDASGLKVAVVTARWNAEICDRLHKHAVDAGRAAGATVSEYRVIGALELPVVVQELARTHDAVVALGCVVRGGTPHFDYVCDSVTEGLTRIALDTSTPIGNGVLTTNTEEQAVERSGGEGSVEDKGAEAMVAALDTALVLSQIRATEG

SEQ ID NO: 50011 - protein, 469 aa, Yersinia pestis CO92
MSKQQIGVVGMAVMGRNLALNIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 50012 - protein, 483 aa, Sparganium americanum
SSPGVSTLEEKNLGRIAQIIGPVLDAVFPPGKMPNIYNALVVKGRDTLGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNL

SEQ ID NO: 50013 - protein, 422 aa, Corynebacterium glutamicum ATCC 13032
MSEHEQAHSQLDSVEEAIADIAAGKAVVVVDDEDRENEGDIIFAAELATPELVAFMVRYSSGYICAPLTAKDADRLDLPPMTAHNQDARGTAYTVTVDANTGTTGISATDRAHTLRLLADPEADRTDFTRPGHVVPLRAREGGVLVRAGHTEAAVDLARAAGLRPAGVICEVVSEEDPTGMARVPELRRFCDEHDLKLISIEQLIEWRRKNEILVERQVETVLPTDFGTFKAVGYRSIIDGTELVAIVAGDVASDGGENVLVRVHSECLTGDVFGSRRCDCGQQLHESLRLIQEAGRGVVVYMRGHEGRGIGLLAKLRAYQLQDEGADTVDANLALGLPADAREFGTSAQILYDLGVRSLNLISNNPAKKVGLEGHGISIASRTPIPVAVHEDNVRYLKTKRDRMGHDLPDVALWEQEHPEN

SEQ ID NO: 50014 - protein, 517 aa, Aspergillus oryzae
MFKSGLARTFGRAAFARPTPVARRVPSKINAFPSLARLASTEAGATGKVHQVIGAVVDVKFEGEKLPAILNAIETENNGQKLVLEVSQHLGENVVRTIAMEGTEGLTRGAAARDTGAPITIPVGPGTLGRILNVTGDPVDERGPVKATKYAPIHAEAPEFVEQSTEGEILVTGIKVVDLLAPYARGGKIGLFGGAGVGKTVFIQELINNIAKAHGGYSVFTGVGERTREGNDLYHEMQETGVIQLEGESKVALVFGQMNEPPGARARVALTGLTIAEYFRDEEGQDVLLFIDNIFRFTQAGSEVSALLGRIPSAVGYQPTLAVDMGGMQERITTTTKGSITSVQAVYVPADDLTDPAPATTFAHLDATTVLSRGISELGIYPAVDPLDSKSRMLDPRIVGQDHYDTATRVQQMLQEYKSLQDIIAILGMDELSEADKLTVERARKLQRFLSQPFTVAQVFTGIEGKLVDLKDTIRSFKAIINGEADDLPEAAFYMVGDLESARAKGEKLLAELENKA

SEQ ID NO: 50015 - protein, 524 aa, Bifidobacterium longum NCC2705
MSQPDTDTAAQSPSSQQEPQIQTDGRRSHSEQMNQPAQTSQSESSHDGKDEHALHTNLKRGMESRHLQMISLGGVIGTGLFLSSGYTIQQAGPIGTILAYSIGALIVYLVMLTLGELSVAMPVTGSFHVYAEKFIGPGTGFVIAIQYWLTWTVALGSEFTAAGLLMQRWFPDSPTWVWSAACIILIFTLNALSVRLFAEAEFWFASIKVFAICAFIVIGLLAIFGVIPIAGYQHAPMFGNLVKDGIFPNGFMPVFATILTVNFAFSGTELIGVTAGETRDPETTVPKAIHTTLWRLVLFFIGSITVMCALIPWRQAGVGESPFVLVFNSIGIPYAGDIMNFVVLTAVLSASNSGLYASTRMVWSMGNEGMIPRWFAKTNRRGVPMLALCAAMAGGLLALLSSVIAASTVYLVLVALSGLSAVVVWIAIAYCQIVFRRRWLESGHSTSELKYRTPGYPYVSWAAFILCTASFVLVIFDVEQRFALVAELVFIVACYGAYFLQQWVRKRKKATEADDLDTLWVARD

SEQ ID NO: 50016 - protein, 263 aa, Triticum aestivum
VDLQAAALVIRAAPGLGREVPRESLLFIIPAFGGTVSWEGEGAPFDETDQDITHQIVDRPTQSHVFLSRHYVQPQWIFDCVNILKVIPTDDYIVGRVPPPHISPFVDNDKEGHIPDYAVTLEGYKSAGQNQVMPLPGLGDEDLGNSIVEAKSEHNEFAKKKRELEMQEKKYHEELKMEIEGTTFSNLSNKKADSAADVADEDEKAAIEQAEKDADDIAKSVVSRRKRGLMEAMKISNDRKKSKVELLKQRKKAAESSASAKRR

SEQ ID NO: 50017 - protein, 298 aa, Vitis vinifera
MVAALGEDPIREWILSEGKATQITKISPVGGGCINLASRYDTDAGSFFVKTNRSIGPSMFEGEALGLGAMYETKSIRVPRPFKVGPLPTGGSYIIMEFIEFGRSRGDQAVLGRKLAEMHKAGKSEKGFGFDVDNTIGSTPQINTWTSDWVKFYAEHRLGYQLKLALDQYGDSTIYAKGEKLMKILGRLFENVEIEPCLLHGDLWSGNISSDKNGEPVILDPACYYGHNEAEFGMSWCAGFGGSFYNAYFEVMPKQAGFEKRRDVYMLYHYLNHYNLFGSGYRSSAMSIIDDYLRIFNI

SEQ ID NO: 50018 - protein, 163 aa, Escherichia coli O157:H7 EDL933
MRRILSVLLENESGALSRVIGLFSQRGYNIESLTVAPTDDPTLSRMTIQTVGDEKVLEQIEKQLYKLVDVLRVSELGQGAHVEREIMLVKIQASGYGRDEVKRNTEIFRGQIIDVTPSLYTVQLAGTSDKLDAFLASIRDVAKIVEVARSGVVGLSRGDKIMR

SEQ ID NO: 50019 - protein, 462 aa, Bacillus cereus E33L
MHRENSMYSYIFYCIFLCEKEMKITIIGTGYVGLITGVGLAVLGHSVTCFDINDEKIERIKQGDLPIYEAGLYELIHDACENNRLTFTTSKEEAFNDAEFIFIAVGTPSLLDGTADLTYIQNACVDIGTYATKDIIVVTKSTVPVGTNGAMRGWIEETLQNRHELHIVSNPEFLREGSGIYDFFQGDRIVIGADNEEAARKVENLYSELHLKTYVTDIKSAEMIKYASNAFLATKISFINEISNICEKVGANVLDVAKGMGMDKRIGASFLNAGIGYGGSCFPKDTKALVQIAGNVAHDFRLLKAVIEVNNKQQLLLIEKAKKVINMNKKRIAVLGAAFKPNTDDIRDAPSLIMIQELINLGADIVLYDPKAIQNMKNIFGETIQYSKCIDESIRGASAAFIMTEWEAIRTYPLEKYVQLMREPILFDGRNCYTNEDVKKQGIDYYSVGRESVYKRDFSVIR

SEQ ID NO: 50020 - protein, 463 aa, Zea mays
CKESWVRVSLGPSRDTLERPRRTGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVARELRVGPLALSVFRLTWRSAFVCATTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 50021 - protein, 749 aa, Oryza sativa Japonica Group
MILNVIILFVDSYVAVASDTLFPGQSLSGSETLVSENGIFELGLFPSAPAGTKHYLGIRYKNMSSNNPITFWLGNRIPITYFINATLYIDAGKLYIEELGSILWTSNSTRNESNTAVAVILNTGNFVIRDQLNSSVVTWQSFDHPADKLLPGAYLGLDMVMGTNILLTLFKPPYNCTLMIDQSRKRGFIMFIDGHDKYLGTFPEWMVTYEENGSLVRLNDPGIPNDTEYMKLQLGQLSLLRWLDNATISGWQSVWSHPSSCKVSAFHCGAFGICTSTGTCKCIDGFRPTEPNEWELGHFGSGCSRITPSNCLGVVSTDLFVLLDNLQGLPYNPQDVMAATSEECRAICLSECYCAAYSYHSACKIWYSMLFNLTSADNPPYTEIYMRIGSPSKRRMHILVFVLIFGSIGVILFLLMLLLMYKRSSCVARQTKMEGFLAVYSYAQVKKATRNFSDKLGEGSFGSVFKGTIAGSTIVAVKKLKGLGHTEKQFRTEVQTVGMIQHNNLVRLLGFCTRGTRRLLVYEYMPNGSLDSHPFSETSRVLGWNLRHQIVVGIARGLAYLHEECRDSIIHCDIKPENILLDAEFCPKIADFGMAKLLGREFSAALTTIRGTIGYLAPEWISGQAITHKADVYSFGVVLFEIISGRRSTEKIRHGNHWYFPLYAAAKVNEGDVLCLLDDRIEGNASLKELDVACRVACWCIQDDEIHRPSMRKVIHMLEGVVDVELPPIPASFQNLMDDYDSDIYSVEV

SEQ ID NO: 50022 - protein, 483 aa, Burkholderia thailandensis E264
MGIHVIKMPDIGEGIAEVELGLWHVKIGDRVKEDQAIADVMTDKASVEIPSPVTGVVVALGGKEGDVLAVGSELVRLEVEGDGNHKGGDGALAGAAANGDARGEAAARERIADAAHAHAGAASVRGERDFDAPRAASSDAPNAKDERDHDRADREHSDEREARNASRGAFADARPAARESASPPPARRPGERPLASPAVRKRAWDLGVELRYVHGTGEAGRILHEDLDAYLQGRGAAEPRARGGHAAYVERHDEEAVPVIGLRRKIAQRMQDAKRRIPHFSYVEEIDVTELEALRAELNRKYGDMRGRLTVLPFLARAMVIALRDFPQINARYDDEAGVVTRHGAVHLGVATQSKAGLMVPVVRHAEARDPWAIAAEIARLADAVRAGRAERDELSGSTITITSLGALGGIASTPVINSPEVGIVGVNRIVERPMFRAGAVVARKLMNLSSSFDHRVIDGMDAAEFIQAVRALLEQPALLFVE

SEQ ID NO: 50023 - protein, 312 aa, Vitis vinifera
  misc_feature (20)..(20): Xaa can be any naturally occurring amino acid
  misc_feature (273)..(273): Xaa can be any naturally occurring amino acid
  misc_feature (303)..(303): Xaa can be any naturally occurring amino acid
  misc_feature (306)..(306): Xaa can be any naturally occurring amino acid
  misc_feature (308)..(308): Xaa can be any naturally occurring amino acid
MKPLEELATGCAGTKMREEXSQKQQKQWSLDDFEIGKPLGRGKFGRVYLAREIKSKYVVALKVIFKAQIEKYRLHHQLKREMEIQTSLCHPNVLRLYGWFHDSERIFLILEYCYGGELYRELRKTGYLTEKQAATYIASLTQALAYCHEKHVIHRDIKPENLLLDHEGRLKIADFGWSVQSTNKRRTMCGTLDYLAPEMVENKAHDYAVDNWTLGILCYEFLYGVPPFEAESQSDTFKRIMKVDLSFPSNPHVSAEAKNLISRDEWILERGLXPFSSKLKYFPREFHEMAYSNGVPVETLVFXSGXYXALLI

SEQ ID NO: 50024 - protein, 214 aa, Oryza sativa Indica Group
MAGEADGKAPLGSRYPPAALNERILSSMSQKHVAAHPWHDLEIGPGAPAVFNCVVEIPRGSKVKCELDKATGLIKVDRVLYSSVVYPHNYGFIPRTLCEDGDPMDVLVLMQEQVVPGCFLRARAIGLMPMIDQGEKDDKIIAVRADDLNTATSGTSRKSPFTAFKRSAVFFEDYKKNENKEVAVNEFFPAEDAINAIKYSMDFYGAHIIESSRK

SEQ ID NO: 50025 - protein, 481 aa, Thermococcus kodakarensis KOD1
MAVRRKLIKERVPTPEVPVEERIKSFVEVNLGYDFASAVKEAERCLQCPVEYAPCIKGCPVHINIPGFISKLVEYRDNPDKAVREALRIIWNDNTLPAVTGRVCPQEDQCEGVCVMGKVGDPINIGKLERFVADYARKHGIEEELLCEFEERCTGELGKVAVVGAGPAGLTAAGELAKMGYKVTIFEALHKPGGVLAYGIPEFRLPKEILDQELAKLKRLGVEIRTDHVVGRTVTIEELLQEYDAVFIGTGAGTPKLLNVPGILLDRIYSANEFLTRVNLMKAYEFPEYDTPIAIGKKTIVIGAGNTAMDAARSALRLGSEVTIAYRRGREDMTARIEEIKHAEEEGVKFEFFLQPVEFIGDENGRVKAVKFEKMRPLDERDARGKRKIVGTGEYVTLEADTVIIAIGLEPNRIITETPGLKTNTNGTLVVDENLMTSIPGVFAGGDAIRGEATVILAMGDGKKAAKAIHEYIQAKRKANA

SEQ ID NO: 50026 - protein, 475 aa, Mycobacterium smegmatis str. MC2 155
MTNAQNLIGGAWVGEPIIERRNPANPDDVVAIAPSASAADVHDAVAAATDAQPGWAALTAVQRGAILMDAADLLRRRHEEIATDLTREEGKTRAEAMGEVRRAIDVLRFFGSAGWRPSGETLPSTMPNTSVHTRREPLGVVGLVTPWNFPIAIPAWKMAPALVSGNAVVIKPAELTPLSINHLATALIDAGLPAGVLNVVHGSGSLAGDALVRHQEVAAVSFTGSTGVGMAIRDVVNARNARVQLEMGGKNAYLVLDDADVEAAAATVAAGAFSLTGQACTATSRVYVTPGVREVFVKALREKAGAVKSGNGLDPGTTMGPVVSDAQLAKDVTAIHAAVEAGFDAGEVTEPKGQFLAPVVFSGVPHDHPLVTREVFGPVVGVIDVADYQEGLNLVNDSPYGLTAGICTRDLGKAYDFAARVRVGVVKINRPTTGLDLNVPFGGVRDSSTNTFREQGERAVDFYTWTKSVYIGHDL

SEQ ID NO: 50027 - protein, 285 aa, Mycobacterium smegmatis str. MC2 155
MSVRSALRPGVLSPTLPVPKSIPRPEYAWKPTVQEGSEPWVQTPEVIEKMRVAGRIAAGALAEAGRAVAPGVTTDELDRIAHEYMIDHGAYPSTLGYKGFPKSCCTSLNEIICHGIPDSTVIEDGDIVNIDVTAYIDGVHGDTNATFLAGDVSEEHRLLVERTHEATMRAIKAVKPGRALSVVGRVIEAYANRFGYNVVRDFTGHGIGTTFHNGLVVLHYDQPAVETVLEPGMTFTIEPMINLGTLDYEIWDDGWTVATTDGKWTAQFEHTLVVTEDGAEILTQL

SEQ ID NO: 50028 - protein, 367 aa, Chlamydomonas reinhardtii
MRLGGGPGGSELDDLLGKRSVKEKVKVEKGSELLDILSKPTARESARVEQFRTAGGSAIREHCPHLTKDECRRVNGVPLACHRLHFLRVVQPHTDVALGNCSYLDTCRNMRTCKYVHYRPDPEPDVPGMGSEMARLRASVPKKPVGDGQTSRGALDPQWINCDVRSFDMTVLGKFGVIMADPPWEIHQDLPYGTMKDDEMVNLNVGCLQDNGVLFLWVTGRAMELARECMAKWGYKRVDELIWVKTNQLQRLIRTGRTGHWLNHSKEHCLVGIKGSPQLNRYVDTDVVVAEVRETSRKPDEMYSLLERLSPGTRKLEIFARVHNCKPGWVGLGNQLKNVNLIEPEVRQRFAARYGFEPDASKDCFVN

SEQ ID NO: 50029 - protein, 339 aa, Lactobacillus johnsonii NCC 533
MAKIAVLGNGSWGSVLGSMLADNGNDVVLYGNIDSVNQEINEHHTNTHYMKNWKLNPNVPATGDLEKALDGAEIILFVLPTKAVRIVAKNARKILDKTGATPLLVTATKGIEPGSKKLISDILTEEVYPNDSEKIVAISGPSHAENVAQKDLTAIACASTSEENAKRVQKIFSNNYVRFYTNDDLVGVEVGGAVKNVIAIAAGILVGKGYGDDAKAALMTRGLAEITRLGVKYFGAKPMTFSGLSGIGDLIVTATSQNSRNWRAGKQIGEGKSLDYVLDHMGQVVEGATTVKAVHELAEEKNIDMPISEAIYRVLYENADVDQEIKTMMGRNPKPEIQL

SEQ ID NO: 50030 - protein, 303 aa, Salmonella typhimurium
MNTLEQTIGNTPLVKLQRIGPDNGSEIWVKLEGNNPAGSVKDRAALSMIVEAEKRGEIKPGDVLIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKPVTIVGLQPEEGSSIPGIRRWPAEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 50031 - protein, 330 aa, Lactobacillus johnsonii NCC 533
MKVLVIGGAGYIGSHAVRKLIEEGNDVVVLDSLYTGHRKAVDKRAKFYQGDIEDTNLVSKILRDENIDAVMHFAAYSLVPESVKKPLKYYDNNVSGMISLLQAMDDAKVKYLVFSSSAATYGIPKTLPITEDTPLDPINPYGETKMMMEKIMHWADKADGIKSIALRYFNVAGASSDGSIGEDHGPETHLIPNILKSAISGDGNFTIFGDDYDTKDGTNVRDYVQVEDLIDAHILALKHVMETNKSDVFNLGTAQGYSNLEILEAAKKVTSIDIPYTIGPRRGGDPDSLVADSSKARKVLGWKPKHENVDDVIATAWNWHKSHPKGYEDK

SEQ ID NO: 50032 - protein, 315 aa, Glycine max
  misc_feature (149)..(149): Xaa can be any naturally occurring amino acid
MAEHLASIFGTEKDRVNCPFYFKIGACRHGDRCSRLHTKPTISPTLVLSNMYQRPDMNMSIITNPDQPQPQSLDPDKVQDHFDDFYEDLFEELSKYGPIQSLNICDNLADHMVGNVYVQFREEDHAANALMNLTGRFYSGRPIIVDFSXPVTDFREATCRQYEENVCNRGGYCNFMHLKKISRDLRRKLFGRNRRWNGRSGSRSRSPPRNRNHGENSHSGRGSGRRDFDRSHGPHGRRPRSRSPRYRGKRSRSPVGRDRSPPIRESSAERRAKIEQWNREKEQGDTGNMNNSKSSDDYQEQSVAQNGSESGNHQI

SEQ ID NO: 50033 - protein, 492 aa, Spigelia marilandica
  misc_feature (39)..(39): Xaa can be any naturally occurring amino acid
TSGSGVSTLEKKNLGRIVQIIGPVLDAAFPPAKMPNIYXALVVKGRDTVGQPINVTCEVQQLLGNNRVRAVAMSATDGLMRGMEVIDTGAPLSVPVGGATLGRIFNVLGEPVDNLGPVDTGTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEMENSLKK

SEQ ID NO: 50034 - protein, 232 aa, Rhodopseudomonas palustris CGA009
MSSFALRPLAIAPSILASDFSKLGEEVRAVDTAGCDWIHLDVMDGHFVPNISYGPDVIKAMRPHTKKVFDAHLMIAPCDPYLEAFAKAGCDIITVHAEAGPHLHRSLQAIRALGKKAGVSLNPGTHPSAIEYVLDDIDLVLVMSVNPGFGGQAFIPSAVQKIKQIRAMVAGRPIDIEVDGGVSDKVAGELAAAGANAFVAGSAVFKGGTLEAYKANIAGIRNAAMQARGEVA

SEQ ID NO: 50035 - protein, 219 aa, Corynebacterium glutamicum ATCC 13032
MAQRTPLIAPSILAADFSRLGEQVLAVPDADWIHVDIMDGHFVPNLSFGADITAAVNRVTDKELDVHLMIENPEKWVDNYIDAGADCIVFHVEATEGHVELAKYIRSKGVRAGFSLRPGTPIEDYLDDLEHFDEVIVMSVEPGFGGQSFMPEQLEKVRTLRKVIDERGLNTVIEIDGGISAKTIKQAADAGVDAFVAGSAVYGAEDPNKAIQELRALAQ

SEQ ID NO: 50036 - protein, 336 aa, Pseudoalteromonas tunicata D2
MTIKIGINGFGRMGRLSMRAAFDWQDIEIIQINDPAGDAETLAHLMNFDSVHGRWHHEATHQDSSIVINGKPILCSKNKSINDTDWSQCDVVIEASGKMKTKTLLDAYLAQGVKRVVVTAPVKEEGILNVVMGVNEHLFDKEHHPIVTAASCTTNCLAPVVKVIHEKIGIKHGSMTTIHDITNTQTILDAPHKDLRRARACGMSLIPTTTGSATAITHIFPELAGKLNGHAIRVPLANASLTDCVFEVASPTNALEVNSLLQEAANNELKGIMGFETRPLVSIDYKTDPRSSIIDALSTMVINETQVKLYVWYDNEWGYANRTAELARMVGLADKV

SEQ ID NO: 50037 - protein, 242 aa, Zea mays
  misc_feature (218)..(218): Xaa can be any naturally occurring amino acid
  misc_feature (237)..(237): Xaa can be any naturally occurring amino acid
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHHLVSITKKNHRQDATNGGDEGXFFTYIQENKEGLNYEGTLXKAGYL

SEQ ID NO: 50038 - protein, 354 aa, Forsythia x intermedia
MAKVVNPRVEILASNGIQSIPKEYVRPQEELESIRDVFEEEMSDEGPQLPTIDLEGLDSDDKQVREKCHQELIKASKEWGVMHLVKHGISDELIDRVKMAGKAFFNQSVEKEKYANDQASGNVQGYGSKLANNASGQLEWQDYFFHCIFPEEKRDLSICPKTPTDYIPAISEYAKQLRDLTSKMLSVLSLGLGLEQGRLEKEVGGMEELLLQLKINYYPKCPQPELALGVEAHTDISALTFILHNMVPGLQLFYKGKWVTAKCVPNSIIMHIGDTIEILSNGKYKSILHRGLVNKEKVRISWAVFCEPPREKILLKPLPETVSEAEPSRFPPRTFAQHVMNKLFRKSEDSGETK

SEQ ID NO: 50039 - protein, 424 aa, Burkholderia mallei ATCC 23344
MAIVEVKVPQLSESVSEATMLQWKKKPGEAVAQDEILIELETDKVVLEVPAPAAGVLAQVLQNDGDTVVADQVIATIDTEAKAGAAAAAAGAADVQSAAAPVAAPAPAAQPAAAASSTAATSPAASKLMAEKGIGAGDVAGSGRDGRITKGDVLSAGSAPKAAPAAAPAKAAAKPALPEVKVPASATTWLNDRPEQRVPMSRLRARIAERLLESQQTNAILTTFNEVNMQPVMDLRAKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERPVVENGQIVIRPINYLALSYDHRIIDGREAVLSLVAMKDALEDPARLLLDL

SEQ ID NO: 50040 - protein, 476 aa, Burkholderia mallei ATCC 23344
MSKEFDVVVIGAGPGGYIAAIRAAQLGKTVACIEKWKNPAGALKLGGTCLNVGCIPSKALLASSEEFENAQHHLADHGISVDGVKMDVAKMLARKDGIVEKMTGGIEFLFKKNKITWLKGHGKFTGKSDAGVQIEVSGEGETQVVTAKNVIIATGSKARHLSNVPVDNKIVADNEGALAFDSVPKKLAVIGAGVIGLELGSVWRRLGAEVTVLEALPAFLGAADEALAKEAAKLFKKQGLDIHLGVKIDGVKTGANGVSIAYTDKDGNAKTLDADRLIVSVGRVPNTDNLGLEAIGLKANERGFIDVDDHCRTAVPNVYAIGDVVRGPMLAHKAEDEGVLVAEVIDGQKPHIDYNCIPWVIYTYPEIAWVGKTEQQLKAEGREIKSGKFPFSINGRALGMNAPDGFVKMIADAKTDELLGVHVIGANASDLIAEAVVAMEFKAASEDIARICHPHPSMSEVMREAALAVDKRSLNS

SEQ ID NO: 50041 - protein, 585 aa, Aquifex aeolicus VF5
MPAKKGADIVIETLKAEGVEVVFGLPGGAIMEVYDALYRLGGIKHILARHEQGAGHMAEGYAKATGKVGVVMVTSGPGATNLVTPIADAYMDSVPLVAITGQVPTHLIGNDAFQEVDIVGITRPITKHNFLVKSIEELPLILREAFYIARTGRPGPVLVDLPKDVTQQIADVKIPSDEEVKAALPGYKPHVEGNPQQIKKAAELIMSAKRPVLYVGGGAVNSEAQEELIELAELMQIPVTTTTQGKGAFPETHPLSLRMLGMHGTYYANMAVYNSDLLIAVGARFDDRVTGKIDEFAPGAKIIHIDIDPASISKNITVDVPIVGDVKIVLRKLINEIKKRGAKILYPEERKKWLEQIEKWKKLHPLTYRNSDKVIKPQYVIEQLWEATNGEAIIVPGVGQHQMWAAMFYKFKYPRQFINSGGLGTMGFGLPAGIGAKIGRPDREVWVVDGDGSFVMTMQEVITAVQYKVPVKVAIINNAYLGMVRQWQELFYDKRYSEVDLSVQPDFVKLAEAMGAVGMRAKKPKEVREVIEEARKIDDRPVIIDFWVDREENVLPMVPAGKSYKDMILEDGKGKHEAETMYLVG

SEQ ID NO: 50042 - protein, 471 aa, Methanopyrus kandleri AV19
MEYGCLIGGEWLEGDREIVVENPYDGSEVGRVLAPEVDVEALLKDAREGQRRWRERPTYEVREALAEAAHLLKKHEDELAELIALEGGKPIRDARYEVYRTREVLRLSAAEAERLYGETLPGDAQRGRTAELILTVREPVGVVLSITPYNFPLLLPTHKLGPALAARCSVVHKPATVTPLSSLRLAEILLDAGVEPLALQVVVGPGAELGEELARADFDALSFTGSRSVGEHLREISPIPRITLELGGNDPVIVDETADVEAAAEAAVRGACYHAGQVCIAVERAIVVEDVYEEFLEAAVEVAESLKVGDPLDEDTDVGPLIDDGAVEKVRRHVEDAVERGAEILTGGEPEGRLFPPTVLADVPEDALVAREETFGPVLPVIRAKDFEEAIRIANSTDYGLHAAVFTERLDRAVKATRKLEAGGVIVNESTIYRADYMPFGGVKASGVGREGVPQAVREFTEEKTVVIGRR

SEQ ID NO: 50043 - protein, 124 aa, Codonopsis lanceolata
MEHHQISISKVVKVDSKQTWDSLVIQAINQSSPIVAHFTASWCIPSVVMNPFFEELASTYKDTMFLLVDVDDVQEVASKYEVKAMPTFVLMKEGAQVDKLIGANPDEIRKRIESLIQSNPICVA

SEQ ID NO: 50044 - protein, 379 aa, Burkholderia thailandensis E264
MIEFTLPSMGADMDEGTLLEWKVKPGDAVKKGQVVAVVDTSKAAVDIESWQEGTVDELIVEPGEKIPVGTPIATLLEPGETPPAVRPVRRRARPAAAVGAGARRKISPAARQRAMRGGVDLDAVSGTGPGGSVTLADVERTSAAAAAPSEAAATGDRAREMRRVIAAAMARSKHEIPHYYVSEPIPLGKALAWLAAENAKRSVVDRLLPAALLLKAVAVTLTRFPELNGFYRQGAFQPAGQVHLGVAISLRQGGLIAPALLDAGTKPLTQLMRELADLTQRSRAGSLRSAELSQSTITVTNLGDRGAAEVFGIIYPPQVALVGFGRIVERPWAEGGALGVMPVVTASVSADHRVSDGHRGALFLVELSEALQNPEALSR

SEQ ID NO: 50045 - protein, 165 aa, Psychrobacter arcticus 273-4
MQQQHLISVLMENEAGSLSRVVGLFSQRGYNIETLNVAPTDDPSISRLTVTTITSPEKIEQITKQLHKLIEVVKVLNLSDTVHVERELMLIKVRATGGVREEIKRSADIFRAQIVDVNASLYTIQIVGDKAKLDGFIDVIGRERIMEVVRSGVIGIARGDKTLSL

SEQ ID NO: 50046 - protein, 80 aa, Cryptomonas sp.
NEQEIFEKVQTIISEQLGVDKSQVTKDANFANDLGADSLDTVELVMAIEEAFNIEIPDDAAEQISNLQQAVDFISQKVAA

SEQ ID NO: 50047 - protein, 298 aa, Triticum aestivum
MLRSTHPLSPSSSSSAPASSSGETMVGGAPSGAKLLQILNVRVVGTGERVVVLSHGFGTDQSAWSRVLPYLIREHRVVLYDLVCAGSVNPDHFDFRRYNNLDAYVDDLLSILDALRIPRCAFVGHSVSAMIGILASIRRPDLFAKLVLIGASPRFLNDSDYHGGFELEEIQQVFQAMSANYEAWAKGYAPLAVGADVPAAVQEFSRTLFNMRPDIFFPRFAEECSMTALPGVLGMGQAPCVLVQTTPDVSVPPTGAAYLRAHLGGRTTIEPLPTEDHLPHLSAPSLLAQVLRRALARF

SEQ ID NO: 50048 - protein, 554 aa, Zea mays
MELHLATIAHRPPLPVPARGHHLRRRLHHLPAPLSFQNTYSPSLSSPHHHRLSPTLRRHLRLPLLASQAPNSNPEPEPVPEPTGAKLLPLVISIAIGLAVRFLAPRPVEVSPQAWQLLSIFLSTIAGLVLGPLPVGAWAFLGLTAAVATRTLPFTAAFSAFTNEVIWLIVISFFFARGFVKTGLGDRIATYFVKWLGSSTLGLSYGLTLSEACIAPAMPSTTARAGGVFLPIIKSLSLSAESKPNHPSSRKLGSYLVMTQFQASGNSSALFLTAAAQNLLCLKLAEELGVIIANPWVSWFKAASLPALVSLLATPYLLYKIFPPETKDTPDAPALAEKKLKLMGPVTKNESVMIGTMILAVSLWVFGDAIGVSSVVAAMLGLSILLVLGVLDWDDCLNEKSAWDTLAWFAVLVGMAGQLTNLGIVSWMSNCVAKLLQSFSLSWPVAFCVLEASYFLIHYLFASQTGHVGALYSAFLAMHIAAGVPSVLSALALAFNTNLFGAITHYSSGQAAVYFGAGYMELPDVFRLGFITALANTLIWGVVGTIWWKFLGLY

SEQ ID NO: 50049 - protein, 541 aa, Listeria monocytogenes EGD-e
MKKVLLNSVKGYTWARFRKDLLAGIIVGIIALPLAMSFAIASGVSPEYGIYSSFVAGIIVSIFGGSKFQIAGPTGAFIPVLLGIVLTYGYQDLLVAGMMAGVLLCLMGIFKIGTLIKFIPRPVTIGFTAGIAVTIFMGQVGNFLGLTGMEKHESFVANMKEIWLHLDSWNFYSVLISCICMLVLFIFPKILPRIPAPLIGLVVTTAIAMLFFPDALPTIGSAYGNIPSTFPPFEFPDMTFANMSKLIGPAFVIAMLGGIESLLSAVVADGMTNTKHNSNRELIGQGIANIVTPMFGGIPATGAIARTATNINNGATSRVSGVIHGVFVLLTLLVLAPVAVNIPIAAMAPILMLVAWNMSERKTFQHIIKLKSGDTLVLVITFLLTVFASLTVAVEVGLLLAVVLFAKQMGSSMQIEEIEPEGAEIAPHLHEKISIFTIRGPLFFGAAQIFQQNIIKAIHVKPKYLILRMGKVPIIDATAEGYFHQIEKEFSKQGGQILITGLTDKAKESLKGSGLYDRIGEEHFFSHTEDAIHYAENALNK

SEQ ID NO: 50050 - protein, 805 aa, Oryza sativa Japonica Group
MAADGDGDGELVRRVRSPSSRGRMAPTLAFLLVLLLLLAGGGGGGAFLAAAASTDTVVPGKGMAGNQTLVSKNGRFELGFFTPGSGIHYFLGVRLRNMAEYSPTFWIGDRVGVIDLPGVSLEVFGDKLYIKEDGVSLWWSSVAGNGSSSSSDGGAVAVLLDTGDLVVRDQGNPSGVLWRSFDYPGDSLLPGGRLGLDAATGTNVSLTFKGFSHNGSLQVDASRRNGFVLTTDGIDSRGAFPDWMVTSQDNGSSLVLNHPDAPNSTEFLQFNLGLISLMRWSDSTAGWVARWTFPSDCKSGAFFCGDFGACTAGGGGGCECVDGFTPSYPDEWRLGYFVTGCSRSLPLSCEANGQTEHDDSFAILDNLRGLPYNAQDEPVTTDEDCRAACLNKCYCVAYSNESGCKLWYHNLYNLSSADKPPYSKIYVRLGSKLKSNRGLATRWIVLLVVGSLAVTSVMLGLVLLCRYRRDLFASSKFEVEGSLIVYTYAQIRKATGNFSDKLGEGGFGSVFRGTLPGSTTVVAVKNLKGVGQAEKQFRTEVQTVGMIRHTNLVRLLGFCVNGNRRLLVYEYMSNGSLDAHIFSEKSSLLSWHVRYQIALGIARGLAYLHEECEDCIIHCDIKPENILLDYEFCPKICDFGMAKLLGREFNSALTTVRGTMGYLAPEWIYGQPITKKADVYSFGIVLFEIISGRRSTETVKFGSHRYFPTYAAVQMNEGDVLCLLDSRLEGNANVKELDITCRVACWCIQDEENDRPSMGQVVRMLEGVVDMEMPPIPASFQNLMESEDSGIYSEESWNFRTRDQF

SEQ ID NO: 50051 - protein, 234 aa, Brassica napus
  misc_feature (171)..(171): Xaa can be any naturally occurring amino acid
  misc_feature (218)..(218): Xaa can be any naturally occurring amino acid
  misc_feature (224)..(224): Xaa can be any naturally occurring amino acid
  misc_feature (228)..(228): Xaa can be any naturally occurring amino acid
VDPRVRAPYGDHWRNLRRICALEILSSNRLTNFLHIRKDEIRIMLMRLSRDTTHSDGGSRFTHVELEPLFSDLTFNNIVRMVTGKRYYGDDVYNKEEAELFKKLVYDIAVYSGANHTADYLPVLKLFGNKFEEEVKALGKSMDEILQRLLDECRRDKDGNTMVTHLLSLQXQEPEYYSDVTIKGLMMAMMLAGTETSAITLEWAMTNLLRPLDVLKRXRSEIDXKIGXDRLIDE

SEQ ID NO: 50052 - protein, 163 aa, Glycine max
VILRFLLLAASVVALAVIVSSDQTEQVLFQDVLLPQPAKFKYSPAFVYFVAAFSVSGLYALVSALASISVIQKPGFKLKFLLHFIFWDALILGITASATGAAGSVAYIGLKGNSHVGWIKVCNIYDKFCRHLAGSIAVALFGSIVTVLLIWLSAFTIHSRVPK

SEQ ID NO: 50053 - protein, 223 aa, Arabidopsis thaliana
  misc_feature (37)..(37): Xaa can be any naturally occurring amino acid
  misc_feature (89)..(89): Xaa can be any naturally occurring amino acid
  misc_feature (158)..(158): Xaa can be any naturally occurring amino acid
  misc_feature (173)..(173): Xaa can be any naturally occurring amino acid
AIEDINNRMGAGMAFVICDEGKTIDDYCEHWHYAGGXLIALRLSKILIGLQELEILTPDWNQISNSTGLLLQKTSIIIDYLEDINDRPXSRMFWPREIWGKYVDKLEDFTNEEKATKAVQCLNEMVTNALNHVEDCLKSLASLRDPAIFQSCAIPHIXASGTLTLCYHNVQVXFEALVRMRRGLIAKVIDRTITMDDVLWRRSRIYSWQPKNQRVDHNAPKWY

SEQ ID NO: 50054 - protein, 309 aa, Bacillus cereus ATCC 10987
LFFVYNIEMLYMNRGRDVMSKFTVASNGSLETTLRGVEVLSTPLLNKGVAFTQEEREELGLKGLLPPAVLTLEEQARRAYEQFCSQPDDLLKNVYLTALHDRNEVLFYRILTDHLREMLPIVYTPTVGVAIQRYSHEYRKPRGVYLSINDPSGIEEAFANIGATAENIDLVVVTDGEGILGIGDWGVGGINIAIGKLAVYTAAVGIDPSRVLPVILDVGTNREELLNNPFYIGNRHPRITGEAYDEFIDTFVRAVNKQFPKALLHWEDFSSRNARKILDKYRHDICTFNDDIQGTGAVSLAAVLSAVKA

SEQ ID NO: 50055 - protein, 393 aa, Corynebacterium glutamicum ATCC 13032
MSKDTTTYQGVTEIGSVPAYLVLADGRTFTGFGFGAIGTTLGEAVFTTAMTGYQETMTDPSYHRQIVVATAPQIGNTGWNDEDNESRDGKIWVAGLVIRDLAARVSNWRATTSLQQEMAGQGIVGIGGIDTRALVRHLRNEGSIAAGIFSGADAQRPVEELVEIVKNQPAMTGANLSVEVSADETYVIEAEGEERHTVVAYDLGIKQNTPRRFSARGVRTVIVPAETPFEDIKQYNPSGVFISNGPGDPAAADVMVDIVREVLEADIPFFGICFGNQILGRAFGMETYKLKFGHRGINVPVKNHITGKIDITAQNHGFALKGEAGQEFETDFGTAIVTHTCLNDGVVEGIALKSGRAYSVQYHPEAAAGPNDASPLFDQFVELMDADAQKKGA

SEQ ID NO: 50056 - protein, 284 aa, Arabidopsis thaliana
MAERGGESGAERGGDRGDFGRGFGGGRGGGRGRDRGPRGRGRRGGRASEETKWVPVTKLGRLVADNKITKLEQIYLHSLPVKEYQIIDHLVGPTLKDEVMKIMPVQKQTRAGQRTRFKAFVVVGDGNGHVGLGVKCSKEVATAIRGAIILAKLSVVPVRRGYWGNKIGKPHTVPCKVTGKCGSVTVRMVPAPRGSGIVAARVPKKVLQFAGIDDVFTSSRGSTKTLGKFVKATFDCLQKTYGFLTPEFWKETRFSRSPYQEHTDFLSTKAVSATKVITEGEDQA

SEQ ID NO: 50057 - protein, 122 aa, Oryza grandiglumis
PVGENKRGGEVYRLYDVGGQRNERRKWTHLFEGVNAVIFCAAISEYDQMLFEDETKNRMMETKELFDWVLKQRCFEKTSFMLFLNKFDIFEKKIQKVPLGVCEWFKDCQPIAPGKQEVEHAY

SEQ ID NO: 50058 - protein, 509 aa, Leifsonia xyli subsp. xyli str. CTCB07
MSTQALAIDASRTIVDGGVIYHRPGDSGSIVPLRTRYDNFIGGQWRAPSTGRYGEDIAPATGQPFAEYARSGPDDVDAAVAERAAVLNAIADRLEQNLESIAVMESRENGKPVRETLHADIPLALDHFRYFASAIRAQEGTIAPLSRDLVSYHFFEPIGVVAQIIPWNFPLLMAAWKLAPAIAAGNTVVLKPASATPVSVLYVLQLIEDLLPAGVVNVVNGAGSTLGQALVEHPGVAKVAFTGSTETGRQIMQYAVKNIIPSTMELGGKSPNIYFDDVSREHDAFYRKALEGMSLFAFNKGEVCSCPSRAFLQRGLIRDGFLDAAVERISRIRVGDPLDTRTEMGPQNSAEQVDKIAGYLALGPMEGCEVLAGGGLADLGGDLSGGYFVEPTVFRGRNEMRVFQEEIFGPVLAVAAFDEYDEAIHLANATIYGLGSGVWSRDADLTFAASRDIHAGRVWVNTYHQYPAGAAFGGYKQSGYSRETDQQTLRNYQQVKNVLVNHQPLGLFV

SEQ ID NO: 50059 - protein, 350 aa, Leifsonia xyli subsp. xyli str. CTCB07
MLIERKTPMRAAVVTSFTEPIVVEDVPLPTPGPGQVLVRIETCGLCHTDIHAAHGDWPVRPSLPFIPGHEGVGRVTALGEGVTAPAVGTRVALAWLGSACGSCRYCETGRENLCVSQQNTGYSIDGAYAEYAVADARFAVPVPDSVSSMDAAPLTCAGVTAYVAVKTARVRPAERVVVFGVGGLGHLAVQYARLVGAEVIAVDVTDEKLALATELGADHVVNARTSDPVQEIHALGGADAVIVLAVAPAVFDQAFRSLSRGGRLILVSLPANGVMGIPVFETVLNGITVAGSIVGTREDLAEVFRLQALGRTRVIAQPRELEQAPEAMQEVLDGTVPARLVFDLAHVGSH

SEQ ID NO: 50060 - protein, 458 aa, Xanthomonas campestris pv. campestris str. ATCC 33913
MSALLGATPADWLDARNLRLATRLGGLGLDPAAGRTLIREGILRRAVGLTLEATGCEAPMGATCKVEVDGGWVDAEVVGFSGERTYLMPSAELHGLLPNARVVPSRRRGGVEVGEGLLGRVIDSDGTPLDGKGPIRAEGSVGMAGVSINPLAREPITTSLDVGVRAINAMLPIGRGQRVGLFAGSGVGKSTLLGMMTRFTSADVIVVGLIGERGREVRDFVETTLGEEGLRRAVVVAAPADRPPLARLHGAYRATAIAEWFRDQGLNVLLLMDSLTRFAQAQREIGLSVGEPPTTRGYPPSVFAKLPALVERAGNGAKGRGSITAFYTVLTEGDDPQDPIADAARAILDGHILLSRRVADSGLYPAIDLESSVSRVVQDIANDTWRLRIRKLKRLLSAYTANRDLIAIGAYQRGSDPATDEALARWPEIVDFLGQDVHKASDLTDSLSALQRLVEPEN

SEQ ID NO: 50061 - protein, 67 aa, Glycine max
MKYNIANHSNGCQNHLEIDDELKLRAFWRQRIPHDDLCDVLGEEFKGYVFKITGGYNTQRFPMKPGV

SEQ ID NO: 50062 - protein, 498 aa, Leptospira interrogans serovar Copenhageni str. Fiocruz L1-130
MHSFYIPFGSSLVVLNLEPILPLCFWPHSLRQPGPKTKVLSPREGEILTVYQLETTVQANSDGEFEIFHEGNKLFSFQSTPSSPQTSPTFKPKNGHNTIQIRFKKSNGFVLSQEIHFYFGTKLSAGGAHSGFLINGELYTVGRNNFGQLGTGISTGDGINDRIVKVDPIRDIFSIHFNQNNSMAISQNGRVYTWGANSKGQLGIGNNNTDPARASDPGNRQPPTEIPGINDAVMGAYGFNHALVLKSDGTVVAFGQNNVGQLGNGENNLNRNSFSSNPVNVVQLRNVIQVIAGSEHSAALTENGEVYIWGRNQYGNLGNGIISPANTVQSVPVKVEGLSKIKQIANGRDHILALTSDGKIYSWGLNASGQLGIGGNGNPPPTPIPTQILNIQDVASIWAGGTQSFAILKNGEVKGWGANGNMASLALGESNTQKVYEPNKAVVGIDNVVHFGCGATHNFALLGNGEIYGWGWNFKGSLGRTDLQNNWGAPNPVYIKFP

SEQ ID NO: 50063 - protein, 178 aa, Thermococcus kodakarensis KOD1
MNPFHELEPGPEVPEVVYALIEIPKGSRNKYELDKKTGLLKLDRVLYSPFFYPVDYGIIPQTWYDDGDPFDIMVIMREPVYPLTIVEARPIGIMKMEDSGDKDWKVLAVPVEDPYFKDWKDIDDVPKAFLDEIAHFFQRYKELQGKTTTVEGWGNAEEAKKEILRAIELYKEKFGKKE

SEQ ID NO: 50064 - protein, 288 aa, Oryza sativa Japonica Group
MAGEEIGASEEHGCAAGGEPMNDYERQRLARIRENEARLQALGIRRLAASPLLHSPASSAGGKGKRKSRAADADEEYLPSDGGEDDDEEESSSTSDQDGEEEEDAEASSRSRKKGKKKVLNSGKSSQVTHRKENAHLADSVDDDAALQQAIALSLAESLENSVPAMSGETPSTGMKGSGSTPCKKNNTVPIQDSAKTMRIKKQGKSRIQLTEDDVVAFFFSFDEVGKGYITPWDLERMATVHDFIWTDSEISKMIHCFDSDRDGKINLEDFRTIVSRCNMLQEPEKSG

SEQ ID NO: 50065 - protein, 314 aa, Burkholderia vietnamiensis G4
MRGRLHWHMSTSPARQWGLEEIVAGLRESREELHRTRHPRGIRELPSRDAICKIVTGLRASMFPTHYGAPDLTDESVDYYVGHTLESTLRILSEQIRRALPFLPEHADTPFVALDERAFEIAREFGRQLPSIRALLVSDIQAAYAGDPAAQHITEILLCYPGVLAMMHHRLAHALHQLGVPLLARFINEIAHSATGIDIHPGAQIGPSFFIDHGTGVVIGETAIIGERVRVYQAVTLGAKSFPADGDGALVKGNARHPIVEDDVVIYAGATILGRVTIGRGSVIGGNVWLTHSVPPGTSVAQGKVREGGSAEKP

SEQ ID NO: 50066 - protein, 317 aa, Exiguobacterium sibiricum 255-15
MVMRIANSVLDLVGRTPIVKLNHLTGPEDADVYLKLEYMNPGSSVKDRIALAMIESAESAGHLKAGDTIIEPTSGNTGIGLAMVAAAKGYRSILVMPETMSMERRTLLRAYGAELILTAGPEGMKGAIARATAEAEEHGYFMPQQFNNESNPVVHEKTTGPEIVEAFEGLTLDAFIAGIGTGGTITGAGKVLREAFPGIEIIAVEPTDSPVLSGGKPGPHKLQGIGAGFVPSILDTQIYDSVEQVTTEEAFDHARRAAKSNGVLGGISSGAAIAAALKTAKRLGKGKTVLAIIPSNGERYLSTPLYQVEEETDSSKL

SEQ ID NO: 50067 - protein, 299 aa, Thermosynechococcus elongatus BP-1
MLMLIGSQEGTAHLPLAVMNPQEYALVLDPGYPSHVGGVYLAGGQVYPLPLRSEDHFLPDLAAIPLAVREQAKLLILSYPHNPTTAVAPLDFFKTAVEFCDRHGILLVHDFPYLDLVFDGERAPSIFEVDRDRQVGIEFYSLSKSYNMGGFRIGFAIGRADIIAALRQIKSVIDFNQYAGILRGAIAALTGDQTCVQQTREIFRQRRDVFVQALGDHGWPVPLPPATMYVWAQLPAPWQRDSLGFCQALVQATGIAAAPGSGFGQGGEGYVRFALVRDRPCLEVAAAQIAAFSQTVPKV

SEQ ID NO: 50068 - protein, 449 aa, Listeria monocytogenes EGD-e
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNNVDWIKGYAEFVDEKTLRVNGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAIPQKVEKNPDGSLTLSLEDGRTETVDTLIWAIGRKPVIKGLQIEKSGVELLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 50069 - protein, 363 aa, Blastopirellula marina DSM 3645
MEAGIVGLPNVGKSTLFNALTAAGIASENYPFCTIEPNVGIVPVPDERLEIIQSFIKTQKVIPAVLQLVDIAGIVRGASEGEGLGNKFLSHIREVDAIVHVVRCFADSDVIHVDGSVDPIRDIETIDTELMLADLQTVESSKDRAAKSARSGDKEAKARVELLEQCYAVLSAGKPVRSMSFPDPETEKRARGLGLITAKKVLYLANVDEDNLTGEGELVAKVRARAAEEEGEVVPVCARLEAELIELDAADRQEMLESVGLTEPALHTFARSAYKLLGLQSYFTAGEKEVRAWTIPIGATAPQAAGVIHSDFERGFIRSETYSVADLEQLHSEKAIRDAGKMRVEGKQYVMKDGDVCHFLFNV

SEQ ID NO: 50070 - protein, 298 aa, Schizosaccharomyces pombe
MSTEEQKEEIKDISSKQENSSEVPKAEEAGKVVESQKDTTSEEKKEETTEKKEDDGKKDLSFDEAEVLKQVEFYFSDTNLPHDKFLWTTSQKNDGWVPIQTIANFKRMRRFQPLEAIVNALRKSPELLEVDEAGEKVRRMIPLVRVDNKSVMERSVYCKGFGDEKDDTQIALEKFFEENAGPISAVRIRRDDDKKFKGSVFVEFKEPDVANKFLEKVKTAPLKWGEDELTIMSKKEYVDMKAELHKNDPPKFSSKRRRFDAFKEMDRQRPGKYSNRGRKFKKQRSSNASEEKPSAASE

SEQ ID NO: 50071 - protein, 249 aa, Triticum aestivum
  misc_feature (121)..(121): Xaa can be any naturally occurring amino acid
MKISLNQPNGFTSHFAPTEHKYLDAPTQNIEHARNRFNPYVNHGGTVVAIAGEDFVVVGGDSRLSEGYSIVTRTESKVVQLTDKTVWATSGMYADFCELTKVLKAKLEVYDFKIERLPTTXSIAHLLSKTLYGRRFFPYYTFNLVAGLDKDGKGVVYGYDAIGSYGSDRALAQGSGAHMILPFLDSEVIGYNDPKHSQKPPLTVDRAVELVELAFKSAAERDIATGDKLEILVVTRDGSRKEWRQLRRD

SEQ ID NO: 50072 - protein, 300 aa, Klebsiella pneumoniae subsp. pneumoniae MGH 78578
MAALNSKVRKAVIPVAGLGTRMLPATKAIPKEMLPLVDKPLIQYVVNECIAAGITEIVLVTHSSKNSIENHFDTSFELEAMLEKRVKRQLLEEVQSICPPHVTIMQVRQGLAKGLGHAVLCAHPVVGDEPVAVILPDVILDEYESDLSRDNLAEMISRFDETGASQIMVEPVEDVTAYGVVDCKGESLKPGESVPMVGVVEKPKADVAPSNLAVVGRYVLSADIWPLLAKTPPGAGDEIQLTDAIDMLIEKETVEAYHMKGKSHDCGNKLGYMQAFVEYGIRHKTLGDDFKAWLETAVAK

SEQ ID NO: 50073 - protein, 123 aa, Exiguobacterium sibiricum 255-15
MDRIEVTGMRFYGYHGVFAEETKLGQRFNVDLSIGLDLLRAGQTDDLRESVNYAELYEVTKQVVEGTPLQLVEALANRIAEQVLALDNRILETTVKVIKPDPPIAGHYEHVAVEIHRKRADYL

SEQ ID NO: 50074 - protein, 1764 aa, Cryptococcus neoformans var. neoformans JEC21
MSHHPQLSVSTGSAGAGPSTPTLPRRPQGARRRGVMPGLFIANPDNSDEENSPPKAGSQRSSSGVSPISVSSSSGRGGPSSVSIPQPASPSHSIKERGSLPYPSIPAPQSSPLPSISAFPSPQPLIPTPSPAPIAYGHTPEISSGPPQPPPQPQRHLQRAFTTATPENAPRLLPEPRSSSTGTTSFHQQVNNSPSRALPSLPSPITRQSTMPSPVSQSPSTSHGQPYSAPPAYHPHDPTRVASPDDVMSPATGSEHGSIMSAGIGHRNRSASVQGQQVRLQVTTDNEAFHLVDITGINTAEGIREKVFSKLRIRDEDYPTLSMYRTEIGEPADETPILPAALLNICRTLGDSRASLKFLVKQTDVPPSSAASVIPPVSQTDYHPFRAASDPRRAGVPPITTDLPNPVLYRVSSRHSKEGKDWSGPGLSRSTRKSVLQNAGVRLSTSTGGSRSPVTEHSASLGTSSPALPTPPIPPHSTSLQAGEPSIHSSPSSRPSSRHYEFNELSLPPQFDHFKPSNAISVFPRPGTPISDSYQNENAFAGPSRPVMNQEQGSQGLGLTLDDDIDPETRALIEQFQREEQEAQKKEEERRRQLEADEELAKREQQSERELWEMMQQMQKEQRQREQAQIAEDEARARQVEEEQRQEEEQRQALEAARTAWEAEQREQRDQREQREQQESRFHTFEKDRRQRQQFFQNRARMGAPLDDSATWESTWMVGPSAEGSLSSRRPSEGRMPMVQTSAPRTSQTQSPALPPRQSSQPIYQPSQSQYLPDFAYSHRRPSGFPNTSYAETSHAQERLHDPRLQQATGRAPAPGQRGGTSNTPRPESQRLRHPFSYAAHEPSNERLQAPALSTARSVDNLRMTNGPLGMTSRQSQVYGPPRTSITPAPGFAEHRNIQPASATATSYRSPSSDRARDGRYPEPLHSSSRVATPMAPAIIDTGLVPFPSPHPNSAASSNSWRGHTPQFNSLPRSARGPTFDITRPNTVHYDRSPPPPTSPETAIPPRRPSTYYDEFHPPDTARTIVEDGATIRRPSSPFPWGDRARSGNASTPYRTASPVPVDQPRTSETNTFDDTDSQLPYAHNASPQSSWLSVSRAGAHRSDSDTLSVAGTVSSEATVRPGKGMGEDNDTNSGDTAKAGQWDRHLKEMIAKMGPGGGEGTVRPRKEEEEDEATLFITPPVRAPETSSSRTNAIRPSPSKPNLIVNTASLSQQAYDQVNPVLSASTPSDSATESEGTGEGDGEIEGSNIKRGKSFARPRDPNQWNFRPEPEQLYENLDRVFPQIDLDRPIVQGAESTPSTPGIESPSRVEIIGGLPLPAGAAPGRQGGPQAGSGPLGRAPQATGPSSAPTGAFNRSKFNKAENRRSIRVVADHKRRTLQRQVSRHEDLPPEYDVGAEEVNSAMDDQVVDPRSEEQRKKDNRRSSSMWDHKLVEVTRFARAQANREADIPESPASDGKPGTVNWVKGELIGKGSYGRVYIALNVTTGDMMAVKQVELPATEIERHDSRQQGMVKALRDEIELLKGLEHKNIVAYLGYETSPEYLSIFLEYVPGGTIASIYRTPNQARFEPQLVRFFTEQILEGLAYLHSKNIWHRDLKGDNILVDAQGICKISDFGISKQTADAYDSFGQATNMKGSVFWMAPEVIHSYSERSYSGKVDIWSLGCVVLEMWSGKRPWGDMEQFAAMFELFNKRSRPPLPPDINLSSVALDFLNEKCLATDPRNRPMARDLLQHEFIKNRDLTWTFKDSKIGKAVAKRGAKRPQA

SEQ ID NO: 50075 - protein, 195 aa, Lactobacillus johnsonii NCC 533
MLVPTVIEQTARGERAYDIYSRLLKDRIIMLSGEINDQMANSIIAQLLFLDAQDNTKDISLYINSPGGVITSGLAIMDTMNFIKSDVSTIAIGMAASMASILLTSGTKGKRFALPNSTVLIHQPLGGAQGQQTDIQIAANEILKSRKKLNQILHETTGQPLDKILKDTERDNYLSAEEAKDYGLIDEILVNQKKD

SEQ ID NO: 50076 - protein, 293 aa, Zea mays
  misc_feature (214)..(214): Xaa can be any naturally occurring amino acid
MDQYEKVEKIGEGTYGVVYKGKDRHTNETIALKKIRLEQEDEGVPSTAIREISLLKEMQHRNIVRLQDVVHNDKCIYLVFEYLDLDLKKHMDSSTDFKNHRIVKSFLYQILRGIAYCHSHRVLHRDLKPQNLLIDRRTNPLKLADFGLARAFGIPVRTFTHEVGTLWYRAPEILLGARQYSPPVDVWSVGCIFAEMVNQKPLFPGDSEIDELFXFSGILGTPNEQSWPGVSCLPDFKTAFPRWQAQDLATVVPNLDPAGWDLLFKMLRYEPSKRITARQALEHEYFKDLEVVQ

SEQ ID NO: 50077 - protein, 338 aa, Lactobacillus johnsonii NCC 533
MTVKIGINGFGRIGRLAFRRIMDLGEKSSDIEVVAINDLTTPALLAHLLKYDSTHGTFNHEVSATDDSIVVDGKKYRVYAEPQAQNIPWVKNDGVDFVLECTGFYTSKAKSEAHLKAGAKRVLISAPAGSDLKTIVYGVNDDTLTADDKIVSAGSCTTNSLAPMVNALQKEFGIEVGTMTTIHAYTSTQMLLDGPVRGGNLRSARAAAINIIPHSTGAAKAIGLVVPELNGKLNGHAQRVPVPDGSVTELVSILSKDVTADEVNEAVKKYESPSFAYNDHNIVSSDVLGMTAGSIFDPTQTMVTTAGDKQLVKTVAWYDNEYSFTCQMVRTLLKFATL

SEQ ID NO: 50078 - protein, 403 aa, Lactobacillus johnsonii NCC 533
MAKLIVSDLDLKGKKVLVRVDFNVPIKNGVIGDDNRIVAALPTIKYIIDHGGKAILLSHLGRVKSDADKKELSLRPVAERLSELLEKPVTFVPENEGKEVEEAIDNMKDGDVVVLENTRFQDIDNDFGKRESKNDPKLGEYWASLGDVFVNDAFGTAHRSHASNVGIATAMKKAGKPAAAGYLLEKEIKFLGDAVENPVHPFVTILGGAKVSDKIGVIENLIPKSDHILIGGGMAYTFLAAQGHKIGKSLFEADKVELAKSLLEKAGDKIVLPVDNVAATEFSNDAPHEIVGDDIPDNEMGLDIGPKTVEKFRDILKDAKTVVWNGPMGAFEMPNYAEGTLEVGRALADLKDAVTIIGGGDSTAAAKQLGIAPKISHISTGGGASLNYLEGKELPGIACVSDK

SEQ ID NO: 50079 - protein, 251 aa, Lactobacillus johnsonii NCC 533
MRTPIIAGNWKLHMNPEQTIEFVNAVKGKLPDPSKVESVIAAPAVDLYVLKKTAEGSNLHTGAENAYFEVEGAFTGETSPKVLNEMGIDYCIIGHSERRGYFHETDEDINKKAKALFANGVTPIICCGESLETREANKQDEWVVAQIKAALDGLTAEQVSKLVIAYEPIWAIGTGKTASADQAEEMCKTIRETVKDLYNEETAENVRIQYGGSVKPANVKELMSKPDIDGGLVGGASLDPESFLALVNYQD

SEQ ID NO: 50080 - protein, 277 aa, Sulfolobus solfataricus
GHMSSTPSNQNIIPIIKKESIVSLFEKGIRQDGRKLTDYRPLSITLDYAKKADGSALVKLGTTMVLAGTKLEIDKPYEDTPNQGNLIVNVELLPLAYETFEPGPPDENAIELARVVDRSLRDSKALDLTKLVIEPGKSVWTVWLDVYVLDYGGNVLDACTLASVAALYNTKVYKVEQHSNGISVNKNEVVGKLPLNYPVVTISVAKVDKYLVVDPDLDEESIMDAKISFSYTPDLKIVGIQKSGKGSMSLQDIDQAENTARSTAVKLLEELKKHLGI

SEQ ID NO: 50081 - protein, 250 aa, Sulfolobus solfataricus
GHMREMLQVERPKLILDDGKRTDGRKPDELRSIKIELGVLKNADGSAIFEMGNTKAIAAVYGPKEMHPRHLSLPDRAVLRVRYHMTPFSTDERKNPAPSRREIELSKVIREALESAVLVELFPRTAIDVFTEILQADAGSRLVSLMAASLALADAGIPMRDLIAGVAVGKADGVIILDLNETEAMWGEADMPIAMMPSLNQVTLFQLNGSMTPDEFRQAFDLAVKGINIIYNLEREALKSKYVEFKEEGV

SEQ ID NO: 50082 - protein, 279 aa, Zea mays
FRHTKKKTQGFLGSSSSSRSPGLLSPEHPKKYSATALSRPPSQHQQRRAMATAPYASSLFLASSPISTAPRIRAGPCPPSAQPSLRLRPRPSPAAAAAVQAEHQPALTAAPKPPALPFRVGHGFDLHRLEPDLPLIIGGINIPHDRGCEAHSDGDVLLHCVVDAILGALGLPDIGQIFPDSDPRWKGADSSVFMREAVKNCWVKLMHEAGYELGNLDATLILQKPKISPFKETIRSNLCDLLGADPSVVNLKAKTHEKVDSLGENRSIAAHTVVLLMRK

SEQ ID NO: 50083 - protein, 453 aa, Pseudoalteromonas tunicata D2
MAQHFDYIAIGGGSGGIASANRAAMRGAKVALIEAKHMGGTCVNVGCVPKKVMWHGAQVAEAIKLYAPDYGFDVEIKNFNWSKLLESREAYIGRIHQGYDKYLASNGVTVIKGFAKFVDEKTIEVNGEHYTADHFLIAVGGRPSIPNIPGAEHGIDSNGFFELKTQPKRVAVVGAGYIAVELAGVLNGLGTQTQLFVRQHAPLRSFDPLIVDTLKEVMAAEGPQLHTHATPSKVVKEADGSVTLHLENGESHNVDQLIWAIGRHPATDAINIQAAGVALNDRGYVIVDEYQQTSTANIYAVGDIVEGGVELTPVAVKAGRMLAERLFNQAMPNAKMDYNLVPTVVFSHPPIGTIGLTEPEAIEQFGKDDIKVYTSSFTAMYTAVTQHRQPCKMKLVCQGPNEKIVGLHGIGFAVDEMIQGFAVAMKMGATKADFDSVVAIHPTGSEEFVTMRG

SEQ ID NO: 50084 - protein, 365 aa, Bacillus subtilis
MKKRIALLPGDGIGPEVLESATDVLKSVAERFNHEFEFEYGLIGGAAIDEHHNPLPEETVAACKNADAILLGAVGGPKWDQNLSELRPEKGLLSIRKQLDLFANLRPVKVFESLSDRSPLKKEYIDNVDFVIVRELTGGLYFGQPSKRYVNTEGEQEAVDTLFYKRTEIERVIREGFKMAATRKGKVTSVDKANVLESSRLWREVAEDVAQEFPDVKLEHMLVDNAAMQLIYAPNQFDVVVTENMFGDILSDEASMLTGSLGMLPSASLSSSGLHLFEPVHGSAPDIAGKGMANPFAAILSAAMLLRTSFGLEEEAKAVEDAVNKVLASGKRTRDLARSEEFSSTQAITEEVKAAIMSENTISNV

SEQ ID NO: 50085 - protein, 365 aa, Oryza sativa
  misc_feature (192)..(192): Xaa can be any naturally occurring amino acid
MPLSYSAAAAAAPSPLAARSRGLLRRPPRSSPVVVRCKKIDQLRAVNGIPPYAPVSNRSLLSPVTLPIIRDANIKNDTRLRIFSGTANPSLSQEIASYLGLELGKINIKRFADGEIYVQLQESVRGCDVFLVQPTCPPANENLMELLIMIDACRRASAKNITAVIPYFGYARADRKSQGRESIAAKLVACLXQPVILDYLASKTICSDDLVVVSPDVGGVARARAFAKKLSDAPLAIVDKRRHGHNVAEVMNLIGDVRGKVAVMMDDMIDTAGTIAKGAELLHQEGAREVYACCTHAVFSPPAIERLSSGLFQEVIITNTIPLKEDKSFPQLTILSVANLLGETIWRVHDDCSVGHEPYSSLDID

SEQ ID NO: 50086 - protein, 221 aa, Brassica napus
  misc_feature (200)..(200): Xaa can be any naturally occurring amino acid
  misc_feature (209)..(209): Xaa can be any naturally occurring amino acid
PKQKHFTISIEKGEEIVDSFEGSEVKWSYVQSEKEKGEQVKRHYELTFEKKLREKITSSYLTHVVAESEEIKRSLRVVKLYSKDLYETDDDDGCAGGNWGCISLEHPSTFETLAMDPNAKKKIIGDLDRFLKRREFYKRVGKAWKRGYLLYGPPGTGKSSLIAAMANYLKFDVFDLELSSIYDNGQLKRILLSTTNRSIXLVFEDIDCXSEVRDRETDDDD

SEQ ID NO: 50087 - protein, 426 aa, Aquifex aeolicus VF5 [sequence omitted]

SEQ ID NO: 50088 - protein, 333 aa, Arabidopsis thaliana
MKLYEHDGVDLEDGKTVKSGGDKPIPRKIHNRALLSGLAYCISSCSMILVNKFVLSSYNFNAGIFLMLYQNFVSVIIVVGLSLMGLITTEPLTLRLMKVWFPVNVIFVGMLITSMFSLKYINVAMVTVLKNVTNVITAVGEMYLFNKQHDNRVWAALFLMIISAVSGGITDLSFNAVGYAWQIANCFLTASYSLTLRKTMDTAKQVTQSGNLNEFSMVLLNNTLSLPLGLLLSYFFNEMDYLYQTPLLRLPSFWMVMTLSGLLGLAISFTSMWFLHQTGATTYSLVGSLNKIPLSIAGIVLFNVPTSLQNSASILFGLVAGVVFARAKMREKS

SEQ ID NO: 50089 - protein, 122 aa, Oryza granulata
PVGENKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPIAPGKQEVEHAY

SEQ ID NO: 50090 - protein, 486 aa, Pseudomonas aeruginosa UCBPP-PA14
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 50091 - protein, 500 aa, Aspergillus oryzae
MRSTVTRSLSNATRARKGCISLRRFSLTTGKHKLVEAEKQRDGEQNHTSTNLESGDKSAILHSKLDTKPPTIVSSNGNYLIAEGGREILDASGGAAVACIGHNNSRVNNAIMRQLQSFSYIYAPFFTSKASEKLATLLSESTQNQLSKAFIVSSGTEAIEAALKMARQYFLELPNPEPSRTRFIARRQSYHGNTLGSLSLGGHVGRRAPYAPILTTNVSHVSPCYSYRGKRAEESDEDYVARLAQELEDEFQAVGASNVCAFVAETVSGTTLGCVPPVAGYLQAMKEVCDRHGALFILDEVMSGMGRCGTLHAWEQEGVVPDLQTVAKGLGGGYAPIGALLVNKRVVQALDKGTGAFVHSQTYQGHPVACAAAYEVQKIIKEENLLQNVRSLGEYLGNRLKEQLGDHKHVGDIRGRGFFWGIEFVKNKETKEPFLAEQKIAPVIHKTGLSEYSISFIPGTGVADGKNGDIIQIAPPYNATKADIDLIVERTALVVKRVLG

SEQ ID NO: 50092 - protein, 442 aa, Chlamydophila caviae GPIC
MIENDFQGYSPSYQASHFYRDKVGVIVLCGGEGKRLSPLTYWRCKPTVSFGGRYKLIDVPISHAIASGFSKIFVIGQYLTYTLQQHLVKTYFYHGVLQDRIHLLAPEGREGSQVWYQGTADAIRQNLLYLEDTEIEYFLVLSGDQLYNMDFRKVVDYAIAMQSDMVIVAQPIQEKDASRMGVLQIDKDANLVDFYEKPQEEEILNRFRLSSEDCRKHKLDPQYGNFLGNMGIYLFRRESLFQLLLEEQGDDFGKHLIQAQKQRGSIKTFLYDGYWTDIGTIESYYEANIALTQRPKPQVRGLNCYDDAGMIYSKNHHLPGTIVTDSMISSSLLCEGAVIDSSNVSHSVVGIRGVIGKNSIIDHSIVMGNDRYGNPQQNALGIGDNCEIYKTIIDENCRIGNGVKLTNIQGHKDYNSPDGKLVVRDGIIIIPRGTRIPDNYTF

SEQ ID NO: 50093 - protein, 326 aa, Kluyveromyces lactis NRRL Y-1140
MTVSISKSNLLRFEPVKSFRVSDKELGPITSVTFDDHGQYLLTATASDNMHLYDAVSCRFLNTIASKKYGCHSAKFTHAQSECIYSSTMKSFDIRHLNLETNTYLRYFQGHGALVSDIQMSPLDDTFLSASYDESVRLWDLRSSKAQALIPSLVPTCIAYDPSGLVFAIGNPENHEVGLYNVKHLKAGPFLVINVDPSFDQWNKLEFSNDGKYLLLASSAGKHLIMDSFDGTQLFELSGTKPFPLREFMDSGSATFTPDGRITLGTDYTGKIAIWNHADFISGRTLKPQGFINAAPNTCPRTIAFNPKYSMFVTADETVDFYVYNE

SEQ ID NO: 50094 - protein, 366 aa, Oryza sativa Japonica Group
MADCMQEWPEPVVRVQALADSGLEAIPRCYVKPPCDRPAPEADDASSGASIPVVDLGNGGDDEGGQLAEAVAAACRGWGFFQVVNHGVRPELMRAAREAWHGFFRLPLQEKQKYANSPRTYEGYGSRLGVEKGAILDWGDYYFLVLSPDAAKSPAKYWPANPGICKEVSEEYGREVIKLCERLMRLLSASLGLDETRFQEAFGGADCGAGLRANYYPRCPQPDLTLGLSAHSDPGILTVLLADDHVRGLQVRRRDGHWVTVQPLPDAFIVNVGDQIEILSNSMYKSVEHRVIVNAEEERISLALFYNPRGDVPVAPAPELVTPERPSLYYRPMTFDEYRVYVRKNGPKGKAQLEALKGQSITQNNE

SEQ ID NO: 50095 - protein, 488 aa, Listeria monocytogenes EGD-e
MSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDDVNVGPLIREDAIDKIDKQLKNATEKGAKVLTGGGRLTGSDYDKGNFYKPTVLDNVTRKMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 50096 - protein, 253 aa, Picea sitchensis
MKLNVSYPATGCQKLFEVVDEHKLRIFYEKRMGAEVEADLLGDEWKGYVLRVAGGNDKQGFPMKQGVLTNSRVRLLMSKGHSCYRPRRTGERKRKSVRGCIVDANLSVLALVIVRKGSQEIPGLTDGNVPRRLGPKRASKIRKLFNLSKEDDVRRYVVKRVLPPKEGKENAKPRSKAPKIQRLVTPVVLQRRRHRLALKKKRLVKRKASEADYAKLLAQRKKESKVRRQEELRRRRSASMRESKSSDKSAPQK

SEQ ID NO: 50097 - protein, 457 aa, Escherichia coli O157:H7 EDL933
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVTVFGEMEFWFAIIKVIAVVAMIIFGGWLLFSGNGGPQASVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAVVLVIMLMTPGMAISVYLIPVWLVVLGIGYLFKEKTAKAVKAH

SEQ ID NO: 50098 - protein, 630 aa, Escherichia coli O157:H7 EDL933
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAVPEAAAAKDVNVPDIGSDEVEVTEILVKVGDKVEAEQSLITVEGDKASMEVPAPFAGTVKEIKVNTGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 50099 - protein, 582 aa, Exiguobacterium sibiricum 255-15
MRRTKIVCTIGPASEKRLPEMIEAGMNVARLNFSHGDYEEHGARITDIRRAAEEANKLVTILLDTKGPEIRTHTFEEGKALLVRGKQVIVVSGDANEIVGTADKFSVTYDGLYDDVEVGSMIMLDDGLIGLRVAEKLDNRELLCDIENEGIIKTKKGVNLPNVKVNLPALTDKDIADIEFGIKSDIDLIAASFVRRASDVVAIRQLLEKHNASHIKIFPKIENQEGVANIEEIIAISDGLMVARGDLGIEIPTEEVTPTQKDLIKICNDYGKPVITATQMLDSMQRFPRPTRAEASDVANAILDGTDAIMLSGETAAGDYPIESVQMMHTIAKRTEKMLDYKMLLKDRQTRSEHTVTDAIAQAVTHTAINLDAKAILTPTQSGYTAARISKYRPEPNIVAVTPSARVARQLNIVWGVYPIVVDHLSDNTDDMLTLAADTAKEAGFVTDGDLVVISAGIPALTAGTTNMLKIHIVGKEITNGRGIGERGVVGEVVIAHTAEEANAKAKPGMILVTNSTDRDMMPAIEMAAAMVTVDGGLTSHAGIVGPSLGKPVIVGVENAMTIFTDGQRISIDPLTGKLYNA

SEQ ID NO: 50100 - protein, 388 aa, Avena sativa
MASATLLKSSFLPKKSEWGVTRQAAAPKPMTVSMVVRASAYADELVKTAKTVASPGRGILAMDESNATCGKRLASIGLENTEANRQAYRTLLVTPPGLGNYISGAILFEETSTSRLLMGRRLLTSLSSRVIVPGIKVDKGLVPLVGSNDESWCQGLDGLASREAAYYQQGARFAKWRTVVSIPNGPSELAVKEAAWGLARYAAISQDNGLVPIVEPESHVDGEHGIERTFEVAQKVWAETFFYMAQNNVMFEGILLKPSMVTPGAECKDRATPEEVASYTLKLLHRRIPPSVPGIMFLSGGQSVVEATLNLNAMNQAPNPWHVSFSYARALQNTCFKTWGGRPENVAAAQEALLLRAKANSLAQLGKYTSDGEAAAAKEGMFVKNYSY

SEQ ID NO: 50101 - protein, 188 aa, Triticum aestivum
  misc_feature (24)..(24): Xaa can be any naturally occurring amino acid
  misc_feature (51)..(51): Xaa can be any naturally occurring amino acid
  misc_feature (82)..(82): Xaa can be any naturally occurring amino acid
  misc_feature (125)..(125): Xaa can be any naturally occurring amino acid
  misc_feature (161)..(161): Xaa can be any naturally occurring amino acid
SKIKLRFFTKEESNELAFAMKVAXLADRSIGEAFGATPPADAWGEGVNKIXKRSAGGFPVQKELNYVQGAVSIRKRTLGTMXGAPKVCRKNGESESLLEKSDIPLVGGGTIFAFYKAQGLSAGSXGEEEEKLEPATSLLAKTKAKGVSLLMPSDVIIVDKXAQDVNSQPVPAYAIRDGWMGQNIVPDV

SEQ ID NO: 50102 - protein, 353 aa, Helicobasidium mompa
MGACFSSEGGGQHDISYAIDRQIEEDARKFKKECKILLLGSGESGKSTIVKQMKIIHQNGYTRDELVLFKATVFKNVVDSAQAIVLALRKFRMDPVEPVNRMYADRIMEYRVDLDMGIGLSQDVVRSIESLWHDPIIPSVLDRGSEFYLMDSAPYFFDDVQRIGSPDYIPNETDVLMARTKTTGISETKFRSGQLSIHMFDVGGQRSERKKWIHCFEAVTSIIFCVALSEYDQVLLEESNQNRMAESLVLFESVINSRWFLRTSIILFLNKIDLFKAKLPKVPLERYFAEYTGGDDVNKAAKYILWRFTQLNRARLSIYPHLTQATDTSNIRLVFAAVKETILQNALRDSGIL

SEQ ID NO: 50103 - protein, 389 aa, Enterococcus faecalis
  misc_feature (357)..(357): Xaa can be any naturally occurring amino acid
MAKRIVGSTPKQDGFRMPGEFEPQEKVWMIWPERPDNWRDGGKPVQEAFTNVAKAISQFTPMNVVVSQQQFQNCRRQLPPEITVYEMSNNDAWVRDCGPSFVINDHGEIRGVDWTFNAWGGLVDGLYFPWDQDDLVAQKICEIEHVDSYRTDDFVLEGGSFHVDGQGTVLTTEMCLLSEGRNPQLSKEAIEQKLCDYLNVEKVLWLGDGIDPEETNGHVDDVACFIAPGEVACIYTEDQNSPFYEAAQDAYQRLLKMTDAKGRQLKVHKLCCPVKNVTIKGSFKIDFVEGTMPREDGDICIASYMNFLITNDGVIVPQYGDENDRLALEQVQTMFPDKKIVGVNTVEVVYGGGNIHXITQQEPKRVGGKQNSSSVDKLAAALEHHHHHH

SEQ ID NO: 50104 - protein, 157 aa, Pseudoalteromonas tunicata D2
MITVGQSLPTHVFNVLTADGMSNPTTADLFAGKKVVMFALPGAFTPTCSAAHLPGYVVLADELKAKGVDSIICLSVNDAFVMKAWGQSQNAEQLIMLADGDASFSQALGLAQETGAFGGTRALRYAMIVDDGVVSYLAVEEGKEFEVSKAEHILAQI

SEQ ID NO: 50105 - protein, 726 aa, Arabidopsis thaliana
MELDSENKLLKTGLVIVATLVIAKLIFSFFTSDSKKKRLPPTLKAWPPLVGSLIKFLKGPIIMLREEYPKLGSVFTVNLVHKKITFLIGPEVSAHFFKASESDLSQQEVYQFNVPTFGPGVVFDVDYSVRQEQFRFFTEALRVNKLKGYVDMMVTEAEDYFSKWGESGEVDIKVELERLIILTASRCLLGREVRDQLFDDVSALFHDLDNGMLPISVLFPYLPIPAHRRRDRAREKLSEIFAKIIGSRKRSGKTENDMLQCFIESKYKDGRQTTESEVTGLLIAALFAGQHTSSITSTWTGAYLMRYKEYFSAALDEQKNLIAKHGDKIDHDILSEMDVLYRCIKEALRLHPPLIMLMRASHSDFSVTARDGKTYDIPKGHIVATSPAFANRLPHIFKDPDTYDPERFSPGREEDKAAGAFSYIAFGGGRHGCLGEPFAYLQIKAIWSHLLRNFELELVSPFPEIDWNAMVVGVKGNVMMESITEWDLGSLRTYYSVEPSENFQEDEFLDFNLVPCLQTELWKAQTRIKELEAEKFKSEETIRCLIRNQRNEKEETTNPFVDYLKEKLSKEREEKKRVKAENSRLKKKILDMESSVNRLRRERDTMEKVCEELVTRIDELKVNTRRVWDETEEERQMLQMAEMWREERVRVKFMDAKLALQEKYEEMNLFVVELEKCLETAREVGGIEEKRLRHGEGLIKMAKSMEVVDSKIDFERFEFVSDEGNV

SEQ ID NO: 50106 - protein, 481 aa, Oryza sativa Japonica Group
MAAELPQQKAGGGLARRLVRLLRRKRSTSGSVAGGGEYDESSMDSSINSLSKLKLSAAKLDVLFRSAAQPAASPAVDAAAAHALVASLFAGVSAVKAAYAQLQQAQHPYDSEAIQSADAAMVAELTKLSDHKRRFARDPAAAAKSAAAGPAALAAHADEQRHLLRTYEITAGKLGRELRARDAEAERARAALADDLRAARALEERAHPGRTLAALDGLHLSGLNATHFLTALRHAARSVRSFAKSMLGEMRRAGWDPVAAAAAAHPGVPLRHPGDAKFALESFVALKMFDGFHRRDFGLSALHDRSSYDRRRLFDEFAELKAAPAAEFLDARSSRWGALGEFLRDRYLSVVHERMEAAFFGSTAQRGAAASAGAALPGTPWFAEFAEMARRVWLLHCLFLAFDDGGASTIFQVAAGARFSEVYMESVGDGDGDGDDGGAGTAVAAAAAGDRVVGFTVVPGFKVGRTVMQCRVYLSRPARQP

SEQ ID NO: 50107 - protein, 372 aa, Arabidopsis thaliana
MSSPERKRKKRSLEPSPESTPNPSLPDDLIVSILARVSRLYYPILSLVSKSSRTLVTSPELYKTRSFFNRTESCLYVCLDFPPDPNPRWFTLYRKPNQNITEKTKNSSGFVLAPIPNHHSHSSSIVAIGSNIYAIGGSIENAPSSKVSILDCRSHTWHEAPSMRMKRNYPAANVVDGKIYVAGGLEEFDSSKWMEVFDIKTQTWEFVLSPLAERFIYRSLVIEGEIYIFGDKVVTYKPKEDRWGGVGEHQSMDLGLFFHSYCVIDNVLYCYRPGGIKWYESEKRSWRKLRGLKGLSKLASSCVKLADYGGKMALLWDKYIPCSGNKSHSISCAVVSLERCKNQGIRGKVEWFDDMLTVPSSYNFVGALAATL

SEQ ID NO: 50108 - protein, 1026 aa, Zea mays
MQINASFHPNRAPRPSLVVLVPPRLAWSEDPSGLRLISSPAGPNVHLYAQLQDETSLVWYSHSKVKYLVLSSVSRIIPGQRTAVFRRFLRPEKDYLSFSLIYKNGQRSLDLVCKDQAEVEVWFSTLEALITSCRKSYSADGPSDRLSVSDEVSHYQDTFHDTTLDIASSITRTFNSAKTDVVSDRANMLRASTDSSRLSISSAPSSSSQGSGQDDIESLGDVYVWGEVWTDMIPAEGSANYLCSKADILIPKPLESDVVLDVQQIACGYRHIALTTRQGEVFAWGEELGGRLGHGTDADISRPKLVEALAVSNVEYVACGEFHTCAITASGDLYTWGDGYYNAGLLGHGAGTSHWLPKRVSGPLEGVQVLSVSCGSWHSALTTSSGKVFTFGDGTFGALGHGNRHTVAYPKEVETLSGFRTIKVACGLWHSAAIVETTNQAGVNVISRKLFTWGAGDKNPLGHGDKDARLVPTCVQSLIDYNFHQVACGHSMTIALSTSGHVFTMGSSSNGQLGNPKSDGKHPTPVQDRLAGELVEEISCGSCHVAVLTSRSEVYTWGMGANGRLGHGGVEDKKKPTLVEALKDRHVKSIACGSNFTTCICIHKWVSGADQSVCSGCRQPFGFTRKRHNCYNCGLVHCHACSSKKVLKAALAPTPGKPHRVCDSCFMKLKAAETSSNSSHSKRNAIARRSVDSKDRSERPEIRSSRLATGSTAEPLKQAELKAVRNEIKPDPMSTMRAPQVPSMLPFNNLAFGATFGGPASLKPMTMAPMPMAMPMSPAPLTKKPTPAAATPLCGKSDTDNLKMAKQVLNEDISKLQSQVNKLKQKCDAQEEQLQKAERRAEHSASTAAEESSRRNGVLEFIRFLDNELKSIADRVPSDAADGLKALQNHSERFLTEQGVRPLEATGMHRKCASIGNLVMSQDGSAGNASSSAASLASESPCHRIMENSSRANGDLAPKLGGTHGEVQLIEQFEPGVYVTLIQLRDGTKVFKRVRFSKRRFAEQQAEEWWRENQERVFRKYNHPAN

SEQ ID NO: 50109 - protein, 407 aa, Aspergillus nidulans FGSC A4
MAPTKKHQVSVIGSGNWGSTIGKILAENTSEHTDTFETPVRMWVFEEEITVPSDSPHHSKYGDKPQKLTQIINETHENVKYLPGIKLPDNLIATPDIKEAVKDASILVFNLPHQFIGKTLDQIKGHHLPYARGVSCIKGVDVSDGKVTLFSELIMQKLGIYCGALSGANIAPEVAAERLCETTIGYDPPPMDLTSSDGSPEDNLPHVDGQRQKDLSSTDIKLERVPQDYPHVNDELLEKMFERPYFLVHVIKDVAGVALGGALKNIVALAAGFVAGKQWGENTKAAIIRQGVGEMIRFGRTWFPSSVNEKTFTEESAGIADLVASCYGGRNVRSATHAVEKGVSVAEIEKTEMNGQKLQGVSTAQTVYGFLEKHGKTDEFPLFCAVYNIIEGKAQVDDLPALLNRKK

SEQ ID NO: 50110 - protein, 483 aa, Xyris sp. Chase 154
  misc_feature (3)..(6): Xaa can be any naturally occurring amino acid
  misc_feature (8)..(12): Xaa can be any naturally occurring amino acid
  misc_feature (436)..(436): Xaa can be any naturally occurring amino acid
SSXXXXTXXXXXIGRIAQIIGPVLDVVFPPGKMPNIYNALIVKGRDIAGQQITVTCEVQQLLGNNRVRAVAMSATEGLMRRMEVIDTGAPLSVPVGEATLGRIFNVLGEPVDNLGPVDTSTTSPIHRSAPAFVQLETRLEIFETGIKVVDLLAPYRRGGKIGLFGGAGVGKTVLIMELINNIAKAHGGVSVFAGVGERTREGNDLYIEMKESGVINEKNLTKSKVALVYGQMNEPPGARMRVGLTALTMAEYFRDVNNQNVLLFIDNIFRFVQAGSEVSALLGRMPSAVGYQPTLSTEMGSLQERITSTKQGSITSIQAVYVPADDLTDPAPATTFAHLDATTVLSRGLAAKGIYPAVDPLDSTSTMLQLRIVGKEHYETAQRVKQTLQRYKELQDIIAVLGLDELTEEDRLTVARARKIERFLSQPFFVAEVFTXSPGKYVGLAETIRGFQLILSGELDGLPEQAFYLVGNIDEATAKAMNL

SEQ ID NO: 50111 - protein, 557 aa, Pseudomonas aeruginosa UCBPP-PA14
MYQYDEYDQALVSERVAQFRDQIARRLDGELSEEEFLPLRLQNGLYLQKHAYMLRVAIPYGTLSSPQLRALAHVARHYDRGYGHFTTRQNIQFNWIELEQVGDILEHLAGAQMHAIQTSGNCVRNITTEAFAGVAADEWTDPRPLAEILRQWSTVNPEFLFLPRKFKIALSSAVEDRAAVQMHDIGLYLYRHPDAGELRLRVLVGGGLGRTPMLGQVIRDDLPWQHLLSYVEAILRVYNRYGRRDNKYKARIKILVKALGIEAFAREVEEEWQHLRDGPAQLTAEECQRVAERFVLPRYLPPAGGELAYGSARAVDPAFARWASRNVQAHKVPGYASVVLSTKPGASAPPGDVTAEQMERVADWAERYGFGEIRVAHEQNLVLPDVRLENLHALWREACAAGLGTPNQGLLSDIIACPGGDYCALANAKSIPIAQGIQQRFEDLDHLHDIGELSLNISGCMNACGHHHIGNIGILGVDKNGSEWYQVTLGGAQGKDSALGKVIGPSFSAAEVPAVIERIVETFTDLRVGPERFIDTFNRVGLEPFKARVYARMEEPA

SEQ ID NO: 50112 - protein, 431 aa, Aquifex aeolicus VF5
MSSGDTELRKRIEFIIFGGTGDLSRNKLIPAILKLKDKIDLKKIYILGRNRKKFEEIKEKFKDFSELFVFVEFLAEREESYKNISSILGKESLKVFYLAVPPDLFKEILENVGKYLNFPEKRIVIEKPFGLSLKHAKDLNKIISVYFKEEEIFRIDHYLGKPQVQNILAFKFSNYVFSEVLNKCLVEKVEVIALEEVGVEGRKAYYEKVGVIRDMLQNHMLLLSSLIVMRLPPRAEDFHFELKNALKRAEFESESLILGKYKSYQGKAPTFALVKLHFDDERFTGVPFVLATGKKLKKKLTRVCIHFKNFPKEIERLLGCVPERNLLVFELYPEQEVSFRVNVISPLGFLRCTESINWRVSLKDVLGEIPEAYESLLLDVIRGDKTLFLDAEETEILWEKTEPLLKKEKEVLTYDDRVLIPEFAEDFISCL

SEQ ID NO: 50113 - protein, 384 aa, Desulfitobacterium hafniense DCB-2
MIYLDNAATTWPKPPEVVQAMADFMINMGGNSGRGTHSASIQAANVVFDTRVELAELFGLKNPSRIAFTSNATHAINQALVGLLYPGDHVITSSLEHNAVVRPLKALERYGVSVTEVSGEPGNEFSLEHYRQSFQKNTKCVITLHASNVTGTLLPIEEIGKIAGEHGVKYIVDAAQTAGVFDIDLETLPIDILTFPGHKGLLGPQGTGGLALREGVNLKPLIYGGTGSLSESENQPDFLPDALESGTLNGVGIAGLGASVQYLRSLGLHVIRKRELELCQQLIDGLSEIPEVKIYGENNALNRAPIVSFNIGSLDSMFVADRLDQVYGIRSRAGMHCAPHAHRMFKTISQGVIRFSPSHFTQSEEIAEAIQAVRNLAKEFERTV

SEQ ID NO: 50114 - protein, 592 aa, unidentified eubacterium SCB49
MNTLLLHTINAPEDLKKLSQEDLPQLTQELRDFIIQAVATKEGHLGASLGVAELTVALHYVFNTPTDKLIWDVGHQAYGHKILTGRREVFDTNRRLNGISGFPKMTESPYDAFGTGHSSTSISAILGMAMAAKLKGLKRQHIAVIGDASIASGMAFEALNHAGVTNTNLLIVLNDNAIGIDPSVGALKQYFTKVTLDGAPETDNIFEALNFNYSGPIDGHNIETLISEMRRLQKLEGPKVLHIITKKGKGLKQAEEHQVTYHAPGKFDAITGELTPKNETGLAPKFQDVFGHTIVELAEQNSNIIGITPAMPTGSSLKYMMARFPDRAFDVGIAEQHAVTLAAGMAAEGMHVFCNIYATFLQRAYDQVIHDVCLQNLPVIFCIDRAGIVGEDGATHHGIFDISFLRCLPNLIIYSPSDVIQLRNILYTAQLGLKHPIAIRYPRGRGLITKWKEPFKKIEIGKGFTIKTGTKIAIITTGTIKNNAESAINLLSSKDQAQVGLYDLGFTSPLDKDLLNNIFQHYNTIITIEDGVIQGGFGTAILEFSSSKQFKNNILCWGIDHYFPEHGTITQLHDQAGISVTALCNRLQKLLA

SEQ ID NO: 50115 - protein, 473 aa, Burkholderia thailandensis E264
MDLEEGIRRLYPYAEEFGVTRGFPEHGMPRDALLAQLRSMAEREDRNWESGRCSGAMYSGDRDHHAWLNEAYSIFSHVNALRRDMCPSMNRMESEIVGMTVAMLHGEAVAAHHPGQRACGMITLGGTESILGATLAYREKARAERGIDRPRMIWPASAHPVFRKAAHLFGFDVTVAPVDPDTMQVDADFVRDAIDADTVMLVGSACNYPYGTVDPIEALSEIAVEKEVWLHVDGCLGGWMLPWGEELGYPNIPAFDFRLPGVTSISADTHKFGYGPKGGSVLAWRDASFRRYQYFLMTDWVGGVYGSPGLAGSRSGGLIAATWAALRGLGREGYRARARAIFDTAFDMQAAVRAIPELRVLGKPTFCFAFASDAFDIYHVNDFMRQRGWRLNGLRHPDALQMCVTEPQTRPGVADQFRRDLGAAVEHARRHARERPKTSGIYASDATGVDLSDDARARAFFTQVIDLFTDCPL

SEQ ID NO: 50116 - protein, 862 aa, Oryza sativa Indica Group
MSLHEPIRRCCCSCFFFFFTSLFLPSTSSIYVAMAAASDMPNCRNECGGVLIPYPFGVGENCSRPGFDVFPITCNNSFVPPRPYWSNLEIIDINIATAEMRVYLPVSHKCFSSTNQTADPNWGWSLNSSSSQFLVSPTKNIFTALGCYTIAMLSGRDNGTYSTGCISYCASESEVKVGDGKGCTGLGCCQTSIAGGLSYIAFYFNVPNNPSWNYSPCSYAMVADKSWDIKISKEDVIGNMTFARRIERGAPLVLDWAIRNNGTCPPALISGENGKQRQQAAAACVSPHSYCLNATNGPGYFCNCSDGYAGNPYVSNGCKNVNECDPSFYKENYPCIGGKCLDTEGGFKCKCNFGRKRDSKNSHICQPVLSKPAIVVTATTCAISILSIIFLFLHMEREKRKLREFFKKNDGQLLQSMGIKIFKKKTIEKITNNYSTIIGKGGFGLVYKGAVDNDQKVAVKCPNPISVDTARQNDFANEVSIQSQISHKNVVRLLGCCLETNIPILVYEFIPRGSLYDVLHGNGDDSNMTEHKLSLDVRLGIAIESAEALAYMHSSASQKILHGDVKSSNILLDENFTPKVSDFGISRLLSIEKDHTKFVIGDANYMDPVYMKTGLLTEKSDVYSFGVVLLELITGKKARYEGNESLPLNFVKSYMTESRAREMFDKELMCTEEVNCLEMIGDIAVQCLEEDVDKRPAMKEVSEHLHLARKEFMQNQGAATISDEAKKRKRGADGKLLCDFALHQRSPISPLSTLEAGLDAARHQPTIRRSPEDRGVQPFSQDEEETITIDCFYKPVVARAVSVEIENPSPTNVEVADQENLQAEQEVIVTTAFERDPGKRVQISAAMLHCLFDVGDLELVAT

SEQ ID NO: 50117 - protein, 516 aa, Glycine max
MAIAAPGHLNVNESPIWGSRSVDCFEKLEQIGEGTYGQVYMAKEIKTGEIVALKKIRMDNEREGFPITAIREIKILKKLHHENVIKLKEIVTDTGPEKDEQGKPDGNKYKGGIYMVFEYMDHDLTGLADRPGMRFTVPQIKCYMRQLLTGLHYCHVNQVLHRDIKGSNLLIDNEGNLKLADFGLARSFSNDQNANLTNRVITLWYRPPELLLGTTKYGPAVDMWSVGCIFAELLQGKPIFPGKDEPEQLNKIYELCGAPNEVNWPGVSKIPYYNKFMPTRPMKRRLREVFRHFDHHALELLEKMLTLDPAQRITAKDALDAEYFWTDPLPCDPKSLPKYESSHEFQTKKKRQQQRQNEEMAKRQKIQHPQPHTRLPPIQQPGQHGQMRSGPNQPVHGSQPQVAAGPTHHYGKPRGPSGGPGRYPPNGNPGGGYNHPNRGGQGGGGYGSGPYPPQGRGAPYGSNSMPGGGPRGGGASGYVGAPNYPQQGGPYGGSAAGRGSNMMGGNRNQQQYGWQQ

SEQ ID NO: 50118 - protein, 281 aa, Streptomyces nogalater
MIEETETIEEFLARRSADVEEAVRKAAEAEILPRFRRLAAHEVDQKSGPHDLVTDADRLAELRLTEDLGALLPGSVVVGEEAVHANPVVYEALQGDTPVWIVDPVDGTRQFVHGDDGFCTLVALAHRGTVVASWTYAAARDRFATAVRGRGAFLDGERLFAGPPEPGRDLVVATSHPDYTTDEQKRALRALWTDGLAPRPCGSAGLEYLAVARGELDAVAFSWEAAWDHAAGLLLVEEAGGTHLTLTGEPFRVTGGNALPFTAARDAATARRVAGLLRTAS

SEQ ID NO: 50119 - protein, 340 aa, Oryza sativa Japonica Group
MDPLESEGGSQKSNNKPKYSKFTQQELPACKPLLTPGIVVATFLLIGIIFVPIGLASLSASQEIVELVDRYDTNCVSTLDKVGFIQNTDTDKTCTRTLTVPKHMKSPIQIYYQIGDFYQNHRRYVKSRSDKQLRYKNAVHLTKDCDPEGNTVDGAPIIPCGLIAWSLFNDTYTISVNKKAIEVNKKDIAWKSDKTDKFGSDIYPSNFQKGSLIGGAKLNESIPLSEQEDLIVWMRTAALPTFRKLYGRIETDIMANDQLTVVIQNNYNTYSFGGSKALVLSTTSWIGGKNNFIGVAYLTIGGLCIFLAVGFVVLLYMVKPRTLGDPSYLSWNRDTPDRPN

SEQ ID NO: 50120 - protein, 621 aa, Streptomyces nogalater
MRFTTRPTLQGTFGMVSSTHWLASQSAMAVLEDGGNAFDAAVAGAFVLHVVEPHLNGPAGEVPILLAPAGGAVRVLCGQGVAPAGATPAHYRRLGLDLVPGTGPLAAAVPGAFDAWLLLLRDHGTKPLDAVLKYAIGYAEHGHAPVENVGATVASVRRLFETEWPSSAEVYLPGGRPPRPGTLLRNPALAATWKRLLAETAGAGDREARIDAAREVWRSGFIAEALVRQSRRPTMDTSGERHTGTLTEADLAGWSAHYETPVTYDWNGWTVCKAGPWSQGPVLLQQLALLPAELPAPGSADYVHLLVEGCKLAMADREAWYGDAAEVPLADLLSDAYNAGRRALIGAKASYDLLPGSPGGRPPRLPALAHARVPADTRPGFDPMGAGEPTVAPLPGAPTLAEATGQAQVTGEADVAADGSTRGDTCHLDVVDRWGNMIAATPSGGWLQSNPVVPELGFPLGTRLQMTWLEEGLPGTLTPGRRPRTTLTPSLALRDGVPVLAFGTPGGDQQDQWQLHFFLAAALGAPVRGGLDLQGAIDAPNWHNDSFPGSFHPRRRRPGSVTVESRMDPGVIEELRRRGHDVTVGPAWSEGRLCAVARDPETGILSAAANPRGMQGYAVGR

SEQ ID NO: 50121 - protein, 138 aa, Brassica napus
MTMVVPKEGFVVMAKESISSSPSESPLRLQPQFPDLTIPVKEFFKSREAREFLSGALAGAMTKAVLAPLETIRTRMIAGVGSKTIPGSFLEIVQKQGWVGLWAGNEINMIRIVPTQAIELSTFECVKRVMTSAQEKLK

SEQ ID NO: 50122 - protein, 467 aa, Burkholderia mallei ATCC 23344
MSLFRKKNVDRMIAGAQAAGLKKALGAVDLTFLGIGAIIGTGIFVLSGTGAVQAGPALMLSFVIAAIACGLAALSYAEFASTIPVAGSIYTYSYATLGELVAWIIGWDLMLEYGLAASAVSVGWSGYLQSLLQGFGVSLPTALTAAPGALPGVVTYFNLPAFVVMLVITTLLSIGIRESTRVNNIMVFIKVAVVLLVIAVGVFHVTPVNWKPFMPHGWNGVFGAAAVMFFAFIGFDAVSSAAEEVKNPKRDLPVGIIASLGVCAFLYVAVAAIATGIVPWAQYANVSHPISYALQVAGEKWVAGFIDLGAVIGMLTVILVMSYGQTRIIFAMSRDGLLPAALSRVHPRFATPFLTTWLVGLFFGLIAALIPLNVLAELINIGTLAAFSMVSIAVLVLRRTHPDLPRAFRCPGVPLVPILAVAACLFLMLNLQPVTWIAFLTWLVIGLFVYFAYSRSRSKLAHGAQQH

SEQ ID NO: 50123 - protein, 162 aa, Brassica napus
LLGLDSKLEKSLLIPFREIKVECTIPKDDGTLASFVGFRVQHDNARGPMKGGIRYHPEVEPDEVNALAQLMTWKTAVANIPYGGAKGGIGCDPSKLSISELERLTRVFTQKIHDLIGIHTDVPAPDMGTGPQTMAWILDEYSKFHGYSPAVVTGKPIDLGGS

SEQ ID NO: 50124 - protein, 406 aa, Campylobacter jejuni RM1221
MLNNTLFFKQSEIHTISSYANRINDEVKSGDIGYYHLIDTSLNLIDESLAFIKDKEHIKNIVLVGMGGSSCGVKALRDMLFNEKSNQRELFILDNTSSHSFNKTLEKIKLEESLFLIISKTGSTIEVVSLFKLLIEHFKLDMQELKKYFVFITDKDSKLHQEGENLGIKCFFIPANVGGRFSILSAVGIVPLCFCGYNAKALLEGAKACFEDFFTHKKDEILQKAYHYCTHKNANINVLFSYSDAFKGFNEWYIQLIAESLGKKQGYKRIGLTPIALIGARDQHSFLQLIMDGPKNKTVTFLKIKDAQKAPIIPDIHFKFLDSLSNKVNLHELLNAQCNATMHALIAENLSVDVIELEKLDAWHAGYLMYYYELFTSTCGVMLGINTYDQPGVEVGKLILKNILNS

SEQ ID NO: 50125 - protein, 574 aa, Corynebacterium glutamicum ATCC 13032
MWVGGFPIRLTFMTSAHFESRRIGPPLRDNYDVIVIGGGISGVQIARHAQGRGLRTVMFEARDYSSGTSSTTSKMIHGGLRYLEQYDFGVVQEAVKERRYLGIAAPHLVAPRSFMLTAFDWSEPKAPMLGAGVALYETMAWQRNQGQSKENHSPRFRWIPKNALLKEVPWLDPEGLKGAWRHDDTLNLHAERLLLAVIKAFAADGGTAINHAKVTRILRNVEEGRVKGVEVTDQVTNTTHEVNAPVVINAAGPWVAQALGDLAEVTKLKVRQSKGVHLLTGDLGSQSGVFVRGKNGKHVIVNPWMGRTLIGPTDTMIDGDADDAAADESDIDLLLETIDSVRATPLDRKEIISTLVGVRPLVDDGTDTYTSSRRFDISDHANVGIDGLVSVSGGKWTTSRVMGYKVIEHVVEHQAAVLPPLRHFDSRQMPLSTSFGAYESVADSFESALRSHPELDVDDEIRVHLARLYGTEHEKVLDLVAKQPDLGRRLDPDNLDIAAQAVFAVAEEAAVDLADVLDRRIVLGTLGYVQPAAVRATAEAMAQVTGWSAELIDAQCQSYLAKQDKIQAVLKPYR

SEQ ID NO: 50126 - protein, 328 aa, Aspergillus oryzae
MSTTSSTFKSSSGANCHPTALEIIQNNGLEGKLQDKVILITGCSSGIGIDTARALSVTGATLYLTARDLKKAEQALGDLIEKPNVHLLTLNLNSLASVRACAEEFLPKSSQLNVLINNAGVMATPEGRTQDGFETQFGTNHLGHFTLFYLLKPILLASSTPEFNSRVVNVSSLAHRYGEPVFDNINLEGIYEPWRAYGQSKTANIWTANEIERRYGSQGLHAFSVHPGGIRTGLQQYVPKEQKDAWDQDDAISSVWKTSEHGAATTVWAAVAKELEGKGGKYLEDCQIAEKYDPSTGTAGKGYAPWVYDEAKQAKLWEMSLNLAGLHV

SEQ ID NO: 50127 - protein, 274 aa, Campylobacter jejuni RM1221
MLQTCIFPAAGYGTRFLPATKTLPKEMLPILTKPLIHYGVDEALEAGMENMGFVTGRGKRALEDYFDISYELEHQISGTKKEYLLDEIRSLINRCTFTFTRQNQMKGLGDAVLKGRPLVGDEAFGVILADDLCVNEEGLNVMAQMVKIYEKYRCTIIAVMEVPKEQVSNYGVISGNFVEENLIMVNSMIEKPSPDEAPSNLAIIGRYILTPDIFGILENTKAGKNGEVQLTDALLTQATNGMVLAYKFQGKRFDCGSVEGFVEATNYFYEKSKC

SEQ ID NO: 50128 - protein, 78 aa, Yersinia pestis CO92
MSTIEERVKKIIVEQLGVKEDEVKNSASFVEDLGADSLDTVELVMALEEEFDTEIPDEEAEKITTVQAAIDFINANQQ

SEQ ID NO: 50129 - protein, 324 aa, unidentified eubacterium SCB49
MHDLSSYNEALSKGLEQAIPVNEPIGLYGPAAYILELGGKRLRPVLTLMTAEFFGSTIEKAMNAALAVELFHNFSLIHDDIMDDAPLRRGKVTVHEKWDLNTGILSGDAMLILAYQLFEGYEAEKFQQLAKLFSKTALEVCEGQQYDVDFETRDDVTIPEYIKMIDFKTAVLIGAAMKMGAIVAEASDACKDNIYEFGRNLGIAFQLQDDYLDAFGDPETFGKQIGGDIIVNKKTFLYLTALERCSPSEREQLTTLFSQSPEDPSEKIKIVKDLFISTGAAEASMIKMEKYTAKANDFLEKIDFSEDKKEAFKSFGDWLLKRKV

SEQ ID NO: 50130 - protein, 406 aa, unidentified eubacterium SCB49
MLEMKVPSPGESITEVEIAEWLVEDGDYVEKDQAIAEVDSDKATLELPAEASGIITLKAEEGDAVAVGAVVCLIDTDAKAPEGGEAPEAVEKKATKKEEAPAKQEKTEAPAAKTYASGTPSPAAKKILDEKNIAASAVAGTGRDGRITKNDAENATPSMGTPGIGDRGSYRTKLSMLRRKVAERLVEAKNTTAMLTTFNEVDMGPIFELRKQYKDTFREKHGVGLGFMSFFTLAVVRALEMYPAVNSMIDGKEMLTFDYKDVSIAVSGPKGLMVPVIRNAENLSFRGVESEVKRLALRARDGKITVDEMTGGTFTISNGGVFGSMLSTPIINPPQSGILGMHNIVERPIVKDGAIVIAPIMFVALSYDHRIIDGKESVGFLVAVKEALESPEELLMGGDVKKALEL

SEQ ID NO: 50131 - protein, 835 aa, Rhodospirillum rubrum ATCC 11170
MGSVDTVGALPRDLVRLAVSPRDKADAIAQAAQMLVAAGCVEAGYAQSMIRREGVANTFLGHGVAIPHGMAEDRALVRANGIAVLQVPDGVEWNPGQSARLVVAIAAQSDTHIAILRRLTRLLQDEDRLGGLFVTSDPGDVITALTTDPEVNAPAVPVSDLAKRFEWVLDYPNGLHARPAARWVDTAKGYAARCQIRHGDEVADVKNLVALLRLGLTQGERISVSAEGPDADQALSRLKATMLDLSVQERADAALAARRAKQPVIGWHPPGAPMALAGIAAAPGLAIGRLHVLAAADRSVPDHPVPLSEGGNILHEALSATRLQLKALADDTARRLGPSEAGIFKAQGELLNDTDLITLTCQLMVEGHGVAWSWDQAIERMAGKLAALGNALLVARAADLRDVGRRVLGQLDPGLGGASLHDLPDEPCILIAGDLAPSETAGLDPSRVVGLATAQGGPTAHTAILARTMGLPAMVAAGPGLLALESGTLAILDGYGGRLYPDPSPEALSSARAFIAEQGLRRAREEERRSLPASTRDGHRVEIAANVNFADQAAFALSQGAEGVGLMRTEFLFLERGDTPDEEAQLAAYTAMQDALNGRPLIVRALDIGGDKQVAHLDLPREDNPFLGVRGARLLLRRPDLLDPQLRALYRAAKSGKPLSIMFPMITSVPEIIALRGICERIRAEVEGPEVALGIMVEVPAAALAADVLARHADFFSIGTNDLTQYTLAIDRQNPELAAEADSLHPAVLRLIRMTVDGAAAHGRWVGICGGIAGDPFGAALLTGLGVQELSMTPRDIPAVKERLRDCDATALRALAERALTCETATDVRALEADL

SEQ ID NO: 50132 - protein, 418 aa, Klebsiella pneumoniae subsp. pneumoniae MGH 78578
MTLLALGINHKTAPVALRERVTFSPETLDKALESLLAQPMVQGGVVLSTCNRTELYLSVEEQDNLQEALIRWLCNYHGLNEEDLRKSLYWHQDNDAVSHLMRVASGLDSLVLGEPQILGQVKKAFADSSRGHLNVSELERMFQKSFSVAKRVRTETDIGASAVSVAFAACTLARQIFESLSSVTVLLVGAGETIELVARHLREHHVRKMVIANRTRERAQALAEEVGAEVIALSDIDERLKEADIIISSTASPLPIIGKGMVERALKARRNQPMLLVDIAVPRDVEPEVGKLANAYLYSVDDLQNIIQHNLAQRKAAAVQAESIVEQETSEFMAWLRAQSASETIREYRSQSEQVREELTAKALAALEQGGDAQEIMQDLARKLTNRLIHAPTKSLQQAARDGDDERLHILRNSLGLE

SEQ ID NO: 50133 - protein, 380 aa, Lotus corniculatus
MSSTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 50134 - protein, 248 aa, Bradyrhizobium sp. BTAi1
MREAGELAHAMFGTELRKWTKGASSPVSEADMAVNELLERRLRSATPDYGWLSEESADDSDRLDRSRVWIVDPIDGTRSFLASRQDWCVSVALVEDQSPILAAVYAPVTSEFFFAGLGQGTTLNDQPVQAAQGTALDFARVAGPKPLVEKLAPQFARIELHPRIGSLALRLCRVAHGALDAAFAGGQSRDWDLAAAHLIVQEAGGKMTALSGETILYNRPEVVHGVLVAAGRDRHADIVAQYRRLPPG

SEQ ID NO: 50135 - protein, 513 aa, Arabidopsis thaliana
MDAIVVDSQNCFIIILLCSFSLISYFVFFKKPKVNFDLLPSPPSLPIIGHLHLLLSTLIHKSLQKLSSKYGPLLHLRIFNIPFILVSSDSLAYEIFRDHDVNVSSRGVGAIDESLAFGSSGFIQAPYGDYWKFMKKLIATKLLGPQPLVRSQDFRSEELERFYKRLFDKAMKKESVMIHKEASRFVNNSLYKMCTGRSFSVENNEVERIMELTADLGALSQKFFVSKMFRKLLEKLGISLFKTEIMVVSRRFSELVERILIEYEEKMDGHQGTQFMDALLAAYRDENTEYKITRSHIKSLLTEFFIGAADASSIAIQWAMADIINNREILEKLREEIDSVVGKTRLVQETDLPNLPYLQAVVKEGLRLHPPTPLVVREFQEGCEIGGFFVPKNTTLIVNSYAMMRDPDSWQDPDEFKPERFLASLSREEDKKEKILNFLPFGSGRRMCPGSNLGYIFVGTAIGMMVQCFDWEINGDKINMEEATGGFLITMAHPLTCTPIPLPRTQNSLISHL

SEQ ID NO: 50136 - protein, 361 aa, Burkholderia vietnamiensis G4
MSDSTYRIAVIPGDGIGREVMPEGLRALAAVTARFGIRFEFEQIDWASCDYYAQHGKMMPDDWKAQLSDVDAILFGAVGWPATVPDHISLWGSLLKFRREFDQYINLRPARLFDGVPSPLAGRKAGDIDFMIVRENTEGEYSSVGGTMFEGTEREVVMQQSIFTRHGTERVLKFAFELAQRRAKRLTVATKSNGIAISMPWWDARAAEMAERYPDIAVDKQHIDILCARFVLQPDRFDVVVASNLFGDILSDLGPACTGTIGIAPSANLNPDRTFPSLFEPVHGSAPDIAGQYIANPIAMIWSAAMMLDFLGNGAGREREAHDAIVAAIEDVLRNGPRTRDLGGQAATQEVGEAIAARIAG

SEQ ID NO: 50137 - protein, 312 aa, Klebsiella pneumoniae subsp. pneumoniae MGH 78578
MKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVMVDDMIDTGGTLCKAAEALKERGAKRVFAYATHPIFSGNAIQNIKNSVIDEFVVCDTIPLAPEIKALDKVRTLTLSGMLAEAIRRISNEESISAMFEH

SEQ ID NO: 50138 - protein, 98 aa, Triticum aestivum
MDSFSSPSMSSSGSPPNPEALMEQIKAQLAQAYAQELLELAQLEFGVAAKTVGNKCFAKCVTKPGSSMSGSESSCVSRCVDRYIEATGIVGRALFSHR

SEQ ID NO: 50139 - protein, 550 aa, Klebsiella pneumoniae subsp. pneumoniae MGH 78578
MPFRALIDACWKEKYTTARFTRDLIAGITVGIIAIPLAMALAIGSGVPPQYGLYTSAVAGIVIALTGGSRFSVSGPTAAFVVILYPVSQQFGLAGLLVATLMSGIFLILFGLARFGRLIEYIPLSVTLGFTSGIGITIGTMQIKDFLGLQMPHVPEHYLQKVAALAMALPTINVGDAAIGVVTLGILILWPRLGIRLPGHLPALLGGCAVMLVVNLLGGDVATIGSQFHYQLADGTQGNGIPQLLPQLVLPWDMPGSNFTLSWASLQALLPAAFSMAMLGAIESLLCAVVLDGMTGTKHKANSELIGQGLGNIVAPFFGGITATAAIARSAANVRAGATSPVAAVIHALLVILALLILAPLLSWLPLSAMAALLLMVAWNMSEAHKVINLLRHAPKDDIVVMLMCMSLTVLFDMVIAISVGIVLASLLFMRRIARMTHLAPVNVEVPDDVLVLRVIGPLFFAAAEGLFNDLETRIAGKRIVVLKWDAVPVLDAGGLDAFQRFVNKLPEGCELRVSNLEFQPLRTLARAGVKPLPGRLSFYPDRQAALADL

SEQ ID NO: 50140 - protein, 65 aa, Pyrococcus horikoshii
MIIPVRCFTCGKVIGDKYYEFKRRVEAGEDPEKVLDDLGLERYCCRRMLLSHVELIDDIMHYKVY

SEQ ID NO: 50141 - protein, 166 aa, Ralstonia solanacearum GMI1000
MIQPGQPLPDATLYEYFEVEKDGCALGPNAFSAADLAQGKTILIFGLPGAFTPTCSARHVPGYLAHYDALRTKGVDEIWCVSVNDAFVMGAWARAQGTDGRVRMLADGSAEFTRRLGLEQDLSKRGMGVRSQRYAMIVKNGVVTVLQVEAPGQFAVSNAESMLARL

SEQ ID NO: 50142 - protein, 439 aa, Oryza sativa Japonica Group
MDGDSSYSPALAAVAGAVALVAFCSYYLAVTRATGDGEARRRRRRHPPVVGTVFHQLYHVRRLHDYYTALCREHTTFRLLATPGRRNIYTCDPAVVEHILRTNFPSYGKGPLNSEILNDLFGEGIFAVDGEKWKTQRKIASYDFTTRALRDFSSDVFKRNAAKLAGVVSNHAASNQSMDFKGLLTRATMDSIFTIAFGQDLNTLDGSGEGRHFAKAFDDAGEYLLLRYLNPFWKLARLLNVGAEATLKERIKVVDEFVYKLIRARSDELSNTMAQDHRSRDDLLSRFIQATTSDSGTVDYKYLRDIVLNIVIAAKDSTSGSLAWFLYMACKRPEVQEKIFDEVMETTNAGDCASIDEFLTSLTDQALNKMHYLHAALTETLRLYPSVPLENKQCFSDDVLPNGFSVSKGDGVFYMPYAMGRMEFLWAANLIVSDCKYSV

SEQ ID NO: 50143 - protein, 296 aa, Klebsiella pneumoniae
MANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWAELERTEPGAWGRIQLTDAIAELAKKQSVDAMLMTGESYDCGKKMGYMQAFVTYGMRNLKEGAKFRESIKKMLA

SEQ ID NO: 50144 - protein, 185 aa, Corynebacterium glutamicum ATCC 13032
MSEQALSTFDRAREALDKKTRYVQDFPEKGVLFEDLTPVLGDAESFVAVVDAMAEAAEKLNAEIIGGLDARGFLLGSAVAYKLGLGVLAIRKKGKLPPPVVTQEYELEYGTAALELPSEGIDIAGKNIVLIDDVLATGGTLGAARKLIESCDGHVSGYVLAIEVPGLGGRDNLGDRPVIVVRDPQ

SEQ ID NO: 50145 - protein, 122 aa, Zea mays
GHNVAGGRIFFGDGGGKVAVLLDDMIAPPGPFSKGGELLPQEGAREVYACCPQGVFSPPPIERLSRGLFQEVIFPTPILLKGGKSFPQRIFFWVVTLWGETFWGVPEDCWVGLDPYSSWDID

SEQ ID NO: 50146 - protein, 532 aa, Aspergillus oryzae
MLTLSFSALLGIALAWAIHRLAWKYSRLKAICVKRDNKLATQYGCEQPPRLRNWWPLGIDRLIQIWTADSEQRLMDLFTFPFKDVGYTLEQKFLGTIAFGTIDPENLEAIMTNINVFSFGLRRHILFPLLGDGIFTQEGKSWRHSRELLRPQFTRQHYRDLNIFRPHVDRLLHYLTGNGAATDLQPLFFRLTLDTTTEYLFGKSVNSLMPGEATKGQSFANHFDMAQNYVVQRFRLLDLYWLIGGPKFWRSCSAVHRFIDEIIDTRMDSKEKDKDCNSKSIFFDAVARDSRTRRDLRDQLTNVLLAGRDTTACLLSWTFHCLARHPDVLGRLNVEIASVVGTNTDLTRDDFKRMPYLDQVLREVLRLYPPVPVNTRTAHKTTILPTGGGKDGTKPFMVREGENVAFCVYAMHRREDLYGPDAGQFRPERWDEDLPLFQNERTATWGYLPFNGGPRACLGQDFGFVEAAYTVVRILQKYPIVKPDMYKGDIQGRKWLGWSSHQPEGIEMVTEERQKMTIVLSLGDGCRVTLGR

SEQ ID NO: 50147 - protein, 219 aa, Lactococcus lactis
GGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMFLAKEIEKTGMFEIMNDGSQLPIVCYKLKEDSNRGWNLYDLADRLLMKGWQVPAYPLPKNLENEIIQRLVIRADFGMNMAFNYVQDMQEAIEALNKAHILYHEEPENKTYGFTH

SEQ ID NO: 50148 - protein, 87 aa, Chlamydophila caviae GPIC
MSQKNKNSAFMNPVNITPDLAAIVGEGPMPRTEIVKKVWEHIKKNNLQDPKNKRNILPDDALAKVFGSKNPIDMFQMTKALSAHIVK

SEQ ID NO: 50149 - protein, 163 aa, Lactococcus lactis
GGLYAPFVEPELEWDFRLKNVISINTSGHKYGLVYPGVGWVLWRDKKYLPEELIFKVSYLGGELPTMAINFSHSASQLIGQYYNFVRYGFDGYKAIHERTHKVAMYLAEEIEKTGMFEIMNDGSQLPIVCYKLKENSNLGWNLYDLADRLFNEGMASACLSTS

SEQ ID NO: 50150 - protein, 265 aa, Triticum aestivum
TSLYKKAGWYRSGIPGISSTHASDKMQRAIQAIGSHGSVLKSAVLQHISVVKPAMLPAVFPRFMSVSPAQIEESGFESSTVADILKSKGKSADGSWLWCTTDDSVYDAVKSMTQHNVGALVVVKPGEDKSIAGIVTERDYLRKIIVQGRSSKSTKVGDIMTEENKLITVKPETRVLKAMQLMTDKRIRHIPVISGTEMMGMVSIGDVVRAVVSEHKEELNRLNAYIQGGYDPAVLQGVPLSELYNNDQGDDDIGRVSSRTMGVEL

SEQ ID NO: 50151 - protein, 380 aa, Aquifex aeolicus VF5
MKVFLKKGKEKKVKHFYPWVFRDEVEKIEGEGIVAELYDSEGNFLALGTYSPYSRIAFRVLSYEREEVNEEFFKRRLRESELLRRDIPSNAYRLAFSESDLLSGLIIDRYGDAFVIQVRSYPMEILKEKVLKTLVEEFNPAFVYERSDFKGRREEGLKEFKGLLYGKLENPLIIEEREFKFLVDVVEGLKTGFYLDQRDNREYVRNLVKEGDRVLDLFCYSGGFSVYCANRGAKVVGVDINKRAVELARENAKLNSVKADFVLGNAFDFIQESKEEWDLIIADPPAIAKTKKEKESILWAIWKLAYYSFQKLKKGGSLFICSCTYQISSEEMIRQVRLASTDVKRRIIIKSLNLQPIDHPYLPTFPESLYLKCLHAIVID

SEQ ID NO: 50152 - protein, 363 aa, Klebsiella pneumoniae subsp. pneumoniae MGH 78578
MGFKCGIVGLPNVGKSTLFNALTKAGIEAANFPFCTIEPNTGVVPMPDPRLDKLAEIVKPQRILPTTMEFVDIAGLVKGASKGEGLGNQFLTNIRETEAIGHVVRCFENDNIIHVAGKVNPAEDIDVINTELALSDLDTCERAIHRVSKKAKGGDKDAKVELAALEKCLPQLENAGMLRALDLTKEEKEAIRYLSFLTLKPTMYIANVNEDGFENNPYLDQVRAIAEQEGSVVVPVCAAVEADIAELDDEERDEFMAELGLEEPGLNRVIRAGYALLNLQTYFTAGVKEVRAWTIPVGATAPQAAGKIHTDFEKGFIRAQTIAYEDFIAYKGEQGAKEAGKMRAEGKDYIVKDGDVMNFLFNV

SEQ ID NO: 50153 - protein, 329 aa, Streptomyces olivaceus
MTWLITGGAGYIGSHVVKSMTEAGERVVVLDDLSTGDPARVPAGVPLERGTVLDRAFLDRVLAEHRVRGIVHLAAKKAVGESVERPLHYYRENVTGLQVLLEAAAAAGVDSFLFSSSASVYGMPDTDLVTEDTPCAPLSPYGETKVAGEWMVRSVGRAHSMATACLRYFNVAGTAAPELADTGVFNLVPMVFQRLDAGQPPLVFGDDYATPDGTCVRDYIHVADLADAHLAAARRLAELAAAGDHRDLTLNIGRGEGVSVREMMDLIREVTGRPVEPEVTARRPGDPAQVVASADRISAELGWKARHDVRSMIASAWAAHTGAAVQPAE

SEQ ID NO: 50154 - protein, 558 aa, Oryza sativa Indica Group
MPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRRLSHEWQAYISRTHSLRKTFISVKGIYYQAEVQGQKITWLTPHALQQVLTDDVDFNVMLTFLEFYETLLGFINFKLYHSINVNYPPVLDPRLEALASELYALCRYMSSGRVPGNSEPAGLIEDKEDEDNKESSKTDESELRLAQLQHQLPTNEPGALMHLVQESTAADADDADAKECRSLFKNLKFYLSREVPRESLLFIIPAFGGTVSWEGEGAPFDETDEDITHQIVDRPTQSHVFLSREYVQPQWIYDCVNARIILPTEGYIVGRVPPPHLSPFVDNDAEGYIPEYAETIKRLQAAAQSQVLPLPSLGDEDMENSLVEAIIDRSESNEIADKKRKDSHKQAEKDAADISKTLMSRKQRGLLQAIEINQERKKDKVNLLKKRKKNADSSASAKGR

SEQ ID NO: 50155 - protein, 288 aa, Ashbya gossypii ATCC 10895
MAAFSDSDYNSTGYSDYRPRYPGTWYSRIKEYHSGARGLVVDVGCGPGTATFQLRENLPFKRVVGVDVSTAMVERARQTAREKVVTDAGRVEFVVSTADNFSFLNGAKADMITAAQCVHWLDWERFQLAAADNLRAGGTLAIWDYTDPSIVGYPELDPLMKEFIYGESHLGPHWEQPGTRMLKQLLRNLHFDEKLFDDIYVCRESTDDALRGTAGRTPLHVEKTMTLEQMNSYLSTWSAFHSWRKQDPAGSIAAKSAFFQFIFSKTSMSWSSEVCLTWNSVGILARRR

SEQ ID NO: 50156 - protein, 609 aa, Zea mays
MDTSGIVGSVDGHRPAASGAVACPASGVSGFITSTGGGGEPPPRDATLGRHLARRLVQVGVSDVFAVPGDFNLTLLDHLIAEPGLRVVGCCNELNAGYAADGYARARGVGACVVTFTVGGLSVLNAIAGAYSENLPVVCVVGGPNSNDYGTNRVLHHTIGLPDFSQELRCFQPVTCHQAVVNNLEDAHEQIDGAISTALRESKPVYMSVSCNLPGLPHPTFATDPVPYLLAPRPSNLTGLAAAVEATVSFLDKAVKPVVVAGPKIRVAKAAAAFVELAEASGYAVAAMPSAKGLVPETLPRFLGTYWGAVSTAFCAEIVESADAYLLAGPIFNDYSSVGYSILLRKDKAVVVQPDRVTVGNGPTFGCAMMRDFLSVLAKRVRPNTTAYDNYRRIFVPGGQPPECEAGEPLRVNVLFKHIQRMLSGGSSVIAETGDSWFNYQKLRLPDGCGYEFQMQYGSMGWSVGALLGYAQGAPDKRVIACIGDGSFQVTAQDVSTMLRCEQRSIIFLINNGGYTIEVEIHDGPYNVIKNWDYTGLVDAIHNGQGRCWTARVATEEELTAAIATATGDDRKDCLCFIEVVVHKDDTSKELLEWGSRVSAANSRPPNPQ

SEQ ID NO: 50157 - protein, 542 aa, Lotus corniculatus
MAARTLSYLLSRSRSLSSSSGAASLLPSLGGKSGGWRNSNNRYSTAAVVEELITPQVSINYTQHLINGKFVDAASGKTFPAYDPRTGDVIAHVAEGDAEDVNRAVAAARKAFDEGPWPRMTAYERSRILLRFADLVEKHNDEIAALETWNNGKPYEQAAKAEVPTFVRLFRYYAGWADKIHGLTVPADGNYHVQTLHEPIGVAGQIIPWNFPLLMFAWKVGPALACGNTIVLKTAEQTPLTALVVAKLLHEAGLPPGVLNIVSGYGPTAGAPLASHMDVDKLAFTGSTDTGKVVLGLAAKSNLKPVTLELGGKSPFIVCEDADVDKAVELAHFALFFNQGQCCCAGSRTFVHERVYDEFLEKSKKRALRRVVGDPFKKGVEQGPQIDTEQFEKILRYIKSGIESNATLECGGDRLGSKGFYVQPTVFSNVQDDMLIAQDEIFGPVQTIFKFKEIDEVIRRANSTRYGLAAGVFTQNLATANTLMRALRAGTVWINCFDVFDAAIPFGGYKMSGIGREKGIYSLHNYLQVKAVVTPLKNPAWL

SEQ ID NO: 50158 - protein, 132 aa, Brassica napus
  misc_feature (19)..(19): Xaa can be any naturally occurring amino acid
  misc_feature (34)..(35): Xaa can be any naturally occurring amino acid
  misc_feature (47)..(47): Xaa can be any naturally occurring amino acid
KLNIQLYRYNKSQENKSDXILAQLPRFHLSILTXXPSSSLSSPHFNXLNHRSNPPVSLARTLFSFAPKSNLSTVEPIPLPVSDSSDLDEAPVEISLDKPFIPPETDISGDDPSSLTARVLKGSNIVLSKYAR

SEQ ID NO: 50159 - protein, 514 aa, Bacillus subtilis
MIQKRKRTVSFRLVLMCTLLFVSLPITKTSAVNGTLMQYFEWYTPNDGQHWKRLQNDAEHLSDIGITAVWIPPAYKGLSQSDNGYGPYDLYDLGEFQQKGTVRTKYGTKSELQDAIGSLHSRNVQVYGDVVLNHKAGADATEDVTAVEVNPANRNQETSEEYQIKAWTDFRFPGRGNTYSDFKWHWYHFDGADWDESRKISRIFKFRGEGKAWDWEVSSENGNYDYLMYADVDYDNPDVVAETKKWGNWYANELSLDGFRIDAAKHIKFSFLRDWVQAVRQATGKEMFTVAEYWQNNAGKLENYLNKTSFNQSVFDVPLHFNLQAASSQGGGYDMRRLLDGTVVSRHPEKAVTFVENHDTQPGQSLESTVQTWFKPLAYAFILTRESGYPQVFYGDMYGTKGTSPKEIPSLKDNIEPILKARKEYAYGPQHDYIDHPDVIGWTREGDSSAAKSGLAALITDGPGGSKRMYAGLKNAGETWYDITGNRSDTVKIGSDGWGEFHVNDGSVSIYVQK

SEQ ID NO: 50160 - protein, 362 aa, Oryza sativa Japonica Group
MSAYCGKYKDELIRNAAYIGTPGKGILAADESTGTIGKRLASIGVENVEENRRALRELLFTAPGALDCLSGVILFEETLYQSTRDGTPFVDVLAAAGVLAGIKVDKGTVELAGTDRETTTQGHDGLGERCRRYYAAGARFAKWRAVLSIGRASSRPSQLAVDANAQGLARYAIICQENGLVPIVEPEILVDGEHGIEACAEVTERVLAACYKALSDHHVLLEGTLLKPNMVTPGSDAARAPPEVVAEHTVRALLRTVPPAVPAIVFLSGGQSEEEATRNLNAMNQVASRGKKPWSLTFSFGRALQQSTLKAWAGKAENVGKAQAALLARCRANSQATLGAYAGDAAAGEGVSENLHVKDYKY

SEQ ID NO: 50161 - protein, 606 aa, Lotus corniculatus
MDVKLGSLDTTKPASNDVVSCATANHTTAIQSSIPSTAVSSCDATLGRHLARRLAQIGVTDVFSVPGDFNLTLLDHLIAEPQLNLVGCCNELNAGYAADGYARARGVGACVVTFTVGGLSVLNAIAGAYSENLPLICIVGGPNSNDYGTSRILHHTIGLPDFTQELRCFQTVTCFQAVVNNLEDAHEQIDTAISTALKESKPVYISIGCNLPGIPHPTFSRDPVPFSLSAKLSNQMGLEAAVEATAEFLNKAVKPVLVGGPKLRVAKASDAFVELADASGYALAVMPSAKGQVPEHHPHFIGTYWGAVSTAFCAEIVESADAYLFAGPIFNDYSSVGYSLLLKKEKAIIVQPDRVVIANGPAFGCVLMKDFLKALAKRLKHNNAAYENYHRIFVPEGKPLKSAPKEPLRVNVMFQHIQKMLSGETAVIAETGDSWFNCQKLKLPRGCGYEFQMQYGSIGWSVGATLGYAQAVPEKRVIACIGDGSFQVTAQDVSTMLRCGQNTIIFLINNGGYTIEVEIHDGPYNVIKNWNYTGLIEAIHNGEGKCWTSKVFCEEELVEAIATATGPKKDCLCFIEVIVHKDDTSKELLEWGSRVSAANGRPPNPQ

SEQ ID NO: 50162 - protein, 3689 aa, Sorangium cellulosum
MDRSDKLRAYLEKTTASLVEAKSRIRELEARSREPIAIVAMACRFPGGVDSPEKLWALLDEERDVITEVPPSRWDLERFYDPDPDAAGKTYSRWGGFVGDLDRFDAAFFGISPREARSIDPQERWLLETTWEALERAGVRADTLEGTLGGVYIGLSGSEYQAEAFHDAERIDAYSLTGASPSTTVGRLAYWLGLRGPAVAVDTACSSSLVAVHLACQALRNGECDFALAGGVNALLAPESYVAFCRLRALSPTGRCRTFSANADGYVRAEGCGVLLLKRLSDAQRDGDRVLAVIRGNAINQDGRSQGLTAPNGLAQEDVIRRALSQAAVEPTTVDVVECHGTGTALGDPIEVQALGAVYGHGRPGDRPLVIGSVKTNLGHTEAAAGMAGLIKAVLSLQHAQVPRSLHFAAPSDYIPWDTLPVRVAAQRVAWERREHPRRAGVSSFGISGTNAHVILEEAPASEAPATAPVAAPVAAPLPATLPLLVSGRDEAALRAQAGQWAAWLAAHPEAPWADVVHTAAARRTHLEARAAVAAGSAADAAAALEALAAGHPHRAVSLGEARARGEVVFVYPGQGSQWPAMGRALLAESEVFAAAVAACDAALRPLTGWSVLSVLRGEQGEAVPPADRVDVVQPALFAMAVGLSAVWRAWGIEPSAVVGHSQGEVAAAYVAGALTLEDAARVVALRSQLVRRIAGGGAMAVIERPVGEVEQRLSRFGGQLSVAAVNTPGSTVVSGDAAAVDRLLAELEAERVFARRIKVDYASHSAHVDAILPELEATLASVEPRACTIPLYSTVTGEVLAGPELGGGYWCRNLREPVRLDRALSRLLADGHGVFVEVSAHPVLAMPLSAASAERGGVVVGSLQRDDGGLGRLASMLGALHVQGHAVNWQRVLAPYGGALVDLPTYAFQRQRHWLEAPRYAAEDTDGAARRDPLYRVTWIEAALEEAPWAAERHVVLGADGALASGLGALALAGLPELLEALENGAAAPERLVLDLTEGRPGAVAESVHATTRSALALVQAWLAAPRLSGTELVVVTREAVAAGPDEGVAALGPAAVWGLLRTVRVEHPERAVRSVDLGREPPDVAVLRRALGTAAEPELALRAGGARAPRLRAVNAGADARAPAAALDPQGTVWITGGTGELGRQVARHLVAAHGVRHLLLTSRRGAAAPDAEALVEQLRADGAETVEVVACDVTDGAALSAAVQVAAAKRPLTAVVHTAGVLADGVLTALTAEQLTRALAPKVDGACHVYAAAQDQPLAAFVLFSSIVGTLGNAGQANYGAANAFLDAFAAQLRARGVPATSLAWGFWEQAGLGMTAHLGAADLARLGRQGLVPLSVAQGLRLLDRALAHPEATLVPAALDLSALQRAASDAGRVPPLLRGLVRASPGRPTATATPEAGPAAASALRARLSALPEAERAGALLELVRAEVAVVLRLAGPAQVPADKPLKELGLDSLTAVELKNRLGARAETVLPTTLAFDHPTPRAIADLLLQRAFSELAGATRAQAPRARGAHDEPIAIVSMACRLPGGVDTPAALWDLLSEGRDAIGPFPEGRGWDVAGLYDPDPDAPGKSITTQGGFLYDADRFDPTFFGISPREAERMDPQQRLLLECAWEALERAGLAPHALEASATGVFFGLAHGDYGGRLLQQLESFDGHVLTGNFLSVGSGRIAYTLGLRGPAVTVDTACSSSLVAVHLACMSLRAGECDLALAGGATVMATPMIFVEFSRQRGTALDGRCKAFGAGADGAGWSEGCGILALKRLSDARRDGDRVLAVIRSSAVNQDGRSQGLTAPNGPAQQDVIRQALAAAGLTPADIDAVEAHGTGTRLGDPIEAQALLATYGTAHTAERPLWLGSLKSNLGHTQVAAGVSGLMKLVLAMQHAELPRTLHADPPSPHVDWSQGHVKLLNEPAPWPRTDRPRRAAVSSFGISGTNAHVIVEEAPEPAPAADAKAVEALPILPLLVSGADEAALRAQVRRLVEHLRSHPDQRLLDVAASLATTRTHLATRLALPVSAGAPRDAWMDELEAFARGGAAPTQASQTPVESSTGKVAVLFTGQGSQRAGMGRALYATHPVFRAALDAACAELDRHLDRPLMSVLFADAGSEAAALLDQTAWAQPALFALEVALYRQWDAWGLRPELLLGHSIGELAAAHIAGVLDLADASALVAARGRLMQALPLGGAMASVEATEDELRPLLDQHTGRLSLAALNTPRQSVVSGDEPAVDQVCAHFTALGRRAKRLVVSHAFHSAHMEPMLDAFARVARGLTFHPPRLPIVSSVTGARASADELTSPDYWVRQVREPVRFVDGMRALHAAGAATFVECGPHGVLSAAGAECLAPDGARDAGFVPSLRNERDEALALVHAACAVHVRGHALDWLRFFDATGARRVELPTYAFQRQRYWLQAPRPRPSLEGVGLTAANHPWLGAAVRLADRDGYVLSGRLSTSDHPWVLDHVVLGTALLPGTGFVELAWAAAEAVGLSGVSELAIEAPLALPARGAVALQVAIEAPDPAGRRGIAIYSRPDGAADAPWTAHARGVLGAAASDRDAAWAQGAWPPPGAVPVDVTQWLEIVDAWVGPAFRGVVALWRVGRTIYADVALPDGVAGTAQDFGLHPALLDVALRAFLRAELSADPSPREGTVVPFAWSDVALEARGTAALRVRAEVEAGGDGDAITASIQLADGQGRPVARVGALQMRWTTAERVRAAAAAGAAERDLYRVAWTDVALDDTAFVPEEHVVVGGDGALAAALGARAVAGLPELLASLPDGAAAPRRLVVDLTADAAGAVVDAVHAAARDALSLVQGWLAAPQLAATELVVVTRGAVAVAPDEGVAALGPAAVWGLLRATRVEHADRTVRMLDLGPGAPDMALLRRALTAAEEPELALRAGGARAPRLDAAGETDGELAPPDGARSLRLSIRTKGSFDALHLADAPDALRPLGPGQVRLAVRATGLNFRDVLNVLGTYRGEAGPLGLEGAGVVLDVGEGVTALRPGDRVMGILHAGMATHAVVDARLLTHIPRGLSFVEAATIPAAFLTALYGLRDLGALKAGQRVLVHAAAGGVGMAAVQLARLWGAEVFATASEGKWPALRGMGIDQAHIASSRTLHFRKAFLDATRGQGVDVVLDALAGEFVDASLDLLPRGGRFVEMGKSDVRDPERVAKDHPGVRYTAFDLLDAGPDHIQAMLRELVPLFEEGVLAPLPFAVHDLRRAPHAFRSMANARHVGKLVLVPPAALDPDGTALITGGTGELGRQIARHLVAAHGVRHLVLTSRRGMDAPDAAALVGSLRAAGAATVEVAACDVTDRDALAAVVQAIPAARPLTAIVHTAAVLDDGIVAGLSAEQLARVLRPKVDGAWRLYEATRDAPLAAFMLFSSVAGTLGSSGQANYAAANAFLDGLAAELRTRGVPAMSLAWGFWEQGGIGMTAHLGAADLARLKRQGIAPMTVAHGLRLLDRALERPDAALVPASLDVAVIQRAASDHRQVPPMLRGLVRVAPRQAAGAANGRSHEASTLRQQLAALPEPERQRALLDLVRTEAAAVLVLRGPDAVPADKPLRELGLDSLTAVELRNRLRTRAQTDLPSTLAFDYPTPKAVAVYLAQELDVHDVMTEMRGPSLRSDDEIKSAIASIRISTLRQAGLLDSLLRLAASEAVSTSSDTTPETDELTLQHVGDDELARLVFDLAGGAQ

SEQ ID NO: 50163 - protein, 354 aa, Zea mays
  misc_feature (271)..(271): Xaa can be any naturally occurring amino acid
MAQRWRSRARWDSDLDEDGSPPFRQPRRGGSDEEDDEVGNEDLSLEIIARAQRKRRWASCGGVTGFANLLSVSSGDDEDAVVELAEADEPRRKQKKRQHWKQRKRQRKEATAAAAAAAAVDEEEKEVGTTQEEQIGTAESVLTEDGVDAPTSHSMFLRKLLRIPRYFDPGETLLETCFNCSEEGHVAANCPMGKRKKPCFVCGLFGHNAKQCKQGQDCFICKKGGHMAKDCPDKHKRNDHQSTLCIRCGETGHDMFGCANDYPPDDIECNXCPSCKVSCYNCAQSGHSGLGCAKQRREASAVTTPTLCFKCGEEVRWAKRLVVTTQSEEGKMEKRWQVTITHPEEGKMEERFQC

SEQ ID NO: 50164 - protein, 245 aa, Triticum aestivum
  misc_feature (168)..(168): Xaa can be any naturally occurring amino acid
  misc_feature (181)..(181): Xaa can be any naturally occurring amino acid
  misc_feature (193)..(193): Xaa can be any naturally occurring amino acid
  misc_feature (199)..(199): Xaa can be any naturally occurring amino acid
MAAPSSLASSRLAAAAPAPQHHHHQNHQLRLGCSRRRAQRLVAMAGSGKFFVGGNWKCNGTKVSISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSPNLKVXACIGELLGKEREXAGKTFDVCFKQXMKAFAXDNITDWENVVIAYEPVWAIGTWERLLLQEQAQEVHAAVRDWVKTKV

SEQ ID NO: 50165 - protein, 161 aa, Triticum aestivum
  misc_feature (75)..(75): Xaa can be any naturally occurring amino acid
LTSFFTHFTQGYKHIMENCKLNAAVLKEGIDPPGRFNVLSKPNGVPLVAIRLKDSTNFSVLKISENLRRFGWIVXRPTYKMPANAEHVAVLRIVIREDFNRSLAQRLLADINKIVAELDAHAVHAIKLSNAAAAEGASKSTVDAVTEAFKGLAGNKKAGVC

SEQ ID NO: 50166 - protein, 414 aa, Clostridium acetobutylicum ATCC 824
MDYRKYFEKLKSDYVYLDNAATTPPLKSVMKKALEFLENYSSIHRGTGYLAKMSTDSYENSRRVIGEYLHATKDDVVVFTANTTDSINKFALLYPFMGNEGVLISDIEHSSNMLPWFKNSGRVKMFNTGKSNKINPYSIEEELYRNPQIKIVSICGASNLTGYLTPLRDIYKICKKYGVYLLVDASQIAPHFKITLDDCDFIAFSGHKMYAPFGAGVLAGRKDVLSHIGLAPTGGGNIVYIGKRGEVIYKEPPLSLEAGTPNGLGAVTVAEAMRVLNEDIGWENMNQHNKRINEIGYKYLSDLSNIKLYYPKDQDIRINRTPTFVFDFKNVGTKVGCDILKENKIGVRCGTFCLYRLIEKVKNIDEYERKRLYRNYIVPNRELPERYSLVRASAGLMTTEEDFLRLRAAIKKVE

SEQ ID NO: 50167 - protein, 257 aa, Oryza sativa Japonica Group
MAGGGDDLKMLGVYVSPFPLRVKLALSFKGLSFEYVEEDLHNKSDLLVSSNPVHKRTPVVIHNGKPISESMVIVQYLDEAFPGAGAALLPSDPLDRAVARFWASYVDDKVIRMITVHQFSHASFSDDFGADRMMQLFSAWKMVFKGKTEEEKVEGRKQTFAVAETLEGALRECSKGKPFFGGDAVGYVDVALGGFVPWVHAMEELFGLKQFDAAKTPLLAAWLERVGELEAYKAVMPDAGMMIEFKKKQAQEAAAEA

SEQ ID NO: 50168 - protein, 530 aa, Citrus sinensis x Poncirus trifoliata
  misc_feature (516)..(516): Xaa can be any naturally occurring amino acid
MADIEGSPGSSMHGVTGREPAFAFSVASPAVPTDTTAKFALPVDSEHKAKVFKLFSLANPHMRTFHFSWISFFTCFVSTFAAAPLVPIIRDNLNLTKADIGNAGVASVSGSIFSRLVMGAVCDFLGPRYGCAFLIMQSAPTVFCMSFMAGPSGYITVRFMIGFSLATFVSCQFWMSSMFNSKIIGLANGTAAGWGNMGGGATQLLMPLVYDIIRRCGATPFTAWRIAFFVPGWMHVSMGILVLTLGQDLPDGNLDALQKKGNVAKDKFSKVLWYAITNYRTWIFVLLYGYSMGVELSTDNVVAEYFYDRFNLKLHTAGIIAATFGMANLVARPFGGYASDMAARYFGMRGRLWVLWILQTMGGAFCIWLGRANSLPIAVLAMILFSVGAQAACGATFGIIPFISRRSLGIISGLTGAGGNFGSGLTQLIFFSKTKFSTAQGLSWMGVMIVACTLPVTLVHFPQWGGMFFPPSKDVVKSTEEYYYASEWNEEEKQKGLHQGSLRFAENSRSERGRRXASAPTPPNTTPAHV

SEQ ID NO: 50169 - protein, 145 aa, Vaucheria litorea
VVPKTAENFRALCTGEKGVGRSGKPLWYKGSAFHRVIKDFMCQGGDFTRGNGTGGESIYGDKFADENFSLRHTGPGILSMANAGPGTNGSQFFLCTVPTPWLDGKHVVFGEVSKGMEVVRAIESVGSSSGKTSRPVVIANCGQLS

SEQ ID NO: 50170 - protein, 139 aa, Glycine max
MPSPSSMEQEDNTIIPTFLRKPAEDQNNNNSPTPSHKSLHVFRRSRRRWRKEVAVKDAVQEEEDEEKEEGEDGGDDREEIERKIHALQRIVPGGESLGVDKLFDETAGYILALQYQVKALRALTGFFEKLEKEKTKFGG

SEQ ID NO: 50171 - protein, 308 aa, Arabidopsis thaliana
MEEGLKIQSLVIYPIKSCRGISVPQATVTHTGFQWDRYWLVVNYKGRAYTQRVEPTLALVESELPKEAFLEDWEPTNDSLLVIRAPGMSPLKIPLTRPSSVAEGVSMWEWSGSAFDEGEEAAKWFSDYLGKQSRLVRFKKDTETRPSPPEFAAGYSTTFMDMFPFLVASQGSLDHLNTLLPEPVPINRFRPNILVDNCDPFGEDLWDEIKINDLVFQGVRLCSRCKVPTVNQETGVMGKAEPTETLMKFRSDNVLMPDKKPRGKVFFGKEMVWNWNLTNTEGEGKKTIKVGDTISVIRKIPSRAEAAV

SEQ ID NO: 50172 - protein, 326 aa, Aspergillus nidulans FGSC A4
MAVKTQALVSREVNVPPKLEEITLDDIRADEVLVEIHATGICHTDFSCMNGTLPAAFPSVLGHEGAGVVLEVGEKVKHVRKNDKVLLSFDHCGACSQCDKGHPAYCSEWVTRNFGQKRSDGSLTLADANGAKVHGNFFGQSSFARHTIVSSASVVKVPSDTRLDLFSPLGCGIQTGAGAILNTLDLRNAKTIIAIDLQPQRLELAKKLGATHAVLGSDTDVVAQIQKISGSNGVDNSVDCATVGAPTPGVRAGVDVFSHLVMGRQYLGCCEGDSDTQKFLPYLIEQHARGQFPLDQMVTYYRVNEFERTFKDVKEGKALKAVLLRT

SEQ ID NO: 50173 - protein, 405 aa, Vaucheria litorea
MLVHSLILLLAAGALHVESFVSTHSALRTSTFTNNAQSLNKAASKLQALEMKLGDPDEPVVIIGVAADSGCGKSTFMRRLTNIFGGSSVGPLGGGFGNGGWETNTLVSDLTTVICLDDYHLNDRNGRKVSGRTALHTDEQKFDLMTEQLSALKRGESVMKPIYNHVNGTLDTPEEVKPTPIVIIEGLHPFVDERVRDLLDFTIYLDISDEIKFAWKIQRDMMERGHSLESIQASIEARKPDFDAYIAPQRAQADVVLQVLPTKLVPEDKEGKILRTRLIQKENVKNFETAYLFDEGSTINWIPCGRKLTCSFPGIKFAYGPDTYFDNEVSVLEMDGQFDNLQELIYVEGFLSNTGTKFYGELTQNILKLSDSPGSNNGTGFLQTVIALKLREIYEKITTSQAEAA

SEQ ID NO: 50174 - protein, 311 aa, Corynebacterium diphtheriae NCTC 13129
MAKIYDSILDTVGNTPLIKLNRLDKYLPGNVVVKVEFFNPANSVKDRIGKAIVDAAEASGDLKPGGTIVEATSGNTGIALALVGAARGYNVVLTMPETMSLERRVMLRAYGAEIVLTSGAAGMQGAVDKANEIVAERDNAILASQFKNAANPEIHRRTTGEEIWNDTDGQVDIFVAGVGTGGTVTGAGETLKKHNPEIKVYAVEPAASALLTTGKAGPHKIQGLGANFIPSVLNQKVYEEVITVTNEDAISTSRQLAAQEGILGGISAGANLKAALELAALPENEGKTIVTVVPDYGERYVSTVLFDDIRD

SEQ ID NO: 50175 - protein, 188 aa, Corynebacterium diphtheriae NCTC 13129
MYRLVKTIREDLANAREHDPAARSDAENAIVYSGLHAIWSHRIAHALWQKNLKGPARILAQFTRFLTGVEIHPGATIGRRFFIDHGMGIVIGETAEIGDGVMLYHGVTLGGQVLTQTKRHPTVEDDVVIGAGAKVLGPITIGKGSAIGANAVVTKDVPANHIAVGIPAANRPRGADEKIKLVDPDYYI

SEQ ID NO: 50176 - protein, 183 aa, Arabidopsis thaliana
  misc_feature (134)..(134): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTXDSVQVVEREWEKCQERSTPMPSFRIIGFDNTRQVQCISFIAYKPPSFTG

SEQ ID NO: 50177 - protein, 874 aa, Pneumocystis carinii
MIFKILITFFLYWIYLVRVRCETVPVDFENNDYYHFHFSEDVDIEEFSRAIGFKYHMKVDHLDNHHIFFIEKGVLEDEIKEKIENYFGLEKGRNAINGFNSDKLFYYEKQKLVKQENRGAIRDDIYFDNQDLYNDEVVNNVVKDPTGDDQAVNSTEEQAVNSTEDQAENPTEDLTQKLKEIKKQLNITDPCFDKQWYLFNTEKPGVDINVTGVWLQGITGKNVTVAIADNGIDYCNQDLAPNYNSEGSYNFHAGNSDPKPEKPDESHGTKCAGEVAAARNDLCGLGVAYESKISGLRFMTSPYALLLEGEALKYEPNLNHIYSCSWGPPDYGYVAMPMMPTTYSAIIKGIKEGRNGLGSIYVFGSGNGGLLDDCNYDGYANSPYTVTIAAIDAEDKKFDTSESCPCILASTYSGGENGSIYTTDLGKTNCTTQHSGTSASTAIAAGIIALVLSISPNLTWRDVQALIVETAVPFRLKYYDWDELPSKRYYNNYFGYGKLDAYRMVERARTFETLNAQTMFSTRLIQVNMKFPEPSRRIKSSFYIHRGYPEHYNFKNLEYVGVSFYYRHRTRGYLQFKITSPSGVTSLLARVRIRDNESGYFSWIFTTVKHWGEPIVGTWTIDVTDKNNWNEQGYIFNWQLHFFGESINSSKALPPPYPFVHKQPTTMPPPEPTTTLPSDLDANPQPQPDPGSPPSSDPESPPSSDPESPPSSDPGSPPSSDPESPPSSEPGYQPPSEPPPQPPLDPRPPSKPDPNPPSDPSSQQDPDTSLSSNPTSTSSSEPPPPPPPPAPAPPAPAPPPPPAPAPPPPPPPPPPRPEPEPEPEPEPEPEPEPEPEPEPEPEPEPEPRQSHLHLHLHFHLHLHHLDHRNKNQHQ

SEQ ID NO: 50178 - protein, 245 aa, Debaryomyces hansenii CBS767
MSEGGPIIILIGGGHAAGKKTTANLLKEELRFSLPDVDLNIEIIDLDDYKEDEAKREYSTSKSAAITLPDNSDVNYPPLKPSRFNFDKLREYLLSGAKVTLKSQQKILIVHGLYALYDKQVRDISHIKVFLTSDPDTRLIRWIRRDVLDLNKNKSLESVINAYLQGARAEMSDFIFPTKEFADVIMPKGAEKNAIGLIVDGVMLLLPEEDQPQNIFLPRTNNLRPTVSFDSEKFDGQKGKFYEIS

SEQ ID NO: 50179 - protein, 555 aa, Leptospira interrogans serovar Copenhageni str. Fiocruz L1-130
MKGSLMSEAKYSLENPFQSTSEPEVLKPRGLYEEANELGKELLNKPLLGGGVDRILVQHSKDRMTVWERIKVLTDQEPNILYQNWGKSLDGASLVTGILNINGRDVAVYGHDFTLRAGSMDATNGSKLARLIYMAGEHGIPLIGMNDSAGAYVPAGVGGLDGYSEAFTALRKISGVVPSLMLMFGFNAGGGAYLPRQGSFMIQCDNTFFGLTGPGVVKSVLGEDISADDLGGPKVHGQSGVVDIVTGDELGSLRTALRLLSYLPDNNHSFAPFHATSDPTNRFIYEEEILFKKTFNSPTGMNTPFDITLYLQNICDHGQYFEIQGQRSRNLVTAFGRIGGHVVAFVANNSAVSSGQIDIGAARKGTRFIRFCNLYNIPIVFLEDTTGFLPGKEQEQNGIVLEGRKLLDSIIDIRTPRLTLIIRNAFGGAYACFNSYHTGADMVFALPTARIAVMGPAGKDYVYKDEVSSIQKEYQENVKKGMSEKEAIVIRDKKLQTLSTQYEKELMNPKEALSLGSVSRIVLPGTTRNILFQNLDYLIRHYKPAPLSGPQREFE

SEQ ID NO: 50180 - protein, 550 aa, Aspergillus oryzae
MASFDQEAKEGNDAKNPTNTPDALAGDVEEANGNTLKRALEGRHIQMIAMGGAIGAGLFVGSGEALANGGPASVLIGYLIVGVLLLCTIMSLGELAIMYPINGAFYQYSTRFIDPCWGFAIGWAYSLGWLVTLPFEITAASLTIEYWNSDLNPAIFVSIFLIVLVIIQVFGVRGYGEVEFVLSIIKVIACIGLIILGIIINTGGVPGSPQGYIGGKYWRDPGAFANGFKGFCAVFVNAAVAFSGTELVGLAAAETKNPQKTLPTATKQVLWRVTIFYIVNLLIVGLNVPHNSPQLLGSGDAASSAGVSANASPFVLAIQDAGIHVLPSIINAVVLISSLSVANSSTFASTRTLQALAADGGAPSFFAYIDKAGRPLAPIALQVLFGFLAYLQFASSGLTIFNWLLSIAGVSTVMMNLSINMAHIRFRLALKAQNRSTDEIPWKSTLGTVGSSIGAFLSAIALVAMFYSALYAPGGDPPSAFNFFQQYLAGFMGLVLMIFWKVWNRQWWLGVPLRQIDLDTGRRFMEMEQVTPDETGESLPWWKRAKQTIC

SEQ ID NO: 50181 - protein, 380 aa, Aspergillus oryzae
MANLLRRYVAPAETARHVATILGFPSKISIAANYYEDACKEIASLASAISAFEPVRLYTRPEDVSRARDLVSKSIPIFNGTDSNINIIPFSTNHLWVRDTGPVYVYGTGAHAKDRFAVNFRFSEWGKKDDIGDHYRATDGLDWPVMGPEQVRENATFAQQVIGNDTSPAPVVQVESKICLEGGALVLDGDGTLLATESSILNENRNPGLSRAEIEEELQRLLGVEKIIWFPGRRDLDVTDVHADAELNFVRPGVVVLSKPHPSVPQPWQDVHNEIRDILDREVDAKGRRFEVHIVEEPDPTIFGDLSYPDPATNYVNFYFVNGGLILPQFGDPVKDAEAVSTLQKLCPEHKVTQVPVRGLPLAGGVIHCSTQPVVAVGEQ

SEQ ID NO: 50182 - protein, 92 aa, Triticum aestivum
  misc_feature (28)..(28): Xaa can be any naturally occurring amino acid
  misc_feature (57)..(57): Xaa can be any naturally occurring amino acid
  misc_feature (85)..(85): Xaa can be any naturally occurring amino acid
ASNNPTTRCQNTGEIYYHQKLLNLYDKXRISQQVVGDLLGEEFTEYIFKIMGGCYKXGLPMKQGVLTSGRARLLLHRGTPCLRGXGRRNGER

SEQ ID NO: 50183 - protein, 168 aa, Herminiimonas arsenicoxydans
MSIPATLSMPFRIGQGYDCHALVEGRKLIIGGVTIPHVTGLLGHSDADVLLHAITDALFGAAALGDIGRHFPDTAVEFAGADSRVLLREAAKRVAAAGFYIGNVDATIIAQRPKMAPHITQMIANVAEDLGVAVNQINIKAKTNEKLGYLGREEGIAAEAVALIYQRS

SEQ ID NO: 50184 - protein, 66 aa, Zea mays
MPKHYRPAGKKKEGNAAKYITRTKAVNYLQVSLAIFRFVTISQLILYIAGEPSSRRRIMLNKLVGC

SEQ ID NO: 50185 - protein, 764 aa, Coprinopsis cinerea okayama7#130
MATTSPPVDTDFANMPPRTADLEETWAYLNGGVEHIMTNFELGLSFKGYTSLYSTVYNYCTSTKMHGKLDGNRTGANLVGSDLYSKLSTYFVNHFKGMLEKAATLEDMDLLRYYASEWDRYTRGANYLNRLFTYLNRYWVKRERDEGKKGVYQVYTLALSQWRNHFFMHIQKDNSKLSNAVLKLITQQRNGEIVDQGLIKKVVDSFVSLGLDNADPNKECLDIYKEQFEVAFLAATEAYYKQESEAFLAAHSVSDYLKKAEDRLREEENRVERYLHNKTRKELVSKCEHVLIREHSELMWESFQSLLDFDKDEDLQRMYALLSRIPEGLEPLRKRFEGHVKAAGLSAIGRLIGEGGANVDSLDAKAYVDALLEVHHKNSETVARSFKSEAGFAASLDKACREFVNRNAATGSSSTKSPELIAKHADMLLRKNNKMAEEGDLEGALNRVMILFKYLEDKDVFQTFYTTKLSKRLIHGVSASDEAEASMISKLKEACGFEYTNKLQRMFTDMSLSKDLTDAFKERQQHAEDTDITFTVMVLGTNFWPLNPPTHEFIIPQEITPTYERFQRFYQNKHSGRKLTWLWNYSKNELRTNYTNQKYILMTSSYQMAVLMQYNRNDTLSLDELVAATSISKEILTQVLAVLVKAKVLINEEPEQYDLNPGFKSKKIRVNLNLPIRAEVKAESSDVLKAVDEDRKYVIQATIVRIMKARKTMKNQALIQEVISQITQRFAPKIPDIKKAIETLLEKEYIERVEGSKDTFAYVA

SEQ ID NO: 50186 - protein, 220 aa, Oryza sativa Japonica Group
MAAGGGGGDELKLLGLWASPYVLRAKFALSFKGLSYENVEEDLHNKSELLLSSNPVHKKVPVLIHNGKPICESQIIVEYVDEAFPDAGESLLPSDPYDRAVARFWAAYINDKFMPAWQKASLGLTEEEKAEAVKQMLAAIENLETAFKELSKGKPFFGGDTAGYLDVTLGAVVGWARAGEVLFGRKLFDATRSPLLAAWMERFVALDAVKAVLPDNAELI

SEQ ID NO: 50187 - protein, 412 aa, Rickettsia akari str. Hartford
MPIKILMPALSPTMTAGNLARWLKKEGDKVNPGEVIAEIETDKATMEVEAVDEGILAKIVIPQNSQNVPVNSLIAVLSEAREEKADIDAFIAKNNNVSPSPKPDTNLPKHHENIAKVEEQVAVIKHDTSKIFASPLAKRLAKMGNIKLESVKGSGPHGRIVKQDVLSYTPSTVHNKIVSRNPEEYRLVPNNNIRKIIAKRLLESKQTVPHFYLSIECNVDKLLDIREDINKSFSEDKATRISVNDFIILAVAKALQAVPNANASWREDAIRYYNNVDISVAVAIENGLVTPIVKNANQKNIIEISREMKKLIKKAKDNKLTPEEFQGGGFTISNLGMYGVKNFNAIINPPQSCIMGVGASAKRAIVKNDQITIETIMDVTLSADHRVVDGAVGAEFLAAFKKFIESPALMLI

SEQ ID NO: 50188 - protein, 421 aa, Xylella fastidiosa Temecula1
MASAKEISQYLKRFSQLDAKRFAVVKVGGAVLRDDVDALTSSLSFLQEVGLTPIVLHGAGPQLDEELTAVGIQKKTVNGFRVTLPETMAIVRKVFHATNLQLIEALQRNGARATSITGGVFEAHYLDQETYGLVGGISAVNIAPIEASLRAASIPVIASLGETPSGQILNINADVAANELVHVLQPYKIIFLTGTGGLLDADGKIINSINLSTEYEQLIQQPWVYGGMKLKIEQIKHLLDRLPLESSVSITRPADLAKELFTHKGSGTLIRRGERVIRATTWKDLDLPRLQHLIQSSFRRTLIPHYFETTPLLRAYVSENYRAAVILTKLGNVPYLDKFAVLDDAQGEGLGRAVWSIMREETPQLFWRSRHNNQANAFYYAESDGYYKQDHWKIFWNGLHHFQQIQQCVAHCTQHPPTLID

SEQ ID NO: 50189 - protein, 243 aa, Oryza sativa Japonica Group
MAAEGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMELVPNKGGKPLLRAATPSGFLDVALGGLLSWLHGTEELCGAKILDAAKTPLLSAWARRFGEMDAAKVALPDVCKLVEFAKMKRVQLEAAMAATTVSRN

SEQ ID NO: 50190 - protein, 316 aa, Aspergillus oryzae
MKSPIPDYLRQVLEKARPDDSGQLANYIDVLAKADPSKMAIALSTVDGNLYSAGDDEVEFSIQSISKAFVYAIAIEDAGLPRVLEKIGVEPSGDAFNKLSLQPGTNRPMNPMINAGAIAAHTLVAGESASAEERVDHILKVLSKLAGRQLKVDEEVYEAELKDANRNMAIGYMLKAAGIISCDPQDAVRGYIRQGSITTNVRDLAMMAATLANAGVNPITGEEIMPHQSARQVLSVMTTCGMYDAAGDWVSRVGMPAKSGVAGGIIGALPGQVGIAVFSPKLDERGNSFRGVKMFEQLSSEMGLHMMDISQGSMWE

SEQ ID NO: 50191 - protein, 164 aa, Debaryomyces hansenii CBS767
MAVKGLGKVDQQYDGSKLRIGILHARWNKKIIDSLVEGAVKKLQEFNVKPENIVVESVPGSFELPYGTKLFFDKQERLGEPLDAVIPIGVLIKGSTMHFEYICDSVTHQLMKLNFELNRPVIFGVLTCLTDEQAEARAGLIEGKMHNHGEDWGAAAVEMCTKFD

SEQ ID NO: 50192 - protein, 286 aa, Triticum aestivum
MVRAACSARWSGVEWLVQSAIPKGHKTLTKFVNNGSSNVFYAHDYNATVEFYWAPFLVESNSDNPKVHSVPDRVIQWHSIAKHAKNWVGVDYLVFNTYIWWLSALDMKVLKKGSFDEGATEYEEVDRPVAYSEVLKTWAKWVDRNIDPNSTTVFFMGMSPNHITPEAWGNEGGIKCAMETQPIANRSATLDVGTDWRLYAGAQDVLKTFRRVPVHFVDITALSELRKDAHTSVHTLRQGKLLTPEQQANPKTYADCIHWCLPGLPDTWNQFLYARIVSSASTQRQE

SEQ ID NO: 50193 - protein, 526 aa, Prochlorococcus marinus str. MIT 9313
MINRSEPSLIKQWLGNPPKDLLSGLVVAFAMIPEAIAFSGIAGVDPQVGLFGAFCLSVTIAIVGGRMGMITSATGSTALLMTGLVATGNAVGEGLGLAYLMAAGLLTGLLQILWGYLRLAYQMRFVPQGVLSGFVNALALLIFQAQLPQLGLNLHYGEAVVSDHATQILPTGGQIPLVWGLVILGLVIIYGLPRLTRLLPSQLVAIIVLTIISIGFGFDIPTVKDLGHLPTGLPSFTLPFGSLADGKVPFNLETFGLVLPTALAVSLVGLIETFLTQDIVDDLTDTTSNKNVEARGQGIANVVSSLFGGMAGCALVGQSVMNTENGGRSRLSTLFSGVSLLLMILVGRVWLEQIPMAALVAVMIAIAVSTADIRGLRQLKKIPRSDTAVMLMTFAVTMLTTPHNLALGVLAGVALAGILFSRKVAKVIRVSVIQVNPDELRYEVSGQLFFVSKVYFLQGFDIHKHPAKVTIDMSRAHIWDQSGVAALDQVIRKLRLGGSEVEVVGLNKESLDLFERIGGNQEPAHI

SEQ ID NO: 50194 - protein, 159 aa, Bacillus licheniformis ATCC 14580
MNISIVAIGKLKEKYLKQGIDEYIKRLSAYAKVDIIELPDEKAPENLSDQDMKIVKDKEGERILSKISPDAHVIALAIEGKMKSSEELADNMDRLATYGKSKATFVIGGSLGLSDAVLKRADEKLSFSRMTFPHQLMRLILLEQVYRAFRINRGEPYHK

SEQ ID NO: 50195 - protein, 501 aa, unidentified eubacterium SCB49
MSQVTGKVAQIIGPVVDVEFASGAVLPNIYDSLEVDNHGNKLILEVQSHMGENTVRTISMDSTDGLSRGVDAVATGAAIQMPVGPDIYGRLFNVIGDPIDGMEALAKAGKDGLPIHREAPKFEELSTSSEVLFTGIKVIDLIEPYAKGGKIGLFGGAGVGKTVLIQELINNIAKGHGGLSVFAGVGERTREGNDLLREMLESGIIKYGDDFMHSMEEGGWDLSKVDKMAMRDSKATFVFGQMNEPPGARARVALSGLTIAEYFRDGAGDGQGKDVLFFVDNIFRFTQAGSEVSALLGRMPSAVGYQPTLATEMGAMQERITSTKKGSITSVQAVYVPADDLTDPAPATTFAHLDATTVLSRKIAELGIYPAVDPLDSTSRILTAAILGDEHYDCAQRVKMLLQRYKELQDIIAILGMEELSEEDKLAVNRARRVQRFLSQPFHVAEQFTGIPGVLVDIKETIKGFNMIMDGELDHLPEAAFNLKGSIEEAIEAGEKMNAEA

SEQ ID NO: 50196 - protein, 274 aa, Aspergillus oryzae
MKFATTLLPLLAGASAFCIHSPVMRRAAGGLDDANKFNYTGLGGPLNWYGLDEANEACAKGKHQSPIVIDSAAIDYAASGSLKLDLPLADGSKLENLGFGLQVTLTNGSLTANSKTYTLAQFHFHTPSEHHVNEEHFPMEVHFVFQTAAKETAVVGFFFQLSEVGDSVPLFDSVFAPIDNIPDAGTSTTTGQLDFGGLLDHFNRHGVYQYTGSLTTPPCTEEVMWNLSTEPLPLTVQGYNKVKKIIKYNARYTQNALGQDNLLEVAAQKLNSIR

SEQ ID NO: 50197 - protein, 640 aa, Kluyveromyces lactis NRRL Y-1140
MIKLPAKLLGSRFYSSVTNQNRYSVTRHNAPKKCPESGHYNKIPIGKEAARLQSQPKVTRLSVDGPIECPLEGFQLLNSPLFNKGSAFTLEERKAFGLDGLLPPQVNTLDEQVERAYKQLCYLKTPLAKNDFMTSMRVQNKVLFFELVRRHIRQLVPIIYTPTEGDAIAAYSHRFRKPEGVFLDITEPDSIDSRLAAYGEDKDVDYVVVSDGEGILGIGDQGIGAIRIAISKLALMTLCGGVHPGRVMPVALDVGTNNKQLARDELYMGNRFSRIRGKQYDQFLDKFIKALKHRFPNAVLHFEDFGVTTARTLLERYRNELPCFNDDIQGTGAVVMASFIAALKHTNRELVDSRILVYGAGSAGLGIADQIVNHMVTHGCTPEEARAKIYLMDRKGLILDTMENDSNPAQFLYAKPSENWEGANTQSLVDVVSKVKPTCLIGCSTQAGAFNKVVVEEMYKHNPRPIIFPLSNPTRLHEAVPEDLLKWTNYDALVATGSPFPPVDGYRISENNNCFSFPGIGLGAVLSRAKVISDKMISAAVDQLADLSPLKPGDSKPGLLPPLEEINDTSARVATAVILQALEEGSARIEEENVPGTDKKVQVPRDFNKCLEWVIKQMWKPEYRPLIKVEHDPAVHTHQF

SEQ ID NO: 50198 - protein, 545 aa, Bradyrhizobium sp. ORS278
MASGELLLHSPIRFSDALREELERLGPIKYLLAPNVAHWMFLPDWQAALPNAHVYAVPGLSERQQVRRSGLRIDRELTDVAPDEWSEELQLVLITAPLFSEVAVFHRPSRTLVLTDLVQNLAPEGLGVLPRMAARLLGITAPDGKAPAYLRWLLRLGGRAAQLAAARLIALAPERVIFAHGRWFETGGTTQLRRALGWLLDGSPEARRLMRDLRGKRVVITGASSGIGRATALALAREGASLVLAARRENVLKDVAAECETLGGQAIAVGTDVTDADAVRRLAEQAVQSFGGIDVWINNAGTGVFGAYQDADLALHRKTIEVNLLGTMNGAYAALPVFLRQRRGTLINNISLGGWAPTPFAAAYTASKFGLRGFSASLRQELAAHQDIHVCSVFPAMVDTPGFVHGANVSGRNLDPGPLLYRPEDVAETFVQLIHAPRDEVAVGWPARLGQISYALARLPTERLMSTTFRFLLSRAKVAPRSSGAVLAPIAAGTAVSGGWLGRKKLPPAGQLSKIGLAVGLGGLALMLIARSRSGRPAPRARAHR

SEQ ID NO: 50199 - protein, 296 aa, Desulfitobacterium hafniense DCB-2
MKIGFIGLGIMGKPMSLNLLKAGHEVVVYNRSPKAVQECVQAGAEAGASPKDVAERCPLIITMLPNSPQVKEVILGPDGVLEGARPGAMVIDMSSIAPGASQEVAQKLAEKNVRFMDAPVSGGEPKAIDGTLSIMAGGKSEDFEEFLPVLKAMGSSAVLCGDVGAGNVTKLANQIIVAVNIAAVSEALTLATKAGANPETVYKAIRGGLAGSTVLDAKGPMMLERRFDPGFRINLHIKDLNNVMETGHDIGSPLPITATVMEMMQTLKSYDLDHQDHSALVQYYEKLAGIEVKKAD

SEQ ID NO: 50200 - protein, 961 aa, Arabidopsis thaliana
MEGDSGKLEATIDRLLNEEKQMRLAENVAGTRKAATEILQLCFDAKDWKLLNEQILNLSKKRGQLKQAVQSMVQQAMQYIDQTPDIETRIELIKTLNNVSAGKIYVEIERARLTKKLAKIKEEQGQIAEAADLMQEVAVETFGAMAKTEKIAFILEQVRLCLDRQDFVRAQILSRKINPRVFDADTKKDKKKPKEGDNMVEEAPADIPTLLELKRIYYELMIRYYSHNNEYIEICRSYKAIYDIPSVKETPEQWIPVLRKICWFLVLAPHDPMQSSLLNATLEDKNLSEIPDFKMLLKQVVTMEVIQWTSLWNKYKDEFEKEKSMIGGSLGDKAGEDLKLRIIEHNILVVSKYYARITLKRLAELLCLSMEEAEKHLSEMVVSKALIAKIDRPSGIVCFQIAKDSNEILNSWAGNLEKLLDLVEKSCHQIHKETMRGDSFASSSLIMDGADGTVRVKPGRGFETETDVAVSSPVTRQKAAAAKQFIENHYKNYLQGLHERMERRREFQRKVQEAQLPVEEQDEMMRNLARRETEYMRLQRRKIGIDDFELLTVIGKGAFGEVRLCRLRSTSEVYAMKKLKKTEMLSRGQVEHVRSERNLLAEVDSRYIVKLFYSFQDSECLYLIMEYLPGGDIMTLLMREDILSEDVARFYIAESILAIHSIHQHNYVHRDIKPDNLILDKSGHLKLSDFGLCKPLDDKYSSLLLEDDEMLSQDSENQSGKSDADKAPWQMPKEQLLQWKRNRRALAYSTVGTLDYMAPEVLLKKGYGMECDWWSLGAILYEMLVGYPPFCSDDPRITCRKIINWRVCLKFPEEPKISDEARDLICRLLCDVDSRLGTRGVEEIKSHPWFKGTPWDKLYDMEAAYRPIVDGELDTQNFEKFPEVEGSPSEAPQVGPWRKMLTSKDTNFIGFTFKKSDITRSMESSGADMKSNGSGEAPSLISLLGRINMEEGEGEAMERRW

SEQ ID NO: 50201 - protein, 446 aa, Kluyveromyces lactis NRRL Y-1140
MGNDNWRVIASTAAITFAGVKFIDLAIKSWNKRTAASYSGSDNEKDVKLAKRLRETREYDNLLYREQLARNYAFLGEEGMEKLKEQYFIVVGAGGVGSWVVTMLVRSGACRIKIIDFDQVSLSSLNRHSCADLYDVGLSKVNVLRDHLQKIAPWCNIEVCNELWNKENADRLIFGDGTPTFVIDCIDNLDTKVDLLEYTYKKNIPVIASMGAATKSDPTRINVGDLTMTEEDPLARTVRRRLKQRGITKGIPAVFSAEKPDPKKAKLLPLPEEEFQKGNVDQLSALKDFRVRILPVLGTMPGVFGLTIATWVLCKISGYPMEPIEGKNRIKLYDGIYQSLAGQMTRIGQKDQRIPIALSDIGYIVEEVWRGKSPISNYSTRLTLSKWDPTKPVSIQNVILLTKDEQREHEARILNGTETFSDVYSEEALAMINKRFQEELYYSQFR

SEQ ID NO: 50202 - protein, 383 aa, Hebeloma edurum
GAPKFKWSHLWEPAIVNPVNLKSYTIPIFNLRDPYAQAFHLSWLGFFEAFLSWFAFPPLIPDAIKSDLRLSGAQVANSNVIALCATLVIRIGVGPLVDQYGPRKVMAYLLILGAIPSGLAGTARTAEDLYVLRFFIGILGATFVPCQAWTSAFFDKNCVGTANALVGGWGNMGGGATFAIMTSLFQALTETYGLTTHVAWRAAFAIVPAPILIFVAVLTFIVGQDHPAGKWSERHTLPAAAIAAKQGHQILHDHPEKQHTKSSSDSSQDEKDPEANTAVSVRPVIADEDLELVKSTVDVAINERLTLKSTVEILINPLTWLPSLAYLTTFGIELAIDSKFADVLFVLFSKKRPGFDQTTAGYYTSILGFLNLVTRPAGGYFGV

SEQ ID NO: 50203 - protein, 245 aa, Triticum monococcum
MDMSLEHSSSASSSSTTERGGTAWPWPPKRPAGRTKFRETRHPVFRGVRRRGNAGRWVCEVRVPGDRGTRLWLGTYFTAEAAARAHDAAMLMLRGRSAACLNFRDSAWLLSVPPAFSNLSDVRRAAVQAVADFLRRPEATGAFAGAAQEVTSSVTVPSAAACSVPSSETAQTSGDANFEEPGALSMDMFDLDCLFGETDSDTYYYANLAQGLLMEPPPSMATGAYWDNGDCADGGAGADVALWSY

SEQ ID NO: 50204 - protein, 346 aa, Zea mays
  misc_feature (111)..(111): Xaa can be any naturally occurring amino acid
MGRSALAVRLASLLAFGLVLVSVEASLGDVDPRYRTCVRECQATGIIGENVISHCQFKENYTSVGVSWYNQEQIYIQWKELNCRTDCRYFCMMQREGERQSLGLSPVNIMXKWPFLRGSVFQEPLSTALSAVNLLMHFTGWLSFFLLVNYQLPLRPQAKRTYYEYTSLWHIYAILSMNAWFWSSIFHTRDIDLTEKLDYSSAVALLGYSLILSLLRAFNVKVEASRVMFAAPILAFVTTHILYLNFYELDYGWNMKVCVVMAAVQLLTWAVWAGVSRHPSRLKVWTVVFGGALAMLLELYDFPPYMGYADAHSLWHASTIPLTCLLWSFIKDDAKFRTATLVKKAK

SEQ ID NO: 50205 - protein, 1106 aa, Coprinopsis cinerea okayama7#130
MHRIARITLPLTRHNVWSRNLKAQSLRHVSFTRANRNSDTGFVDNIDYEDFGSYRIILPEEPFVFGTAHIKPRSVPPHIKRPYYASTPTGNKPEFRGKIQLGGEEEHRLRESAKLARKVREYAGSLVKDGDIINIDVTIFKDGYHGDTSQTFLVGNVDEQGKKLVSITNQALNAGIAACGPGKHFRDIGKAIHDLVKDTNYSVRGRQLTVIEENDEPEIMEPGHCFTIETRLLNLNSHALYKERTREDGFSLMAGQHLQSSNFIRLYSFGQQVEANLRRLFENHGVPIATREDTHHGLYEFSLDGKPWANPKSVATEKLLVDIFAIIYQAGYSFLSSIDYGREHDDRLAMVFSKPSATPEASRTGTPLPPGGSPFLGANTTVESLPKPTTTEKRVPFALSFASTTLMRVIAPPLHLTPAILQAVRAAWPRGVVYEQKVGENSFEFKLKGYKWFEQDNFASDSLQCILSLLTSLDAHSFTLLTSLSLTNRSKVKDLWIFTGLVSDSTSSHEETSFSLEHSESHRSMQHRRQVSEPPALPTQSGSQPHGHTRAATEDMSQFHRQPSPPTTSLSQGPHLLRKPAPRAQVPVSVIQENDPDVDDDAEMPGGYDVPVNNRVNLPSVISNGQENMTGVGAGGYQYPPFDPNFRVQSVKDRPKTPPLLSVSSSPSTSPQRSPHRHETGGSGSRSPSRSGSQSGGGSPNAQGAITPSVIPPLLGGNAFKGDSDEMYRNSTLSTQTGSSDISSEIPIKWTGAVGGERPANRHKVPGGWQGTSSPIDEEDDPFANTTVNSRWNFPMNSPKPEDGGEQEKASTPIHETSSRVESPEILTTRGLRRSEAALVGVIAATSLSPSSGDGSGPSTPPRHSDGLRNSASRNSGRSVSATPVPPHVQTPPMKSSSSLGSSSGHGQGKEKDGKEPRESRKLVKPNTNSANSGASSGGGQGWVLVNVEGQTSSGSRTATPQMASHTPAFVSGSAGDTGGSIPTPIANLHATTLNTPPSSTSAAAPAPSSASPNTNSPSPVTAEMRAKAIVIVDALETSKGKKAESIASTDTKDTEGKSGSMSGVRRFFSLNKKNSFDGHYHGRGKDYPCEITIIVGSRGDYIRED

SEQ ID NO: 50206 - protein, 844 aa, Ralstonia solanacearum GMI1000
MPSPLICAERIRLQQRATDKTSAIRAAGRLLADTGCIDPAYIDSLLRRETVANTFLGHGVAIPHGMGEDRHLIRQTGIAVLQFPDGLEWHPGQTTHLVFAIAAQSDEHITLLRRLTRLLNDDARLRQLFSTQRAEDIVAALSQDAPAPAASAPGGDLAERLALTLNYPSGLHARPAAQWVETARRFAARVQVRHGAETADAKNLVALLQLGLAAGAALTLSAEGPDARAALTALQHTIRSLTAQERAQAARDTQAARTRQIARGWQPAADLPAIGGIGASPGLAIGTVHVMQPGVSAIPDHPVPLATGGDLLDRALADTRAELAALARDTAARLGEAEAGIFKAQAELLGDTDLMTLTCQAMVEGHGVAWSWHHAVERLAERLAALGNPLLAARAADLRDVGRRVLGHLDPALRGTAQALPDGPCILVAQDLSPSDTAALDTRRIAGIVTAQGGPTSHTAILTRTLGIPAVVAAGPAVLDVASGTQAIVDGSGGQLYLDPDAAAVAGAEAWLREDAARAQREQAERGLPARTRDGHAVEIAANVNLPAQAIEAVTLGAEGVGLMRTEFLFLERDHAPDEDAQHEVYAAMLGALGGRPLIVRTLDIGGDKQVPHLNLPKEENPFLGVRGARLLLRRPDLMEPQLRALYRAASGGGPLSIMFPMITSLGEVIALRAACERIRAELDAPAVPLGIMVEVPAAALLADQLAEHVDFFSIGTNDLTQYTLAIDRQHPDLAAEADSLHPAVLRLIQLTVQGAARHGRWVGVCGGLAGDPFGALLLTGLGVHELSMSPRDIPAVKARLRDAHVRQLTELAGQALACASAEDVRALEATLPAHRAGTEMAAA

SEQ ID NO: 50207 - protein, 210 aa, Triticum monococcum
MDNSGVVFYGGAYATVMSAPPKRPAGRTKFRETRHPVYRGVRRRGAAGRWVCEVRQPNNKSRIWLGTFASPEAAARAHDVAALALRGRAACLNFADSAALLAVDPATLRTPQDIRAAAITLAQTACPHDAPRSSVSAASAPAPAMVITQEAAAAPYDSYAMYGGLADLEQHSHCYYDGMSGSGDWQSISHMNVADEDGGYGAGDVALWSY

SEQ ID NO: 50208 - protein, 330 aa, Vitis vinifera
MEFVGKRGVDVGDELVVLFHHIQYACKRIAALVASPFNSTLGKHSGGGGAGGSDRDAPKPLDIVSNEIILSSLRNSGKVAVMASEEDDFPVWISDDGPFVVVTDPLDGSRNIDASIPTGTIFGIYNRLVELDHLPKEEKTMLNSLQSGLKLVAAVYVLYSSATILCTSFGSGTHAFTLDHSTGDFILTHPNIKIPPRGQIYSVNDARYFDWPQGLRQYIDTVRQGKGKYPKKYSARYICSLVADFHRTLMYGGVAMNPRSHLRLVYEANPLSFLVEQAGGRGSDGKIRILSIQPVKLHQRLPLFLGSPEDIEELESYGNVQQKVNPGYEV

SEQ ID NO: 50209 - protein, 212 aa, Triticum monococcum
MDAADAASPCDGHRTVWSEPPKRPAGRTKFKETRHPLYRGVRRRGPAGRWVCEVRVLGMRGSRLWLGTFTTAEMAARAHDAAVLALSGRAACLNFADSAWRMLPVLAGPFSTAKEIKDAVAVAVLAFQRQHPVASMAPLSPARTTDDEKEIDGSPAPSALSMSSELLNEHWFGGMDAGSCYSEFMESPDTRPWREDFELGGVETPPWSYLFD

SEQ ID NO: 50210 - protein, 274 aa, Opitutaceae bacterium TAV2
MKAIIPAAGLGTRFLPIAKAVPKEMLPLGDKPVIHYVVAEAAAAGFDEILIVISQGKECIQHYFAPNPDLERHLEKIGKLQALEDVRAVSRLARISYTYQKEMRGLGDAVLLGREFVGNDSLFAVLLGDTVMHQSSPLPAMRAAWEKWRQPSVCLERCPAERVSKYGVAGGTLREDGVFTLDRLVEKPAPDAAPRLRSADGVPLPFHAFAARYLFTPQIFDHLENTHAGFGGEIQLTDAMEQLRLRDGMLGVTWPGKRLDIGNPAGLIDAARLY

SEQ ID NO: 50211 - protein, 246 aa, Triticum monococcum
MDMGLEVSSSSPSSSSASSSPEHAAGRASLAKRPAGRTKFRETRHPVYRGVRRRGNAERWVCEVRVPGKRGARLWLGTYATAEIAARANDAAMLALGGRSAACLNFADSAWLLAVPPALADLGDVRRAAVEAVADFQRREAANGSLTVTATVTEEASCGAPEESSSESDSVGSSETSEPSADGEFEVPVAVDTDMFRLDLFPELDLCSYYASLAEALLVDPPAPVTTTYAYWDNGDGGADVALWSY

SEQ ID NO: 50212 - protein, 588 aa, Oryza sativa Japonica Group
MATTASKIIPQTLPEIPTTPEPQQYTKTAPDIPKSNNSRSSVPKLLQESDRGKLNHKLEPKEQKPNHHLKESVDVSSAKCPTEVSEEMVSEGIASQEKKVVEYESVNGSSTSFHTCEGSGPGKASGSARMTDRSETGERGSSSRCRPSTSSDISDESSCSSMSSTTKPHKSNDSRWEAIQTIRVRDGIIGLSHFRLLKKLGCGDIGSVYLSELSGAKSYFAMKIMDKASLASRKKLLRAQTEKEILQCLDHPFLPTLYTHFETDKFSCLVMEFCPGGDLHTLRQRQPGKYFPEQAVKFYVAEILLALEYLHMLGIIYRDLKPENVLVREDGHIMLSDFDLSLRCAVSPTLIKSSNPDAEALRKNSQGYCVQPACVEPSCVIQPSCAAPTTCFGPRFFSKSKKDRKPKPEIATQISPWPELIAEPSDARSMSFVGTHEYLAPEIIKGEGHGSAVDWWTFGIFLYELLFGKTPFKGSGNRATLFNVIGQPLRFPEYPIVSFSARDLIRGLLVKEPQHRLAYKRGATEIKQHPFFEGVNWALIRCASPPEVPKPVEIERPPKLPPSTSGTTDVSSGAPQKGSDGYLEFDFF

SEQ ID NO: 50213 - protein, 239 aa, Triticum monococcum
MGMGLEISSSSPSSSNENALVAKRPAGRTKFRETRHPVYRGVRRRGNAERWVCEVRVPGKRGARLWLGTYATAEIAARANDAAMLALGGRSAARLNFPDSAWLLAVPSAHSDLADVRRAAVEAVADLQRREAAGGSITATVNEEASCGAPAESSSESDDAGSSETSKPSARGDFALPGGMDVEMFSRLDLFPETDLGSYYASLAEALLMDPPPVATGTGAYWDDGEFGEVATEFALWSL

SEQ ID NO: 50214 - protein, 181 aa, Solanum lycopersicum
MASSIVSSAAAATRSNVAQASMVAPFTGLKSAASFPVTKKNNNVDITSLASNGGRVRCMQVWPPINMKKYETLSYLPDFSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 50215 - protein, 306 aa, Candida albicans SC5314
MATYSEMTFNSQHYDDSRPNYPQPFYKELIKYHTKKGDAKLAIDIGCGSGFVAFQLANYFDSVIGTDPSSTMIEQCNSNIPPEWLRNYPKKISFMKGTAEHHPVSIKENSVDLITGAECCHWVNHKQFFDESYRVLKSNGTLAYWFYKDPVFIGYPEANKVYTNYIYNSSFDESPDEEFERYMGPYYQQPGHDYLRSLMKEIEVPTDKFYDIVRHEYISNIHGAPKENEDPYITKTPLFIKKTITMKWFLDYVKSWSAYHTWMTHHGDKYDIAEKFVAELKQKMNWNDDTEIDVIWDTVYTFARKK

SEQ ID NO: 50216 - protein, 264 aa, Oryza sativa Japonica Group
MAGKDDDVKVLGVVVSPFAIRVRIALNIKGVSYEYVEEDIFNKSELLLTSNPVHKKVPVLIHGGKPISESLVIVQYVDEVWAAAPSVLPADPYDRAVARFWAAYVDNNVSTVLYTVLAMAMSPKLFDEQLLVISLVVLQMFPGMAGVLFAATEEERAAKAEETLAALAQLEKAFAECAGGKAFFGGDSIGYVDLALGSNLHWFEALRRLFGVALLDAGKTPLLAAWAKRFVEAEAAKGVVPDAGVAVELGKKLQARAAAASTAA

SEQ ID NO: 50217 - protein, 180 aa, Solanum lycopersicum
MASSVISSAAVATRSNVTQASMVAPFTGLKSSATFPVTKKQNLDITSIASNGGRVSCMQVWPPINMKKYETLSYLPDLSDEQLLSEVEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 50218 - protein, 236 aa, Oryza sativa Japonica Group
MAGSGELKLLGVWSSPYAIRVRVVLNLKSLPYEYVEENLGDKSDLLLASNPVHKSVPVLLHAGRPVNESQVIVQYIDEVWPGDAGGRPSVMPSDPYERAVARFWAAYVDDKVRPAWLAILFGSKTEEERAAAVAQAVAALETLEGAFGECSKGKPFFGGDGVGFVDVVLGGYLGWFTAIDKLIGRRLIDPARTPALAAWEERFRATDAAKGVVPDDADKLLEFRQTLLRWSASKAK

SEQ ID NO: 50219 - protein, 575 aa, Yersinia pseudotuberculosis IP 32953
MDAITINSLFLVGAVLVAASILLSSFSSRLGIPILVIFLAIGMLAGTDGLGGIAFDNYPAAYLVSNLALAVILLDGGMRTRASSFRVALWPALSLATFGVIITAGLTGLVAAWLFNLDIIQGLLIGAIIGSTDAAAVFSLLGGKGLNERVSATLEIESGSNDPMAVFLTVTLIAMIAAGETSLSWMFLVHLIQQFGLGIIIGLLGGGLLLLLINRMELANGLYPLLAVSGGILVFALATALNGSGILAVYLCGLLLGNRPIRNRAGILQTFDGLAWLSQIGMFLVLGLLLNPSDLLPIAIPALLLSLWMILFARPLSVFIGLLPFRSFNLRERVFISWVGLRGAVPVILAVFPMMAGLPNANLFFNVAFFVVLVSLLLQGTTLSFAARKAKLVVPPTLAPVSRIGLDIDMNNQWEQFIYQLSCDKWCIGATLRDLKMPQGTRIAALFRGKDLLHPTGSTRLKEGDILCVIGQEHDLPALGKLFSQSPNIQLDERFFGDFILDADAKLQDISQIYGLNLEPTVDKQQTLGQFVLYLFGGEPVIGDQIEWDGLTWTIAEMESDRVSRVGVKIVTDKA

SEQ ID NO: 50220 - protein, 485 aa, Bordetella bronchiseptica RB50
MTSSPDIGACAYIGGRWAQTPAARTFRTALPHDTRQSGREFGCATPADAEAAVARATAAAAPWAAVPALQRAEPLRKAAALLLERLDELTRLLALEAGKPLQEARGEVSAAAGFLHAYAGWPAWGGQGAVKRNGALRIVQEKFPRGVAAIITPWNYPLSNPCQKIGAALIGGNPVIWRPSVSTPAVSLALIEIMHQAGFPDGVFNALIEDGDAVSRALVASEAVAAVSFTGSTRVGLQVAAAAAGRGAAVQCEMGGKNAAVVMPDADLDLAAERIAFGAFGFAGQKCTAVSRVLVHRHIADAFLERLLDIVRDLRPGLPHQEESCLAPLISARQRDLLVDAIAQARERGARLIEGGAPIEQAPYAHGNYLSPALIQVHDLDDPLWTDEYFGPVLALRVCDDLDQAIAEVNATRYGLGAALFSHDARAIGRFTDQVQAGVVKINDVPPGLYPHVSTGGWKASGLGPNELSEDGVDFFLHKKSVYLA

SEQ ID NO: 50221 - protein, 481 aa, Zea mays
  misc_feature (92)..(92): Xaa can be any naturally occurring amino acid
WFLGYTCCDACGRLFVKGNYCPICLKVYRDSEVIPMVCCDVCEKWVHIECDGISEEKYQQFQADQNLQYTCAACRGECSQIRDTEDAIRELXKRRDVADHELMITLRAAAKLPSLEDVSPLYPNSDDEKLGAYVLKSESRNTLKFSLKSNSSKPPPDTPEQEKVVFKSSGSNKKPSKKKGGQGNKTNDGHDEIFLERRHDVKSSNSRLGDQSIDGNHDMSPFKNDDNAYISSSTRSSEKNLKSPSMKAVTNNADMIPKVKIKGSKVSSLHYKDGEENTSKADTGKATKLVIHLGSRHKTRSGSPKSELSNYQREQDLGSIHVPNFQICCALSSRTYLKMQSNKASTHRSWREMGALLDHLACSIAHRLTHVFKGNFRKANAVRTKAIQHHHPTPTAAGRARRCLVLVQVSPICVRQLVWHCRTGKRKKVPTRRSSRSRIVVSRMAQGRARCRQGDKEILKIVEKNKLRPGMVIDKLAYVRH

SEQ ID NO: 50222 - protein, 393 aa, Clostridium acetobutylicum ATCC 824
MVSEKMYELGSKRSVIREIFEFGKKRAEEVGVENVYDFSIGNPNVPAPEAVKKAILEILEEENPVDIHSYTSAQGDLKVRDTLAESINKRFSTSFSGNNLYMTVGAAASIHICFSALANPGDEFITFAPYFPEYRCFVEAAGGKLVVVPAKIEDFQIDFEEFEKRINEKTKAVIVNTPNNPSGVVYTEETITKLAKVLENKAKEYGHAIYLISDEPYREIAYDVEVPYLTKYYDNTFVCYSYSKSLSLPGERIGYIVVPSEMEEFNKVYAAICGAGRALGYVCAPSLFQKVVAKCAGITADISIYKKNRDLLYEGLIKLGYKCVKPEGAFYLFPQALEKDAYAFTEKAKKYDLLIVPGDDFGCPGHVRISYCVTTDQILRALPAFEKLAKEYK

SEQ ID NO: 50223 - protein, 230 aa, Microcystis aeruginosa PCC 7806
MHKTQREALEFLQDFKSHLDETPDDREVVLCAPFTALAVLSKTLHGGRIRLGAQNVHWEKSGAYTGEISADMLTEIGVHYVVIGHSERRQYFGETDETVNLRVISAQKQGLTPIICVGESKAQRDAGETEKVIIKQIQAGLVNVDQKNLVIAYEPIWAIGTGETCESEEANRVIGLIRQQLDNPEVTIQYGGSVKPDNIDEIMAQSQINGALVGGASLDPAVFARIVNYR

SEQ ID NO: 50224 - protein, 294 aa, Prochlorococcus marinus str. MIT 9313
MVLRSSIEAPSINKMQESSIGFSNRDLDMETPFRNVTPNTPGGTASLLIALLFSSFILITQALFVVPAGQVAVVTTLGKVSGGSRLPGLNLKIPFIQAVAPFDVRTQVRPEKFASLTKDLQVIEATATVKYAVRPNEAGRVYSTIASNDREIYPRIIQPSLLKALKSVFSQYELVTIASKWSDISELVERAVADELDKFDYVEVRGLDLTGLVIAEEYRAAIEQKQIAEQQLLRAQTEVKIAEQEAQRYETLNRTLDDQVLFKLFLDKWDGSTKVVPALPGSKGGGTPVIVGGR

SEQ ID NO: 50225 - protein, 174 aa, Picea sitchensis
MYMERMSGAMGRLKSLVGMEEEEEAQEEENIFLTDDLSRQCSLSPQQRMYGFAACLACGLFCTLLSLLVFLHPIKFAVTFTFGNLLSLGSTAFLVGPMRQLKMMFDPVRVVASAVFIGSMAIALFCALYIHSKLLTLLAIIIEFCALIWYSLSYIPFARAAAKKFMGSCFEAEF

SEQ ID NO: 50226 - protein, 239 aa, Ashbya gossypii ATCC 10895
MSDDKRLKEFQEQNKIVFDHSTRSVWENQDKDSSMGHLMGGSVVQSESKDSMDADHGTTSGIVPTLQNIVATVNLDCRLDLKTVALHARNAEYNPKRFAAVIMRIREPKTTALIFASGKMVVTGAKSEDDSKLASRKYARIIQKIGFSAKFTDFKIQNIVGSCDVKFPIRLEGLAFSHGTFSSYEPELFPGLIYRMVKPKIVLLIFVSGKIVLTGAKQREEIYQAFEAIYPVLSEFRKL

SEQ ID NO: 50227 - protein, 295 aa, Lupinus albus
MTYMFKYDSVHGHWKHDELKVKDSKTLDSVHGHWKHDELKVKDSKTLAESGAEIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSSKDWRGGRAASFNIIPSSTGAAKAVGKVLPVLNGKLTGMAFRVPTVDVSVVDLTVRLEKAATYDEIKKAIKEESEGKLKGILGYTEDDVVSTDFIGDNRSSIFDAKAGIALNEKYVKLVSWYDNEWGYSTRVVDLIAHFAKTI

SEQ ID NO: 50228 - protein, 316 aa, Zea mays
MRNGRKDSLYQNWRWQPRDCNLPKYKPRLLLEKLRNKRLMFVGDSLNRNQWESMVCLVQSVVPPGRKSLNKSGSLSVFRIEDYNATVEFYWAPFLVQSNSDDPDMHSILNRIIMPKSIQNHGKNWKDVDYLVFNTYIWWMNTFNMKVLRGSFDQGDTEYDEIDRPVAYQKVLTTWSKWVDKNVNPNRTTVFFSSMSPLHIKSLDWENPDGIKCALETTPILNQSMHLNVGTDRRLYVIASNITQNMKVPVHFIDITSLSEYRKDAHTSVYTIRQGKMLTPEQQADPATFADCIHWCLPGLPDTWNEFLYARIIAHS

SEQ ID NO: 50229 - protein, 447 aa, Bradyrhizobium sp. BTAi1
MLDKSPRPAVTVPNDLAAHWMPFTANRAFKKNPRLLAGAKDMHYITIDGRKIIDAAAGMWCCNAGHGRTEIAEAIGKQAAALDYAPPFQFGIPQAFELANRIADLAPAGLDHVFFCNSGSEAADTALKMALAYHQINGQGSRTRLIGRVRGYHGVGFGGTSVGGIVNNRKMFGTLLTGVDHIPATYDREKQAFTKGEPEYGAHFAEELENLVALHGANTIAAVIVEPMAGSTGVIPAPKGYLKRLREITQKHGILLIFDEVITGFGRLGHAFAAERYGVTPDLLTFAKGVTNGAAPMGGVVVRDTIHDAFMSGPEHMVEFTHGYTYSAHPIACAAGLATLDIYRDHKLFEHAKAIEPKWADAVMSLKGLPNVLDIRTVGLTAGIDLAPLPDAAGKRGYSAMEQAFHNTDLMLRIAGDTLALTPPLIISEDQIGEIVDKVGKVIKAVA

SEQ ID NO: 50230 - protein, 388 aa, Rhodospirillum rubrum ATCC 11170
MAPPSPPLMLTTGPVTAYPEVSEALSRPILYDGDDAFRGYYAQVLAMLGRVMGLSTPPVILQGEAILGIEAAAAGLIGPKDVVLNLVSGVYGQGFGRYALRAGAEVIELAVPFDAAIDPADVARSLRARPDIGVVAVCHHDTPSGTLNPLADIGAVVAAHGALLIVDAVSSFGGMEVFPEAVAADLFITSPAKCLGGTPGLSLLGVSDRAWAKMRANPQAPRGSFLSLLDWQDVIEDGRTFPVTPSIAEIYGLEAALARHLAEGERAVWARHALTARATRAGILALGLALWPTSEALCSPTTTAIRIPDGLSDKALRDHARDRSGVLLSLGRGATAGKVLRIGHMGPAAQPDHALRAVAALAAAASAQGLAVDRPAGESAVRAVIDGM

SEQ ID NO: 50231 - protein, 254 aa, Listeria innocua Clip11262
MRKPLVGINMKNYINTRAQTSEWLEATIPLLENFSDVDTFIFPSMGTLETTANLLAGTSFGFGPQNMAPEKSGPLTGEFSVESIIDLNANYVEIGHAERKNLFHEKTSEIAKKIKLALDEKITPVVCVGEEVHANDTNELKNALKKQIEALFQTINLAQWENVVLAYEPEWAIGKASSAETNYIESAHQALREIIRELGGDETLVRIIYGGSVSKENAAEIVRQKNVDGLFVGRFGHKPQNFADIVSIVSKTKG

SEQ ID NO: 50232 - protein, 499 aa, Glycine max
MEFLTLSVTVAAAAFSILFFFLRHAGAGAGSLPPVPAVPGLPVIGNLLQLKEKKPYKTFTQMAHKHGPIYSIRTGASTLIVLNSPLLAKEAMVTRFSSISTRKLSNALKILTSDKCMVATSDYNEFHKTVKRHILTNFLGANAQKRHHIHREAMMENILSQFSEHVKTFSDLAVNFRKIFVTQLFGLALKQALGSNVETIYVEELGSTLSKEDIYKILVVDIMEGAIEVDWRDFFPYLKWIPNRRLEMKIQNLYVRRKAVMKALMNEQKNRMASGKEVNCYFDYLVSEAKELTEDQISMLIWETIIETSDTTLVTTEWAMYELAKDKTRQDRLYEELQYVCGHENVIEDQLSKLPYLGAVFHETLRKHSPAPIVPLRYAHEDTKLGGYHIPAGSEIAINIYGCNMDNNLWENPNEWMPERFLDEKYDHMDLYKTMAFGAGKRVCAGSLQAMLIACTAIGRLVQQFEWELGQGEEENVDTMGLTTHRLHPLLVKLKPRIK

SEQ ID NO: 50233 - protein, 150 aa, Brassica napus
  misc_feature (52)..(52): Xaa can be any naturally occurring amino acid
  misc_feature (135)..(135): Xaa can be any naturally occurring amino acid
MADERDGGRLSDASDYSSEDEGTEDYRRGGYHAVRVGDTFKNGSYVIQSKLXGWGHFSTVWLAWDTLKSRYVALKIQKSAQHYTGGQPWTRSKIFENRLRKGDAEDKKCVVKLLDHFKHAGPNGQHVCMVFEYLXGDNLLSGIKYSDYRG

SEQ ID NO: 50234 - protein, 323 aa, Hebeloma helodes
GATFAIMTSLFQTLTQTYGLSSHVAWRAAFAIVPAPILIFVAVLTFIYGQDHPAGKWSERHTLPAAALAIKQGHQIPFDHAEKSDSSSKSTKDEKDPEANAEVSVRPVVAEEDLELVKSTVDVAVNEPLTLKTTVKILTNPLTWLPALAYLTTFGVELAIDSKFADVLFVLFSKKRPGFNQTTAGYYTSILGLLNLVTRPAGGYIGDVVYRHYGTKGKKAWTLICGLIMGAALLGGGFYLQNTRTSGDHNLALLMGVFSVAAIFSEFGNGANFALVPHCNAYNNGVMPGLVGSFGNLGGIIFALVFRFQTQVGRAFWIMGVMS

SEQ ID NO: 50235 - protein, 475 aa, Glycine max
MEIDSRFLNTGLLLVATILVAKLISAFIVPKSRKRVPPIVKGWPLIGGLIRFLKGPIFMLRDEYPKLGSVFTLKLFHKNITFLIGPEVSAHFFKASETDLSQQEVYQFNVPTFGPGVVFDVDYSVRQEQFRFFTEALRVNKLKGYVNQMVAEAEDYFSKWGPSGEVDLKYELEHLIILTASRCLLGREVRDKLFDDVSALFHDLDNGMLPISVLFPYLPIPAHKRRDQARKKLAEIFASIITSRKSASKSEEDMLQCFIDSKYKDGRSTTEAEVTGLLIAALFAGQHTSSITSTWTGAYLLSNNQYLSAVQEEQKMLIEKHGDRVDHDVLAEMDVLYRCIKEALRLHPPLIMLMRSSHTDFSVTTREGKEYDIPKGHIIATSPAFANRLGHVFKDPDRYDPDRFAVGREEDKVAGAFSYISFGGGRHGCLGEPFAYLQIKAIWTHLLRNFELELVSPFPEIDWNAMVVGVKGKVM

SEQ ID NO: 50236 - protein, 323 aa, Hebeloma helodes
GATFAIMTSLFQTLTQTYGLSSHVAWRAAFAIVPAPILIFVAVLTFIYGQDHPAGKWSERHTLPAAALAIKQGHQIPFDHAEKSDSSSKSTKDEKDPEANAEVSVRPVVAEEDLELVKSTVDVAINEPLTLKTTVKILTNPLTWLPALAYLTTFGVELAIDSKFADVLFVLFSKKRPGFNQTTAGYYTSILGLLNLVTRPAGGYIGDVIYRHYGTKGKKAWTLICGLIMGAALLGGGFYLQNTRTSGDHNLALLMGVFSVAAIFSEFGNGANFALVPHCNAYNNGVMSGLVGSFGNLGGIIFALVFRFQTQVGRAFWIMGVIS

SEQ ID NO: 50237 - protein, 107 aa, Triticum aestivum
  misc_feature (40)..(40): Xaa can be any naturally occurring amino acid
RSGISGSTHASASTDDSNGSDAPARKSFSQLDLDNDGLLXADELKPIIGKLHPAENFYAKQQADYVISQADTNKDGQLSLNEMIENPYVFYSALFTEDDYGSHDELR

SEQ ID NO: 50238 - protein, 239 aa, Triticum monococcum
MDLSSSSPSSSASSSPEHASGRASPAKRPAGRTKFRETRHPVYRGVRRRGNAGRWVCEVRVPGKRGSRLWLGTYLTAEAAARANDAAMLALGGRSARCLNFADSAWLLAVPSALSDLADVRRAALQAVADFQRWEAANGLVTRTAAEQAPSSAPAQSSSESDSADSSETSEASADGEFEVLATMDIDMFRLDLFPEMDLGSYYVSLAEALLMDPPSTATIIDAYRDNRDGGADVALWSY

SEQ ID NO: 50239 - protein, 198 aa, Bradyrhizobium sp. BTAi1
MPSKTSTSLPNILTYTRIAAIPVVVGCIYAQSIMDYPLWLRWVAVAVFIAAGVTDYLDGYYARIWNQQSAFGRMLDPIADKLLVASCLLMLAADNSIHGWTLWAAIVILCREILVSGLREYLAALRVSVPVTKVAKWKTTMQLIAIGFLLAGEAGDQIVPVVTMIGIVLLWTSAIFTIYTGYDYFRSGIHHLIEEDSR

SEQ ID NO: 50240 - protein, 351 aa, Zea mays
DAWGGRKETVDQSLRRRPIHHRSDEREEMKIIIDTDPGIDDSVAILMAFQMPGVQVLGLTTIFGNCTTEHATRNALILCEKASHLEVPVAEGSHEPLKGGKPHVADFVHGPDGLGNVDLPDPTIKKVEESATDFLVDKVSRFPGEVSVLALGPLTNIALAIKKDPSFVKNVKKIVVLGGAFFAAGNATPSAEANIHSDPEAADMVFTSGADIYVVGLNITTQVSFTDKDLLELRNSQGKYAQFLCDVCKFYLDWHTESYGAPESCFWFGPVIFLHDPVSFAALVRPELFTFKKGVVRVETQGICVGHTSMDMLLKKWNSENPWTGYSPISVAWTVDVPKVVAFVKELVTKP

SEQ ID NO: 50241 - protein, 347 aa, Glycine max
MQDLMDYVKERCERGEAMDIGEASFTTVLNSISNTFFSMDLAYYTSDKSQEFKDIIWGIMEEAGRPNVVDFFPIFRLLDPQGARRRMSGYFRKLIAFFDGLVEERLRLRALENGSRECNDVLDSLLELMLEDNSQVTRPHVLHLFLDLFVAGIDTTSSTIEWVMAELLRNPEKLEKVRQELQQVLAKGEQLEESHISNLPYLQAVVKETFRLHPPTPMLLPHKSEVDIELCGFMVPKSAQILVNLWATGRDSSIWTNPDEFTPERFLESDIDFKGHDFELIPFGAGRRICPGLPLASRTLHVVLASLLYNYDWKLTDGQKPEDMDVSEKYGITLHKAQPLLVIPIQA

SEQ ID NO: 50242 - protein, 255 aa, Triticum aestivum
RKRPSTDFLETIQKDVNPSMRAILIDWLVEVAEEYRLVPDTLYLTVNYIDRYLSGNEINRQRLQLLGVACMLIAAKYEEICAPQVEEFCYITDNTYFKDEVLDMEASVLNYLKFEMTAPTAKCFLRRFVRAAQVCDEDPPLHLEFLANYVAELSLLEYSLLAYPPSLVAASAIFLSKFILQPAKHPWNSTLAHYTQYKPSELCDCVKALHRLFSVGPGSNLPAIREKYSQHKYKFVGKKQCPTSVPAEFFRDAAC

SEQ ID NO: 50243 - protein, 380 aa, Hebeloma helodes
GAPKFKWSHLWEPAIVNPVNLKSYTIPIFNLSDPYARSFHLSWLGFFVAFLSWFAFPPLIPDAIKSDLHLSAAQVGNSNIIALCATFVVRIMVGPLVDRYGPRKVMASLLILGAIPSGLAGTAQSAEGLYVLRFFIGILGATFVPCQAWTSAFFDKNCVGTANALVGGWGNMGGGATFAVMTSLFQTLTQTYGLSTHVAWRAAFAIVPAPILIFVAVLTFIFGQDHPAGKWSERHTLPAAALAIKQGHQIPFDHAEKSDSSSKSTKDEKDPEGNAAVSVRPVVAEEDLELVKSTVDVAINEPLTLKTTVKILTNPLTWLPALAYLTTFGVELAIDSKFADVLFVLFSKKRPGFNQTTAGYYTSILGLLNLVTRPAGGYFG

SEQ ID NO: 50244 - protein, 241 aa, Triticum monococcum
MDMTGSDQQRSSPSSPSSSSHLKRPAGRTKFKETRHPVYRGVRRRGSAGRWVCEVRVPGKRGERLWLGTHLTAEAAARAHDAAMLGLIGPSTPCLNFADSAWLLAVPSALSDFADVRRAALSAVADFQRREAASGAATTSLAATVPVDDGSCSQSAQSSMENTGSSWTSSSSSLPSGDGMFAVPATLGCNMFELDMSGEMDLDTYYAYFAEGLLLEPPQPPVAGACWDTEGGGADAALWSY

SEQ ID NO: 50245 - protein, 380 aa, Hebeloma helodes
GAPKFKWSHLWESAIVNPVNLKSYTIPIFNLSDPYARSFHLSWLGFFVAFLSWFAFPPLIPDAIKSDLHLSAAQVGNSNIIALCATFVVRIMVGPLVDRYGPRKVMASLLILGAIPSGLAGTAQSAEGLYVLRFFIGILGATFVPCQAWTSAFFDKNCVGTANALVGGWGNMGGGATFAVMTSLFQTLTQTYGLSTHVAWRAAFAIVPAPILIFVAVLTFIFGQDHPAGKWSERHTLPAAALAIKQGHQIPFDHAEKSDSSSKSTKDEKDPEGNAAVSVRPVVAEGDLELVKSTVDVAINEPLTLKTTVKILTNPLTWLPALAYLTTFGVELAIDSKFADVLFVLFSKKRPGFNQTTAGYYTSILGLLNLVTRPAGGYFG

SEQ ID NO: 50246 - protein, 287 aa, Triticum monococcum
MPLVQTASGKTIKQCTPQDTKILTLPSQAQPALTLHRPPSTVRSSSSQHRPPSAMDMTGSDQQWSSSSSPSSTSSHPKRPAGRTKFKETRHPVYRGVRRRGNAGRWVCEVRVPGQRGERLWLGTYLTADAAARAHDAAMLGLLGRSAACLNFADSAWLLAVPPALADLAAVRRAALAAVADFQRRHASNSAATVPADEETSGASALSSADNASGSSATSQPWAEGTFEVPSALGSDMFELDLSGEMDLGTYYADLADGLLLEPPPSLDSGACWDTGDGGADSGLWSY

SEQ ID NO: 50247 - protein, 511 aa, Rickettsia akari str. Hartford
MLPPKIFFEKVKEIIWPIERKELKLFIPMALMMLCILFNFGALRSIKDSLVVPSMGAEIISFLKLWLVLPSCVIFTVLYVKLSNKLNFEYIFYIIVGSFLLFFLLFAYIIYPNQDIYHPNDEMINNLIASYPNFKWFIKIGSKWSYALMYIFAELWSAVVINLMFWQFANHIFDTSKAKRFYPVLGMVGNIGLIIAGSVLVLFSSGQNVIDSELLPYSFNASTGNAIMLQPIMSIIVTAGIMAMLLFRIINRFILTDSINVLDIKKVTAKTKTKLSVIESIKLVIHSKYIGRVALLIICYGLLINIVEGPWKAKIKELHPNTIDYVNFMGRFNIWMGISCVTFMIIGSNILRRLGWLISALLTPIMLSITGFMFFIFIIFIEEIGACFGDFNLLYAAIIIGAIQNILSKSSKYSLFDSTKEMAYIPLSLELRTKGKAAVEVIGTKFGKSLGAFIQSLIFIIIPTATFDSIIIYLLVIFIVIMSLWIWNVIKLNKEYIELCKMTYIQKYLKK

SEQ ID NO: 50248 - protein, 240 aa, Triticum monococcum
MDTAGAWPHFEGQEYRTVWPEEEYRTVWSEPPKRRAGRNKLQETRHPVYRGVRRRGREGQWVWVCELRVPAAGSRVYSRIWLGTFADPEMAARAHDSAALALSGRDACLNFADSAWRMMPVHAAGSFKLAAAQEIKDAVAVALKAFQEQQRPADASKAPSSTDSTSEESAPSITSNDLSGLDDEHWIGGMDAGSYYANLAQGMLMEPPAAGAWREDREQDDGVDTSLWSYWLDGFGCVKL

SEQ ID NO: 50249 - protein, 333 aa, Cryptococcus neoformans var. neoformans B-3501A
MTSPSASPPVASSKVNLQASHHLLSGALSGLSSAVVLQPLDLLKTRLQQSQEGIGSKRQKLRGVVKQVIKDDGISGLWRGTIPTLVRNVPGVAVYFYSLSAIRNRLSAVPYFSITVPVSGNKILTPSGQVKREAGSRSAIVKLSSGGNLLAGAVGRTSVGFVLSPITVIKARFESNRYSNYHSILGALSSLYRTQGVKGFYQGFTATAVRDAPYAGLYLVFYEKSKELAGRLPGVPNAALHSCSGIMAATLATIITSPADVIKTRMQVNPAEHPTLRKAIARVVQERGPLGFFSGTSLRISRKAASAAIGWTVYEGLLIFLRDRKGQPQTGAL

SEQ ID NO: 50250 - protein, 242 aa, Ralstonia solanacearum GMI1000
MPAAIDPSGFRIAPSILSADFARLGEEVRRVIEGGADWIHFDVMDNHYVPNLTVGPLVCEAIRPHAQRDGKPVPIDVHLMVRPVDRIIPDFAKAGADLITFHPEASEHIDRSLALIRDQGCKAGLVFNPATPLHYLDHVMDRLDMVLIMSVNPGFGGQSFIPEALTKLRAVRQKLDAYADRTGRRILLEIDGGVKADNIAEIARAGADTFVAGSAVFGKPDADGGYRGTVGALRSALEGITA

SEQ ID NO: 50251 - protein, 452 aa, Yersinia pseudotuberculosis IP 32953
MQTLPSEKIRMDDVPLNRFHIRIAGLTFGAHFIDGYILGLIGFALIKLKPIMALTPLWEGLLGSAALIGLFLGSLILGWISDYIGRQKIFSFSFVIITLASALQFFASTPEQLFILRVIVGIGIGGDYSVGHTLLAEFSPRKHRGVLLGAFSVIWTFGYVSASFVGHYLSMVSPEAWRWLLSSAALPALLILLVRIGTPESPRWLMGKGREDDAMAIVHKYFGPNVTLIDEEPATSTRRFLSLFGRKYWRRTAFNSLFFVCLVIPYFAIYTFLPSILNVMALSQNFATDLLLNGLLVVGALVGIVLTAFCSRRSFLISSFIFLATCLLLLSILPSNQTFWLIALFAAFTLVMSAVSNLVGVFPAESFPTEVRSMGVGFATSMSRLGSAIGTSLLPLAIVNYGMPVTTTLLAFVLIIGAIVSIAWAPETKGLTLVDASQSATTPRPPSSIIPN

SEQ ID NO: 50252 - protein, 471 aa, Mycobacterium tuberculosis CDC1551
MSLRELMLRRRPVSGAPVASGASGNLKRSFGTFQLTMFGVGATIGTGIFFVLAQAVPEAGPGVIVSFIIAGIAAGLAAICYAELASAVPISGSAYSYAYTTLGEAVAMVVAACLLLEYGVATAAVAVGWSGYVNKLLSNLFGFQMPHVLSAAPWDTHPGWVNLPAVILIGLCALLLIRGASESARVNAIMVLIKLGVLGMFMIIAFSAYSADHLKDFVPFGVAGIGSAAGTIFFSYIGLDAVSTAGDEVKDPQKTMPRALIAALVVVTGVYVLVALAALGTQPWQDFAEQETAGLAIILDNVTHGEWASTILAAGAVVSIFTVTLVTMYGQTRILFAMGRDGLLPARFAKVNPRTMTPVHNTVIVAIFASTLAAFIPLDSLADMVSIGTLTAFSVVAVGVIVLRVREPDLPRGFKVPGYPVTPVLSVLACGYILASLHWYTWLAFSGWVAVAVIFYLMWGRHHSALNEEVP

SEQ ID NO: 50253 - protein, 472 aa, Pseudomonas fluorescens Pf-5
MAIQPDAFFQQFDDSKLVAADKAHYMHGFHMFDEHREQGSLNIAAGDGAYIYDTAGTRYLDAVGGMWCTNIGLGREEMAEAIADQVRQLAYSNPFCDMANVSAIELCQKLASLAPGDLNHVFLTTGGSTAVDTAYRLVQFYQNSRGKHEKKHVISRHNAYHGSTFLTMSIGNKAADRAPEFDFMSDLFHHISCPNYYRAPAGMSEADFLEFLVAEFEDKILTLGPDKVAAFFAEPIMGSGGVIIPPEGYHRRMWEICQRYDLLYVADEVVTSFGRLGAFFASEEVFGMQPDIITTAKGLTSGYLPLGACIFSERIWQVIGEPGKGRCFTHGFTYSGHPVSCVAALKNIEIIERENLLAHVEEVGVYMEQRLQTLAELPLVGSVRCKRLMACVEFVADKRTKALLPDGLNIAERIHLRAQAKGLLVRPIGHLNVMSPPLIITRQQIDEIVATLRDCILEAAAELRQNGQYLGQ

SEQ ID NO: 50254 - protein, 494 aa, Bordetella bronchiseptica RB50
MTIGARLQHVIDGGPWPSIHCNGRVGSLIGGDIVPGNGAMIEVLDASTGEPLFRYLDGSDGLVRRAAESAAAAQVRWAVMPADGRAAVLLAVSAAIRANLARLAELEAVTAARPIRDCRAQVDRVADMFQYYAGWCDKFYGDVIPVPNQYLNYTMREPIGVLLHIVPWNSPLFMAAWHLAPSLATGNAVLLKPSELTPLSAIALVRIAESAGLPTGLVAVLAGLGHTMGNAAIEHPLVRKIGFVGSPETGAKVAGAAARVVKPCVLELGGKSANIVFPDADLDQLCEATVKSMFIGAGQTCVAPSRLIVHRSLEQQVVERLLDAASTLEMGLPELDSTAIGPIHNRRQFDHVNRMIEQGRRDGARCRQAGNAVPQRGLYVPPTIFTGVARDGALARQEVFGPVMACLPFDTEQEAIDLANDTEFGLAGAVWTHDVKRAHRVAAAINAGTVWINTYKSTDIRSPFGGIGLSGYGRSSGHEALQEYTRLKSIWVAT

SEQ ID NO: 50255 - protein, 261 aa, Persea americana
QVHPNSYALVVSTENMTLNWYSGNNRAMLVTNCLFRMGGAAILLSNRWSDRRRSKYQLVHTVRTHIGADDRAFNCVSQEEDEAGKVGVSLSKDLMVIAGEALKSNITTLGPMVLPMSEQLLFFATLAARKVFKMKIKPYIPDFKLAFEHFCIHAGGRAVLDELQKNLELSDWQMEPSRMTLYRFGNTSSSSLWYELGYSEAKGRVMKGDRMWQIAFGSGFKCNSAVWRALRSVNPAKEKSPWMDDIDSFPVHVPKVTTIQS

SEQ ID NO: 50256 - protein, 727 aa, Pseudomonas syringae pv. phaseolicola 1448A
MYDSLCDIVHDQTFLKVSGLGADFFLKMESLNPAGSIKLKTAVGLINDLQTRGLLGPDTILIESSSGNLGVALAMICAERAIPFTCVVDPNSSSHNVRMMRSYGAEVIQVQAPDANGGFLGTRIALIREKLASDPRYVWLNQYENAANPRAHARTTARSISQHFGHVDYLFVGAGTTGTLMGCVQHFQRHHPSTRIIAVDSVGSVTFGTPASRRFIPGLGTSQHPPIYKADGIYALEMVPESRTVAMCRILARSKGLLVGGSTATVIAAVHVWRERIEPGSVVVALSPDWGERYLDTLYDDQWVEQRFGREVLNMTLADLSSPEAATFPGSVKTPSRASSLPQDVCESVVCTCASPCGSELARESGESATAPSGAGALAQEQCSTFWLAAERLKQAAFHVVDGEVVARLLAADPLACIEDVQAAYLAHEAGRTINPDSYFLRFPEAPANRIIALPASLSGEQAVSGIKWISSFPGNIETGLQRASAVLILNDPLTGYAFACLEASRISAMRTAASAVLGARWMNRHQRHVGRMAFIGAGFIARTILDMFVSDGWTMDAITVFDQHDDSALALVRHAASRHQLNSQPSDLPTALQADVVVFATTAPRPYVLEPLLRPGQLLLNISLRDLGPYVIAQANNILDDVEHCLKAQTSPDLAVQQYQDRSFITGTLAQLMTGQVELSPDRASIFSPFGLGVLDLAVGQRVYRQAVAEGSALPVPTFFFESKRW

SEQ ID NO: 50257 - protein, 139 aa, Picea sitchensis
MNLIRAKSIEKGWDLKLGELARIWKGGCIIRAVFLDRIKKAYDRNPDLASLLIDPEFAKEMVERQSAWRRVVTLAINAGISVPGMSASLAYFDSYRRDTLPANLVQAQRDYFGAHTYERTDMPGFFHTEWFKIAKQSKI

SEQ ID NO: 50258 - protein, 364 aa, unidentified eubacterium SCB49
MKTLTEAEKVQYSRHLLLNDVGESGQLKLKAAKVLVIGAGGLGCPIIQYLTASGVGTIGIVDDDIVSTSNLQRQVLYDITEIGNPKVNVVITKMKQLNPHISFKGFKQRLTRENALDIISNFDLVIDGCDNFQTRYLVNDACIILNKPWIFGAIFKFNGQLSVFNYKNGPSYRCLFPEPPSTGETPACNEAGVLGILPGILGTKMASEGLKLILGLGKLLSGKLQLINILESSIQTVQFERNQKNFQIKILAKNYNAFCGLPTRADRASITSEMLQKKLNEEKNNLQLLDVRTEEEYKAFHLNNSIHIPLNELEDNYSLLDLSKETVIMCAKGRRSLEAVLYLKSKGFKKILNLENGLNTWQKT

SEQ ID NO: 50259 - protein, 142 aa, Escherichia coli
AIERTFSIIKPNAVAKNVIGNIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 50260 - protein, 349 aa, Magnaporthe grisea 70-15
MSVPSFITAPEFEGGPPQGLSIPFRLRWSKTHPPKEPIVTFKGRTVLVTGANTGLGFEAAVKYAAFGADKIILAVRSIEKGEEAKKRIVERTGRDATDISVLKLDLGEYSSVKDFVSALHEVTPTLDVALLNAGLGNPTYEKSSAGWEMAVQVNVLSTALLAMLLLPLLRSSAAASGAKSHLTFVNSFAHTLVPRDFPLIEGSILKTATDESSWNASSSYNIVKLLAMASVQGFARMEAGEDQQRVIVNSVCPDLCETDLGRKFTGFISSIGKAIFYYLFALSAEEGARCLIGATALGPESHGRFWHHDFLYPFGELAQDQALMKKTWNEIIEAVGRDEPEILQLCRTT

SEQ ID NO: 50261 - protein, 378 aa, Corynebacterium diphtheriae NCTC 13129
MFPSDRSHVDPFRVMQILGEAQSRDDALLLCVGQPSTGAPRAVIERVHSRIDASALGYTATLGIPELREAIAQWHAQKYGIDTAARNVVVTTGSSGGFVALFLAALDHGDPIAMTRPGYPAYRNALTALGAKIIDLPCGAETRFQPTVEMLEACVEKPKALIVTSPDNPSGTIIDGAELARITDWCERNSCLLISDEIYHGITYGRECHSAREYSDKAVVVGSLSKYFSMTGWRLGWLIVPDELVEALDNLQANLALCPPAVSQEAALAAFGPEARAELESHVQRYARNRALLLKRLPELGLGKCAPPDGGFYLYIDVSEHTDDSEVWVRELLNATGVALAPGVDFDPVDGHRFVRLSFCGEYEEILQACERLRTFMP

SEQ ID NO: 50262 - protein, 103 aa, Saccharum officinarum
AGELKAKGVETVACVSVNDAFVMKAWKESLGLGDDVLLLSDGNLELTRALGVEMDLSDKPVGLGVRSRRYALLAEDGVVKVLNLKDGGASNDGSAREMLKVLG

SEQ ID NO: 50263 - protein, 308 aa, Opitutaceae bacterium TAV2
MSSRRKVILDTDIGTDIDDAACLAWLLAQAGAGRCDLLGITTVCSDVVARARLASALCWAAGRDDITIHAGVERPLLISPLHGRANQAEALARWDHRTDFIPGNAVGFLRDTIYRHPHEIDLLAIGPLTNIAALFACHPETAALLKSITLMGGVVSGLYWGSPMEYNFYCDPHAAQIVLQSGAPHLRVVPLDVTTKLVMKATEVRSRFTHPLLRVVADFSKSWFAHREELTFHDPLTAVTLFNENVCAFSPCTLEIELGAERLKGYLHWQPDAPDAIQPGSHQIALGVAPDVFFDDYFAAFDPQPAVT

SEQ ID NO: 50264 - protein, 1027 aa, Debaryomyces hansenii CBS767
MSVQLSTPPLSKDKSSEKSTTPKSSKKKFFSNLLHRKNKNETSPNLGLNNGLKSRSSSASTKVSSSPSLTNKLKRQSWVSNNSKRTSRSQVRGRSKGPDVSGNCIDDDDDSVFNYAEEDEIEDSRNVFDMTSSLSSLSHAMSSHSLNELGVRHNNSSNTNIGDMINLTMQSTDAQPQPWDGLTPESLVVPQYVKTHRRNKHSPRALNNLFLAQELNVESCASKNHNDNDSISSESLKQGTSSDDDHDEILYEHETQATSEFFSDSQGYSKRPAHKRKNKNDFNEVYVMEFSRDGKYLAVAGRNSIIKIWKVISSPLSRLEQKNAESLNENSKSKKTNKNLYKGAPVFHQAPVRVFKGHTHSVLSLDWSKNNFLISGSMDRLVKLWHVDRLDCLETFQNDDFVTTVKFHPMDDRFFLSGSLDNQVRLWSILEKNIAYNKDLGDDILITAASFTPDGQHCIVGGFNGSIFALEINGLHVINRFEVKEKSFVHSFHNKNGNKITGIKIFESREYSRLKIIDDDPLAKWNFLITTNDSKIRLVNSDLKKLVTRFKGLTNTSSSIVADMTDDFHYIVSGSEDHWCYVWENNNSIINNKLKLALKDLVLEGKNHINDLQSKHKSYAKLIHKNPLMKKLNVQKFLDDENAIEYVANENNSYVAFHPHHSKVNVAVFAPENTKKLLELSDDLIFELIKRGKKYNLGGVEDDKSLENDNPDDFSSEIGVNGGHIIITTDQYGLIRVFRQDSAYEVRKKLRDILKLKKENCSKLKSDSKVNSCNQLCDSKTNKNNLRLDLPRSRSTRLANNRSLSPSNDGYFALKNKLHSRIKGNSNGISNTSSSLSTMDGKSSNPGTPSSMYQISDHRSSSQSNLPRFVSSSSLVNGATLHNTSSSGIMSQVDATVDIRNDDIDSISMSEKSYIPETGNTSLNAPESAYTLTLTPSNDNKSSRTLTATPPVSSTKTEVFPALDNQKKGIPLLINTGSTVDNKEDKSEIINFHTLANDSINMDRAFEGPNSNNSSFYNAENNTRGRM

SEQ ID NO: 50265 - protein, 311 aa, Desulfitobacterium hafniense DCB-2
MSKIARSLTDLIGNTPLLELSNYNRTTELEAKVIAKLEYFNPLSSVKDRIGYAMIKDAEEKGLLNKDTVIIEPTSGNTGIALAFVSAARGYRLILTMPETMSVERRNLLKALGAELVLTPGPAGMKGAIQKAEELAAEYKNSFIPQQFNNPANPEIHRQTTAEEIWRDTDGEVDIFVAGVGTGGTVTGVGEALKQKKPGVKVIAVEPADSPVLSGGTPGAHKIQGIGAGFVPGVYSSEVIDEIFQVKNEEAFETSRKLSKTEGLLVGISSGAAAYAATQIAKRPENKGKNIVVLLPDTGERYLSTVLFQEG

SEQ ID NO: 50266 - protein, 488 aa, Hebeloma helodes
KWSHLWEPAIVNPVNLKSYTIPIFNLRDPYSRAFHLSWLGFFVAFLSWFAFPPLIPEAIKSDLHLTGAQVGSSNIIALSATLGIRIIVGPLVDRYGPRKVMACLLVLGAIPSGLAGTAYSAEALYALRFFIGILGATFVPCQAWTSTFFDKNCVGTANALVGGWGNMGGGATFAIMTTLFEALTKTYGLSAHVAWRAAFAIVPAPILLFTALITMVFAQDHPAGKWSERHTLPAAAIAHRDGDQLDLRRHEKGSHSSSDSKNEKDTEAVTVHPVIAEEDLDLVKSTVDVAINEPLTLETALRILKNPLTWLPALAYLTTFGIELAIDSKFADILYTLFRKRLPGFTQTTAGYYTSILGFLNLVTRPAGGYIGDVVYRRYGTQGKKAWTLICGLIMGAALVGGGVYMENTRVAGDAISILMGAFSVAMIFSEFGNGANFALVPHCNAYNNGVMSGLVGSFGNLGGIIFALIFRFVPHAGKAFWIMGVIS

SEQ ID NO: 50267 - protein, 151 aa, Triticum aestivum
TRTVKIADFGVARHEAANPSDMTGEIGTLGYMAPEVLNGNAYNRKCDVYSYGICLWEVYCCDMPYADLSFSEVTSAVVRQNLRPEIPRCCPSAFANVMKRCWDANPDKRPEMAEVVTMLEAIDTSKGGGMIPVDQARGIGCLSCLRPRRGP

SEQ ID NO: 50268 - protein, 494 aa, Hebeloma helodes
GAPKFKWSHLWEPAIVNPVNLKSYTIPIFNLRDPYSRAFHLSWLGFFVAFLSWFAFPPLIPEAIKSDLHLSGVQVANSNVIALSATLGMRVIVGPLVDLYGPRKVMASLLVLGAIPSGLAGTAYSANALYVLRFFIGILGATFVPCQAWTSAFFDKNCVGTANALVGGWGNMGGGATFAIMTSLFEALTKTYGLSAHVAWRAAFAIVPAPILLFTALLTMVFAQDHPAGRWSERHTLPAAAIAHRDGDQLDLRRPEKELHSSSDSKNEKDTEAVTVHPVIAEEDLDLVKSTVDVAINEPLTLRTALKILKNPLTWLPALAYLTTFGIELAIDSKFADVLYTLFRKKIPGFTQTTAGYYTSILGFPNLVTRPAGGYIGDVVYRRYGTQGKKAWTLICGLIMGAALVGGGVYMENTRVAGDESLSILMGAFSVAMIFSEFGNGANFALVPHCNAYNNGVMSGLVGSFGNLGGIIFALIFRFVPHVGKAFWIMGVIC

SEQ ID NO: 50269 - protein, 382 aa, Hebeloma velutipes
GAPKFKWSHLWEPAIVNPVNLKSYTIPIFNLRDPYARSFHLSWLGFFVAFLSWFAFPPLIPEAIKSDLHLSAAQVGNSNIIALCATFVVRIVAGPLVDRYGPRKVMACLLILGAIPSGLAGTARTAEGLYVLRFFIGILGATFVPCQAWTSAFFDKNCVGTANALVGGWGNMGGGATFAIMTSLFQTLTHAYGLSTHVAWRAAFAIVPAPILLFVAVLTFIFGQDHPAGKWSERHTLPAAALAVEEGHQIPLDHPEKKSTLSSESKDEKDVEGNAAVSVRPVIAEEDLELVKSTVDVAINEPVTLKTTVKILTNPLTWLPALAYLTTFGVELAIDSKFSDVLFVLFSKKRHGFNQTTAGYYTSILGFLNLVTRPAGGYFGVL

SEQ ID NO: 50270 - protein, 288 aa, Triticum monococcum
MDMGSEQWSSPSTSASSRDQHAAAPPKRPAGRTKFKETRHPVYRGVRRRGGAGRWVCEVRVPGRRGCRLWLGTYVTAESAARAHDAAMLALGGRSAACLNFPDSAWLLAVPCALADLADVRRAALAAVAGFQRREAASGAATVPVDEVFDTSSADDAGSWSWATPQPSCAAADGMFEVPAAALASDMFDFEFDVSWVMDLGSPATSQPGCADKVLEVPAAALGGGDMFEFDLELDMSGEMNLVGSYYADFAEGLLLEPPQPADATEARWRNGDYCGGDGGGDAALWSQ

SEQ ID NO: 50271 - protein, 136 aa, Brassica napus
GNSSALFLTAAAQNLLCLKLAEELGVVIANPWVSWFKAASLPAIISLLCTPLILYKLYPPETKDTPDAPGIAALKLKQMGPVTKNEWIMVGTMLLAVTLWICGETLGIPSVVAAMIGLSILLLLGVLNWDDCLSEK

SEQ ID NO: 50272 - protein, 318 aa, Hebeloma truncatum
AIMTSLFQSLTHTYGLTTHVAWRAAFAIVPAPILLFVAVLTFIFGQDHPAGKWSERHTLPAAALAVNQGHQIPLDHAEEKSSSSESGKEEKDAEGNAAVSVRPVIPEEDLELVKSTLDVAINEPLTLKTTVKILTNPLTWLPALAYLTTFGVELAIDSKFSDVLFTLFSKKRPGFNQTTAGYYTSILGLLNLVTRPAGGYIGDVVYRHYGTKGKKAWTLLCGLIMGAALLGGGLYLQNTRTSGDEISVLMGVFSIAAIFSEFGNGANFALVPHCNAYNNGVMSGLVGSFGNLGGIIFALVFRFQTQLGRAFWIMGVIS

SEQ ID NO: 50273 - protein, 322 aa, Hebeloma truncatum
GATFAIMTSLFQSLTHTYGLTTHVAWRAAFAIVSAPILLFVAVLTFIFGQDHPAGKWSERHTLPAAALAVNQGHQIPLDHAEEKSSSSESGKEEKDAEGNAAVSVRPVIPEEDLELVKSTLDVAINEPLTLKTTVKILTNPLTWLPALAYLTTFGVELAIDSKFSDVLFTLFSKKRPGFNQTTAGYYTSILGLLNLVTRPAGGYIGDVVYRHYGTKGKKAWTLLCGLIMGAALLGGGLYLQNTRTSGDEISVLMGVFSIAAIFSEFGNGANFALVPHCNAYNNGVMSGLVGSFGNLGGIIFALVFRFQTQLGRAFWIMGVMS

SEQ ID NO: 50274 - protein, 448 aa, Rickettsia akari str. Hartford
MLKIIISAILKLFTLNQIIMSQKLGFWAVFALVTGSQIGTSVFILPLSLAPFGIYSVWGWVLSLFGAMSIALVFSFLCAQFPKTGGPHVYVRESFGDTIAFFTGFTYWVISFVSTSIVVISAIGYLTPFFQSQTILDLILQIILLTAIAILNLKGPEVAGKAEFYLTLLKFVPLLVVGLAALSHFNIDNIVIAKEVENLSIPTIIGRVALLTFWGFIGVECATTTAGAVKDPATTIPKAIIVGTFCVSGLYIINSIGIMGLIPASELINSKAPYADAAALLFGGKWSSVIAVIASIICIGTLNAWVLTSGQIALGLAEDGLLPKFFAKKNSNNAPTYGIILSCLGIVPLLAFTSNDNFAEQITQIIDFSVIAFLFVYLICSLASFKVIRSSKEKFSSYYLLIALISIIFCAWVIYATPVKTLIIACSFTISGIPLYYGWYRGRNRTKL

SEQ ID NO: 50275 - protein, 548 aa, Mycobacterium tuberculosis CDC1551
MSDARVPRIPAALSAPSLNRGVGFTHAQRRRLGLTGRLPSAVLTLDQQAERVWHQLQSLATELGRNLLLEQLHYRHEVLYFKVLADHLPELMPVVYTPTVGEAIQRFSDEYRGQRGLFLSIDEPDEIEEAFNTLGLGPEDVDLIVCTDAEAILGIGDWGVGGIQIAVGKLALYTAGGGVDPRRCLAVSLDVGTDNEQLLADPFYLGNRHARRRGREYDEFVSRYIETAQRLFPRAILHFEDFGPANARKILDTYGTDYCVFNDDMQGTGAVVLAAVYSGLKVTGIPLRDQTIVVFGAGTAGMGIADQIRDAMVADGATLEQAVSQIWPIDRPGLLFDDMDDLRDFQVPYAKNRHQLGVAVGDRVGLSDAIKIASPTILLGCSTVYGAFTKEVVEAMTASCKHPMIFPLSNPTSRMEAIPADVLAWSNGRALLATGSPVAPVEFDETTYVIGQANNVLAFPGIGLGVIVAGARLITRRMLHAAAKAIAHQANPTNPGDSLLPDVQNLRAISTTVAEAVYRAAVQDGVASRTHDDVRQAIVDTMWLPAYD

SEQ ID NO: 50276 - protein, 491 aa, Pseudomonas fluorescens Pf-5
MSDSNAVYRDLHLQPIAGQWRAGASGKTLVVSNPFDGAQLLELAQANRSDLDAAYAKAAQVQPQWAALGPSQRAAVLHQAVAIFDRRQEEIVDWIIRESGSTRIKALAEWGAARAITLEAASFPARVHGRIVESDVPGKESRVYRSALGVVGVISPWNFPLHLTQRSIAPALALGNAVVVKPASDTPVCGGLLLARIFEEAGLPAGVFSVVVGAGSEIGDAFVEHPVPALITFTGSTPVGRGIGRIASGGEHLKHVALELGGNSPFVVLDDADLEQAVNAAVFGKFLHQGQICMAINRIIVDERLYDAFAQRFVARVKQLKVGDPQSLDTVIGPVINARQLQGLQDKIALAREQGAEPLYEGGQNGNLLAPHVYGEVRADMDLARNEIFGPLVGLLRARDEAHALELANDSEFGLASAVFTGNLERGVNFARQVRAGMTHINDVPVNDEANAPFGGEKNSGLGRFNGDWAIDEFTRDHWISLQHRPRQYPF

SEQ ID NO: 50277 - protein, 144 aa, Brassica napus
LNFGEVSPYLGYNSLKDFFPTMQMRPNPQCSNAACMERQKEYMLAKPARDAAAKAKMEADALTAVDDGPLHDDNEWNISVVDDENEKDAAKASSSSDTLPEGLTRELPVADEYEKAIAIGSGEAEEEEDDLEDLKKQLEALNAA

SEQ ID NO: 50278 - protein, 520 aa, Arabidopsis thaliana
MASIGLYEAFIGFLCFLISFYFLVKKPFSYLLIKKTLQSYPWNWPVLGMLPGVLLRLQRIYDCSVEVLENSNMTFQFKGPWFVGMDVLATVDPANIHHIMSSNFSNYIKGPIFHEIFEAFGDGIINTDAELWRDWRNASQLIFNHQRYQNFSASTTKTKVNDGLVPLFNHFANEEIVVDLEDVFQRFMYDITFIFITGTDPRSLSIEMPEVEFSKALDDVGDAIVHRHITPRFVWKLQKWIGIGTEKKMLKAHATFDRVCEKIIAAKREELGSQGITYNSNGEREDLLTSFIKLDATKYEVLKPSHDKFLRDFTIGFMAAGRDSTASTLTWFFWNLSKNPNVLTKILQEINTNLPRTGSDQDMSSYLNKLVYLHGALSESMRLYPPIPFQRKSPIKEDVLPSGHKVKSNINIMIFIYAMGRMKTIWGEDAMEFKPERWISETGGVRHEPSYKFLSFNAGPRTCLGKNLAMNLMKTVIVEILQNYEIKIVSGQKIEPKPGLILHMKHGLKVTMTKKCSSLE

SEQ ID NO: 50279 - protein, 310 aa, Mycobacterium tuberculosis CDC1551
MSIAEDITQLIGRTPLVRLRRVTDGAVADIVAKLEFFNPANSVKDRIGVAMLQAAEQAGLIKPDTIILEPTSGNTGIALAMVCAARGYRCVLTMPETMSLERRMLLRAYGAELILTPGADGMSGAIAKAEELAKTDQRYFVPQQFENPANPAIHRVTTAEEVWRDTDGKVDIVVAGVGTGGTITGVAQVIKERKPSARFVAVEPAASPVLSGGQKGPHPIQGIGAGFVPPVLDQDLVDEIITVGNEDALNVARRLAREEGLLVGISSGAATVAALQVARRPENAGKLIVVVLPDFGERYLSTPLFADVAD

SEQ ID NO: 50280 - protein, 229 aa, Mycobacterium tuberculosis CDC1551
MLTAMRGDIRAARERDPAAPTALEVIFCYPGVHAVWGHRLAHWLWQRGARLLARAAAEFTRILTGVDIHPGAVIGARVFIDHATGVVIGETAEVGDDVTIYHGVTLGGSGMVGGKRHPTVGDRVIIGAGAKVLGPIKIGEDSRIGANAVVVKPVPPSAVVVGVPGQVIGQSQPSPGGPFDWRLPDLVGASLDSLLTRVARLDALGGGPQAAGVIRPPEAGIWHGEDFSI

SEQ ID NO: 50281 - protein, 378 aa, Leuconostoc mesenteroides
MVNMDEVLSIHQAHTGVLDIESCFDITTPTDLSEAYTPGVAGLAKLIAKDTSKKRDYTMSGKLIPVITDGSAVLGLGNIGPAAGLPIVEGKALIYKNFANVDALPMALNQMSVDQFVDTVKAIAPSFAGIHLEDISAPKVFEIERRLSNELDIPVYHDDQTGTAIVVLAGIMNAAKVVGKNVHDLKIVVNGIGRCTAGVATTKILIAAGICNITLVDINGVINLGDANSNSYQQELVREVTQVDGKTLDDVIANQDVFIGLSDANVLSGKQVARMNENPIIFALANPVPEISPDDAKKAGAAVIATGSSQWPNQVNNVLVFPGLFKGLLESGIKHVDMALQLNVAHALANMISEPDATHIVPAVFDDDVGELGRNSSS

SEQ ID NO: 50282 - protein, 488 aa, Bacillus licheniformis ATCC 14580
MNVKQLNSEWFSNVRGDILSGIVVALALIPEAIAFSIIAGVDPMVGLYASFCIAVVISFTGGRPAMISAATGAMALLMGTLVRDHGLDYLFAATILTGIIQLIFGVLKIARFMKFIPRSVMVGFVNALAILIFMAQVPHFVGVSNMTYVVAGITLLIIYVLPRFTKAVPSALVAIIAMTVFAIFGHFDLRTVGDLGEMKQSLPAFMIPNIPFNFETLAIIFPTAFALSIVGLLESLLTSSIVDDMTDTESDKNRESRGQGIANIVAGFFGGMAGCAMIGQSVINVKSGGRGRLSTFVAGVFLMFLIMVLGDWVVQIPMAALAGVMIMVSIGTFDWSSFSMLRKVPLTDSIVMIVTVVTVVATHDLSKGVFAGVILSAIFFVAKISKLKIEEKSEENAVKYIIKGQVFFASVQDFVNSFKTGEQTKKVILDFSEAHIWDDSAVAAIDKVVLKMKEQGIDVDLIGLNESSWKLVEKLATYDQPHRSVSNH

SEQ ID NO: 50283 - protein, 708 aa, Idiomarina baltica OS145
MTDNNAFHLAVRDDGIAVITIDVPGERMNTLKDSFADEVGRLMNRLEDNSDLKGVVFISGKPDSFIAGADINMINDCETAADTESLARKGQAMFDRIEQLNVPVVAAIHGACLGGGLELAMACHVRVCTDSDKTALGLPEVQLGLLPGSGGTQRLPALVGVQQGLTMILTGKQLRAKQALKAGLVDEIVPQSILLEAAVKQAKKAKAKPSKANLKGMSKLLEATAYGRGIIYKKAGEQAQAKAKGNYPAIDKIIKAVKTGVENGRDAGLDYEARAFGELAMTPESYQLRQIFFATTEMKKETGADGVKPADIKRVGVLGGGLMGGGIAFVTAAKAGIPARIKDISPEGITHALHYSYERLNKKVKRRHMRRAELEKTMLSLSGSLDYSGFDRVDVVIEAVFEDLDLKKKMVADVENNGKDGVIFATNTSSLPITQIAEGAQHPDRVIGLHYFSPVDKMPLAEIITHENTSKETIATTVALTKKQGKTPIVVKDGAGFFVNRILAPYMNEAARLLIAGEPIEHIDKSLVKFGFPVGPITLLDEVGIDVAAKVAPILVKELGTRFEAPAAFDKLIDDGRKGKKNNKGFYQYGKGVKGKPVDKSVYGLLNIEPQAKHEGDEIAELCVLPMLNEAAYCLQEGIIRSARDGDIGSVFGIGFPPFRGGPFRYMDAEGIGSIVKRMERLAEQRGDRYQPAPLLKQMAEQGKRFYE

SEQ ID NO: 50284 - protein, 306 aa, unidentified eubacterium SCB49
MKPHNIIIQPTNNENIVKFVANSFLTQAKSYEFKNIEEAVESPIAQQLFYLPFVKTVYISQNFIAIEKYNIVSWDMVQDEVAESINEYIESGKPVVNESADKKKIPVTIYGETTPNPAVLKFVANKPLVTGTFDFKNIDDAKHAPLATALFNFPFVKEVFMSNNYISVMKYDIAEWDEISMQLREFIRSYIEDGKEIFTDAMLNETIKEEQKAVASPTENGSDKSYSDIDNEIMDILDEYIKPAVASDGGHIAFDSYDANTKTVKVILQGACSGCPSATVTLKNGIETMLRDMMKGRVEIVEAING

SEQ ID NO: 50285 - protein, 390 aa, Chlamydophila caviae GPIC
MFEFRFPKIGETGSGGFVVRWLKQVGENVAKDEPIIEVSTDKIATELASPKAGKLIRCLVSEGDEVASGEILAEIAIESGMQEEVLEEASSKTSCSHSQDCGNSPGWFSPAVLSLAHREGVSIQQLQQISGTGNEGRVTRKDLENYISEMRAPSSPKTTNANENRIPMSPLRRAIASSLSKSSDEVPHASLIVDIDVTDLMNLISEEKDRFFATHGVKLTITSFIIQCLAKALEQFPLLNGSLDGDTIVVKKSINVGVAVNLNKEGVVVPVIHNCQDRGLVSIAKTLADVSTRARSNKLDPSETQDGSITVTNFGMTGALIGMPIIRYPEVAILGIGTIQKRVVVRDDDSLAIRKMVYVTLTFDHRVLDGIYGSEFLTSLKNRLESVTMS

SEQ ID NO: 50286 - protein, 326 aa, Kluyveromyces lactis NRRL Y-1140
MTEIANGQQILPPDYTLKEPEPEHCPGPESENAGKGDSCQGCANKEVCESLPKGPDPDLPLIKENLANIKHKILILSGKGGVGKSTFTTMLSWALSADEDLQVGAMDLDICGPSLPHMLGCVRETIHESNTGWTPVYVTDNLATMSIQYMLPDTDSAIIWRGSKKNALIKKFLKDVDWDYLDYLLIDTPPGTSDEHISINNYLKESQIDGALIVTTPQEVALLDVRKEINFCRKAGINILGLVENMSGFVCPNCKGESKIFKATTGGGKALCNELGIDFLGSVPLDPRIGRCCETGESFLDEFPDSPASTAILEVIESLRDAVGDV

SEQ ID NO: 50287 - protein, 431 aa, Triticum aestivum
PRLTSRPLFAAARRSPVTTLACAITLLALIMYGEDARTIAELSIDDYLYPDADIYNVSGLPPIKLPPPTCDLAHGRWVFDNESLPLYREKECNFLTKQLTCLANGRNDDLWQYWQWQPNNCSLPTFDARRFMERMRGKRLMFVGDSLNRNQFYSLVCMVQSILSKGRKKVVKRGSNTIFHAKEYRATLEFYWAPFLVESNSDDPNIHSIEHRIIRPERIEGHAQYWRGVDYLIFDTYIWWMNTADIKVRRPDSRSWSEHDEVPRIEAYGRVLKTWSDWLNENVDPARTSVFFMTISPIHISPDKWGNPHGIKCAKETLPVLNYTEPLDLNHDMRLYDMVASTARSMKKVPVTLIDITRMSDYRKDAHTSVYSVRRGYLLTPKQKNDPEKFADCIHWCLPGVPDVWNTVLYTRIFSKSPPSSPPALALPPPQ

SEQ ID NO: 50288 - protein, 366 aa, Bacillus licheniformis ATCC 14580
MALTAGIVGLPNVGKSTLFNAITQAGAESANYPFCTIDPNVGIVEVPDERLQKLTELVNPKKTVPTAFEFTDIAGIVKGASKGEGLGNKFLSHIRQVDAICHVVRCFADDNITHVSGKVDPISDIETINLELILADLETVEKRIGRVGKMAKQKDKEAVFEFEILTKLKEAFEQEKPARSVEFSEEQQKVLKQLHLLTTKPVLYVANVSEDEVADPSGNEYVQKVREFAAAENAEVIVVCAKIESEIAELEGEEKAMFLEELGIEESGLDQLIKASYSLLGLATYFTAGEQEVRAWTFKKGMKAPECAGIIHTDFERGFIRAETVAYDDLLEAGSMTAAKEAGKVRLEGKEYIVKDGDVIHFRFNV

SEQ ID NO: 50289 - protein, 254 aa, Rhodospirillum rubrum ATCC 11170
MSGPMVFKRLREDIDAIMHRDPAARSRLEVLLCYPGLHAVLIHRLASALWRRGWLTTGRFVSYLAKIVTGVEIHPGATIGRRLFIDHATGVVIGETAEVGDDVTLYQGVTLGGTSLLPGKRHPTVEDGVIIGAGAQILGPLRVGAGARVGANAVVVTEVPADATMVGIPARIASRSLRKEDGEFCSYGIPEGVPDPIAGTLNGLMDDVRRLNARIAELEGRLDETGSGVGDPPAERRGPALVEDRLKDGARVNG

SEQ ID NO: 50290 - protein, 322 aa, Hebeloma truncatum
GATFAIMTSLFQSLTHTYGLTTHVAWRAAFAIVPAPILLFVAVLTFIFGQDHPAGKWSERHTLPAAALAVNQGHQIPLDHAEEKSSSSESGKEEKDAEGNAAVSVRPVIPEEDLELVKSTLDVAINEPLTLKTTVKILTNPLTWLPALAYLTTYGVELAIDSKFSDVLFTLFSKKRPGFNQTTAGYYTSILGLLNLVTRPAGGYIGDVVYRHYGTKGKKAWTLLCGLNMGAALLGGGLYLQNTRTSGDEISVLMGVFSIAAIFSEFGNGANFALVPHCNAYNNGVMSGLVGSFGNLGGIIFALVFRFQTQLGRAFWIMGVIS

SEQ ID NO: 50291 - protein, 273 aa, Bradyrhizobium sp. BTAi1
MTSVSELQHTTGPIVLAGAGKMGGAMLTGWLAGGLDPARVVVIEPMPSAEITALAARGIRLNPAAPTPAEVVIVAVKPQMFREAGPALKPWVADTTLVLSIMAGTTIASLQNVVGGAVVRAMPNTPAAIGRGITVAVPASDVSAAQRALTDALLRATGAVEWVDDEALMDAVTAVSGSGPAYVFLLAEELARAGIAAGLPEALATRLARDTVSGAGELLHRSELSSATLRQNVTSPGGTTAAALSVLMGPDGFQPLLERAVAAATARSKELAT

SEQ ID NO: 50292 - protein, 355 aa, Hebeloma radicosum
IVNPVNLKSYTIPIFNLGDPYARAFHLSWLGFFVAFLSWFAFPPLIPDAIKSDLHLSAAQVANSNVIALCATFFVRAAVGPLVDKYGPRKVMACLLVLGAIPSGLAGTARTAEGLYVLRFFIGILGATFVPCQAWTSAFFDKNCVGTANALVGGWGNMGGGTTFTIMTSLFHTLTETYGLTTHITWRAAFTIVPAPILPFVAVLTFIFGQDHPAGKWSERHTLPAAALAVKQGHDIPFDHPEKKSDSSSECSKDDKDTEAVSVRPVIAEVDLELVKSTVDVAINEPLTLKTTLKILTNPLTWLPALAYLTTFGVELAIDSKFADVLFVLFSKKRPGFNQTTAGYYTSILGLLNLV

SEQ ID NO: 50293 - protein, 334 aa, delta proteobacterium MLMS-1
MGIKVAINGFGRIGRSIFRAIELDPAFKEIEIVAINDLTPPATLAHLLKYDSVMGIYPHEVKAGDGEIRVDDHPVRVYNQRDPKELPWGELGVEYVIEATGLFTDSDKAQAHLDAGAKKVVISAPAKGQVKTIVMGVNEEDYDPATDHIVSNASCTTNCLAPVAKVIVERFGIKSGLMTTVHAYTGDQRLLDFPHNDLRRARAAAMSMIPTKTGAAAAVALVLPELKGKFDGLAVRVPTPNVSLVDVVMELEQETTVTEVNEALKQATNRYLGYSEEPLVSIDYQGDPRSSVVDAISTKVLGSTVKILSWYDNEWGYSNRVLDLILHMEENRTL

SEQ ID NO: 50294 - protein, 498 aa, Hebeloma cylindrosporum
GAPKFKWSHLWEPAIVNPVNLKSYTIPIFNLGDPYARAFHLSWLGFFVAFLSWFAFPPLIPDAIKSDLHLSAAQVANSNIIALCATFVVRVGVGPLVDQYGPRKVMAYLLILGAIPSGLAGTARTAEGLYVLRFFIGILGATFVPCQAWTSAFFDKNCVGTANALVGGWGNMGGGATFAIMTSLFQSLTQTYGLSTHVAWRAAFAIVPAPILLFVAVLTFIFGQDHPAGKWSERHTLPVAALAVQQGHQIPNIQPEKSLKSSSESSKDEKDPEGNAAVTVRPAIADEDLALVKSTVDVAINEPLTLKTTVKILTNPLTWLPALAYLTTFGVELAIDSKFADVLFVLFSKRRPGFDQTTAGYYTSILGLLNLVTRPAGGYFGDLVYRHYGTNGKKAWTLLCGLIMGAALVAGGFYMQNNRTSGDEQLSVLMGVFSVAAIFSEFGNGANFALVPHCNAYNNGVMSGLVGSFGNLGGIIFALVFRFQTEVGKAFWIMEAEF

SEQ ID NO: 50295 - protein, 397 aa, Erythrobacter sp. SD-21
MRALTWHGTHDVRVDTVDDPEIINPRDAILKITSTAICGSDLHLYDGVIPGVVPGDVLGHEFMGEVVETGAESTLKKGQRVVVPFTISCGGCFHCQIKQYSACENSNPVEKQDMSATLYGHPMSALFGYSHLTGGYSGGQAEYVRVPFSDVGPIVIPDHLEDEKVLFLSDILPTGWMGAENAEIQPDDTVAVWGCGPVGLFAIQSAIVMGASKVIAIDHYPHRLELAKKLGAEVIDFRKTDVRDALMEMSGGIGCDAVIDAVGMESHGFAIDNMIDIAKQKIGIGADRASALKQAILAVRPGGRVSIPGVYGGMTDKFPLGALMEKGLQVRSGQTHVQRYTKDLLEKIEDGTLDTTFLISHRLPLEDAARGYKCFREKQDSWTKVILKPGMEQGQTA

SEQ ID NO: 50296 - protein, 106 aa, Zea mays
  misc_feature (29)..(29): Xaa can be any naturally occurring amino acid
  misc_feature (52)..(52): Xaa can be any naturally occurring amino acid
  misc_feature (69)..(69): Xaa can be any naturally occurring amino acid
  misc_feature (88)..(88): Xaa can be any naturally occurring amino acid
DNSNTPRWRLRKSAQQLEVTAALILGDRXHRYTRPEMDTEIHMDKEHGMHVXYCGPEPTDCSMCRGTFXNYDETGTGRCRRYLHTYGXDVPYNKAPTASTASKSLT

SEQ ID NO: 50297 - protein, 363 aa, Hebeloma cylindrosporum
EPAIVNPVNLKSYTIPIFNLGDPYARAFHLSWLGFFVAFLSWFTFPPLIPDAIKSDLHLSAAQVANSNIIALCATFVVRVGVGPLVDQYGPRKVMAYLLILGAIPSGLAGTARTAEGLYVLRFFIGILGATFVPCQAWTSAFFDKNCVGTANALVGGWGNMGGGATFTIMTSLFQSLTQTYGLSAHVAWRAAFAIVPAPILLFVAVLTFIFGQDHPAGKWSERHTLPVAALAVQQGHQIPNIQPEKSLKSSSESSKDEKDPEANAAVTVRPAIADEDLALVKSTVDVAINEPLTLKTTVKILTNPLTWLPALAYLTTFGVELAIGSKFADVLFVLFSKRRPGFDQTTAGYYTSILGLLNLVTR

SEQ ID NO: 50298 - protein, 126 aa, Brassica napus
ILSYYQAMVAQLEHQFRLRRLSLQGLWFYCQPMMGSMRALAALIHQAKAMAGDNSVRSLLEKMTECASNAYLSILERWVYEGIIDDPYGKFFIAENKSPKKGSPSQDSTAIYWSQRYSLKETSRKF

SEQ ID NO: 50299 - protein, 131 aa, Rickettsia akari str. Hartford
MAYSTKVIDHYENPRNVGSLDKEKKNVGTGLVGAPACGDVMKLQIEVDDDGIITDAKFKTFGCGSAIASSSLVTEWVKGRSINDAGEIKNTEIAKELSLPPVKLHCSLLAEDAIKAAIADYKQKKESKKDS

SEQ ID NO: 50300 - protein, 474 aa, Desulfotalea psychrophila LSv54
MLRCYPRTEKEKRMPLHNKRKNNIMDDIYASSDLSIVLPKYKMPQKELDPRHAYQMVHDELMLDGNARQNLATFCQTWDDPEVHRLMDECIDKNMIDKDEYPQTAEIESRCVHILADLWNAPDSANSLGCSTTGSSEAAMLGGLALKKRWSEKRKAAGKGTDRPNIVCGPVQICWHKFARYWDVELREVPLEDQLYMTAEEAVKRCDENTIGVIPTLGVTFTCVYEPVEEICRALDQLQKETGLDIPVHVDGASGGFLAPFVDPDLKWDFRLKRVKSINASGHKFGLAPLGVGWVLWRDKEELPEDLIFWVNYLGGNMPTFALNFSRPGGQIIAQYYNFLRLGHEGYRKIHQACYKTAQYLSSEVKKLGPFEIIYDGRGGIPAMSFSLQEGVAPGFNLFDLSDRIRSRGWQIAAYSMPANREDLVVMRILVRHGFSRDLADLLLKDLQHCLEYFKKNPVIHQSSEEFSGSFKHS

SEQ ID NO: 50301 - protein, 410 aa, Rickettsia akari str. Hartford
MNQQLNNLTLPIYMDYQATTPLDPRVMEAMLPYFTTKFGNPHSRSHSFGWEAERAVEEARSRVARLIGADTKEIIFTSGATESNNLAIKGVAKFYGNKKNHIITVVSEHKCVLDACRYLEQEGINITYLPVKPNGIIALETLKNAITDQTMLVSVMAVNNEIGVVQPLKEIGKICRARGVFFHSDIAQGFGKIPIDVNEFNIDLASISGHKIYGPKGIGGLYVRKKPRVRVTPLINGGGQERGMRSGTLPTPLIVGLGVAAEIAYSEMEKDTKHVNYLFDRFLNNIHSRISEVYLNGAKDPRYKGNLNLSFAGVEGESIILAIKDLAVSSGSACTSASLEPSYVLRSMGIGEELAHTSIRFGIGRFTTEQEIDYAVNLICSKIDKLRKLSPLWEMMQEGIDLKKIKWAVH

SEQ ID NO: 50302 - protein, 281 aa, Brassica napus
MSKEVSEEGQTHSHGKDYVDPPPAPLLDMGELKSWSFYRALIAEFIATLLFLYVTVATVIGHKKQTGPCDGVGLLGIAWAFGGMIFVLVYCTAGISGGHINPAVTFGLFLARKVSLVRAVGYMIAQCLGAICGVGFVKAFMKTPYNTLGGGANTVADGYSTGTALGAEIIGTFVLVYTVFSATDPKRSARDSHIPVLAPLPIGFAVFMVHLATIPITGTGINPARSFGAAVIYNNEKAWDDHWIFWVGPFVGALAAAAYHQYILRAAAVKALASFRSSATN

SEQ ID NO: 50303 - protein, 502 aa, Gibberella zeae PH-1
MSPPSIPLIAPNGVKWSQPTGLFINNEFVSSSSSRTLTSIDPATENEIATVQAADAQDIDKAVKAAKAALRHPSWKDLPASDRGQLMARLADLIEAKRELFATIDAWDNGKTYIETLENDLVEAVGVIRYYSGWADKTFGQTINTTPQKFAYTIRQPIGVIAQIIPWNYPLSMATWKLGPALACGNAVVIKAAEQTPLSLLVLGELIKEAGFPPGVVNIVNGLGKDTGAALVQHPLVDKIAFTGSTATAANIMGVAAKTLKNITLETGGKSPLIVFDDAEMDQAVKWSHFGIMSNQGQICTATSRILVQETIYEEFIKKFIDTLNTVSKVGDQWDKTTYQGPQVSKVQYERILEYIEIGKKEGATLAAGGGPLKINGSDKGFYISPTVFTDVKPSMRVFREEIFGPVVVVSTFKTEEEAIELANDTTYGLGAAAFTTNLEKAHRVAAAIEAGMVWINSSQDCDPRVPFGGVKQSGIGRELGEAGLEAYTQIKSVHINMGNRL

SEQ ID NO: 50304 - protein, 164 aa, Acetabularia acetabulum
MADETKGPVQLTASFYGFLGAAFALIFSCMGAAYGTAKSGIGIAQMGVMKPELVMKSIVPVVMAGVLGIYGLIIAVIISTNVKKTAYTLYDGYAHMGAGIACGMAGMPAGMAIGIVGDAGVRANAQQPKLFVGVILILIFAEALALYGLIVGIILASKASGGSS

SEQ ID NO: 50305 - protein, 396 aa, Glycine max
  misc_feature (99)..(99): Xaa can be any naturally occurring amino acid
MGAERKWLFTLLSAAFLSLMLLLMSSFSAFSTPKVFPSLVQHGSHYPPAFAYFISGGNQDKDRILRLLLAVYHPRNRYLLHLGRDARDEERQALDSATXAVPVIRTFGNVDVVGKADYVTYLGSSNVAITLRAAAIMLKLDSGWNWFITLSARDYPLITQDDLSHVFSSVSRDLNFIDHTGDLGWKESDRFQPIVVDPGLYLARKSQIFQATEKRPTPDAFKLFTGSPWVILSRPFLEFCIFGWDNLPRTLLMYFTNVKLSQEGYFHSVVCNVPEFKNTTVNGDLRYMIWDNPPKMEPHFLNASVYNQMAESGAAFARQFQLNNPVLDMIDEKILQRGRHRVTPGAWCTGRRSWWVDPCSQWGDVNTVKPGPQAKKLEGSVSNLLDDQNSQTNQCQ

SEQ ID NO: 50306 - protein, 168 aa, Acetabularia acetabulum
MAETPTTPTSDTTTGNDTAPFFGFMGAASALVFACMGAAYGTAKSGVGIASMGVMRPELVMKSIVPVVMAGVLGIYGLIIAVIISTNVKRDVYKLYDGYAHLSAGLACGLAGLPAGMAIGIVGDAGVRANAQQPKLFVGMILILIFAEALALYGLIVGIILASKASAS

SEQ ID NO: 50307 - protein, 167 aa, Acetabularia acetabulum
MATAETPSATPAAGNDTAPFFGFMGAASALVFACMGAAYGTAKSGVGIASMGVMRPELVMKSIVPVVMAGVLGIYGLIIAVIISTNVKRDVYKLYDGYAHLSAGLACGLAGLPAGMAIGIVGDAGVRANAQQPKLFVGMILILIFAEALALYGLIVGIILASKASAS

SEQ ID NO: 50308 - protein, 324 aa, Oryza sativa Japonica Group
MGVPPVDWEAESYPAYSDFAAIPLFAVFLFAVRYLLDRFVFEVVMVFTVLFPHHAHFRIVTGVWLARRLIFEKDEKLDLATHAGRIKIRKFKESAWKCIYFLSAELLALSVTYKESWFTSTKNFWVGPGDQVWPDQRIKFKLKLVYMYAAGFYTYSIFALQFWEIKRSDFGISMVHHVVSVILIALSYIFRFARVGSIVLAIHDASDVFLELGKISKYSGYQLLADVSFLIFVCSWAVLRLIYYPFWILWSTSYEVVPMLDKKKHKFDGPLHYYVFNCLLFSLLVLNIYWWVLMYRMLVEQILSKGHVGDDVRSDSEGEEEHED

SEQ ID NO: 50309 - protein, 168 aa, Acetabularia acetabulum
MSATPSETLSTASAGNDTAPFFGFMGAASALVFACMGAAYGTAKSGVGIASMGVMRPELVMKSIVPVVMAGVLGIYGLIIAVIISTNVKRDVYKLYDGYAHLSAGLACGLAGLPAGMAIGIVGDAGVRANAQQPKLFVGMILILIFAEALALYGLIVGIILASKASAS

SEQ ID NO: 50310 - protein, 252 aa, Candida albicans SC5314
MASNTVNRSIIVLLGGGHASGKKTTALSLKEELSAIVPECHVDVQIIDMNDYTVDGKSSIDSSQFVSNKSAAISINKSNDKLPRLKPSRFQFDKLKTFLLNNLDTPSNEPQKILLVHGLYALYDKEIRNIAHIKAFIDSDSDTRLIRWIRRDVLQNQTDSLEGVINAYLLGARSEMSDFIFPTKEFADVILPRGAEPNAVRLIIDGIMLYLNDKHLTNDTTQFPENILRPNEIGNFQKERFDVQKNKFYELN

SEQ ID NO: 50311 - protein, 231 aa, Streptomyces coelicolor A3(2)
MTRASLNKQPHEVASMFDHVAERYDLTNAVLSLGQDRAWRKAVARAVDARPAQKVLDLAAGTATSSLPFARTGAYVVPCDFSQGMLQVGKERHSWLPFTAGDATRLPFKDDVFDAVTISFGLRNVQDTDAALREMYRVTRPGGRVVICEFSHPTWAPFRTVYTEYLMRALPPVARAVSSNPDAYVYLAESIRAWPDQPALAGRLGRAGWSRVAWRNLTGGVVTLHRGFKAS

SEQ ID NO: 50312 - protein, 382 aa, Idiomarina baltica OS145
MAQDYYQILGVGKDANERDIKKAYKRMAMKYHPDRTKGDKELEAKFKEIKQAYEVLSDPQKRQMYDQYGHEAFQQARQGGGAGSGGFGGGGADFADIFGDVFGDIFGGGRRQQARPQRGADLRYNLEMSLEDAVKGKEVELQIPTMVECEDCDGSGAKKGTRPETCSHCHGSGQIQMRQGFFAVQQACPHCRGTGSIIKDPCNTCHGQGRVEKTKKLSVKIPAGVDTGDRIRLANEGEAGEKGAPAGDLYVQVHVREHPIFARDGNNLYCEVPVSFTKAALGGEIEVPTLEGKVKLKVPKETQTGKHFRLRGKGVKSVRTGAVGDLICKVVIETPVNLSSRQRELLEELESSMGHGDEAAKFRPKEKGFFDGVKQFFDDLRS

SEQ ID NO: 50313 - protein, 360 aa, Triticum aestivum
MGATNHTLQALLPWLLLFVQQAAAASGGCECTTATDGADKQGAMKLKLVAIASILTAGAAGVLVPVLGRSMAALRPDGDIFFAVKAFAAGVILATGMVHILPAAFDGLTSPCIHKGGGDRNGFPFAGLVAMSAAMATMVIDSLAAGYYRRSHFSKARPLDNIDMPGDEEGRADHPHMHAHGHSHGEAIVVSSPEEAAIADTIRHRVVSQVLELGILVHSVIIGVSLGASVRPSTIKPLVGALSFHQFFEGIGLGGCIVQANFKVRATIIMATFFSLTAPVGIVLGIAISSSYNVHSSTAFIIEGVFNSASAGILIYMSLVDLLATDFNNPKLQTNTKLQLMTHLALFLGAGMMSMLAIWA

SEQ ID NO: 50314 - protein, 230 aa, Chlamydophila caviae GPIC
MQLSTNKPDLQEMFDSLAPKYDRINSILSLGMHHLWNRKFSKMLGKSECLLDLCSGTGKVAYRYIHDYPKSQAILVDFSSNMLAIAKQRYPKAPFTFIEGDIAQLPIDQESHTLAAISYGLRNLPDRKNALNEIHRILKPNGCLGILELTSPSDNHPMYLAHRLYLKFLVPLIGRLCSKNKQAYHYLAESIKNLPKDDYLEQLFKDAQFQISKKRKFAFGAATIWILQKI

SEQ ID NO: 50315 - protein, 455 aa, Rhodospirillum rubrum ATCC 11170
MVSNALRDADLSYTIHPYTNLVAHETKGPLIAVRGEGVRVFDDKGKDYIEGMAGLWCASLGFSEPRLAAAAARQMAELPFFHMFSHKSHEPGIRLSEELVKRAPVPMARAFFCNSGSEANDTAIKMIWYINNALGRPQKKKIIARKRAYHGVTVASASLTGLPANHRDFDLPIANILHTSSPDYYREGKPGESEEAFAKRCADELEAMILAEDPNTVAAFFAEPIMGAGGVVLPPKGYFEHIQAVLKKYDILLVADEVICGFGRTGQYWGSQTFGLKPDILTCAKALSSAYMPISAVLVTEEVYKPLRDNSGKIGTFGHGYTYSAHPVAAAVALETLAIYDERDILGNVAVSGARLQERLRSFADHPLVGNVRGIGLIGAIELVADKATHGAFPASDAVGPRVVTKAEEAGVILRAMAGDVVAFSPPLIITPEEVDQMMDRFTVALEAVTAEVLG

SEQ ID NO: 50316 - protein, 160 aa, Zea mays
MAQRDKKEEPTELRAPEITLCANNCGFPGNPATQNLCQSCFSASRSPSSPTSSSSSLASAASQPRPAALVVDAAAVDALAAPAAAAGQATEAAARASASRCSSCWKRVGLTGFRCRCGELFCGAHRYSDRHGCSYDYKGAARDAIAREDPVVRAAKVVRF

SEQ ID NO: 50317 - protein, 488 aa, Listeria innocua Clip11262
MADVRKLKNYINGEWVESKADKYEDVINPATGEVLCQVPISTRAELDQAAVIAEQAFEKWSQVAVPRRARVLFSFQQLLIQHKEELARLITLENGKNLSEARGEVQRGIENVEFAAGAPTLMMGDSLASIATDVEAANYRYPVGVVGGIAPFNFPMMVPCWMFPMAIALGNSFILKPSERTPLLMEKLVELFSEAGLPKGVFNVVYGAHDVVNGILENETIKAVSFVGSKPVGEYVYKTGSANLKRVQALTGAKNHTIVLNDADLEDTVTNVISAAFGSAGERCMACAVVTVEEGIADDFLAALRTAAQNVKIGNGLDDGVFLGPVIREENQKRTIAYIEKGVEEGAKLTVDGRETGLSEGYFVGPTILEDVTTDMTIWKDEIFAPVLSVIRVKNLQEAVRVANQSEFANGACIFTNNAKAIRYFREKIDAGMLGVNLGVPAPMAFFPFSGWKSSFYGTLHANGKDSVDFYTHKKVVTARYSLKGYEE

SEQ ID NO: 50318 - protein, 174 aa, Zea mays
MAQRDKKVEEPTELRAPELTLCANSCGFPGNPATNNLCQACFLAATASASASVSPPPPSSSSSPAVLQFDDQQQQQQQQNPRPRAPAASGPTEEPPRPARAPAPAPASSSSVRRCQTCRKRVGLTGFRCRCGDLFCGAHRYSDRHDCCFDYRAAGRDAIARDNPVVRAAKIVRF

SEQ ID NO: 50319 - protein, 488 aa, Gymnopilus junonius
GAPKFKWSHLWKPAIVNPVNLKSYTIPVFNLWDPYARAFHLSWLGFFVAFLSWFAFPPLIPDAIKSDLHLTTDQVGNSNITALAATLVLRILVGPLVDKYGPRKVMAYLLILGSIPSGLAGTAHNAQTLYVLRFFIGILGATFVPCQAWTSAFFDKNCVGMANALVGGWGNMGGGATFAIMASLFQSLTARGLTPHVAWRASFAVVPVPILLFVAGLVFLFGQDHPAGKWSERHNLPATAISIQQGHQVRYSHDEKSLKIHSKDNEKTVVSIEQVREEDVALVQSTIDVAINETLSLRTALKMMIDPLTWLPALAYFTTFRVELAIDSQMANVLFTLFQKKRRGFTQTTAGYYTSIFGFLNIVTRPFGGYLGDAVYRRFGTKGKKVWTLVSGFIMGVSLLAGGLYLQNHQASGDAQLSVLMGVFSISAIFSELGNGANLSSSTLQSVQQCVMSGIVGSFGNLGGVIFALVFRFVPQVGKAFWIMGVIS

SEQ ID NO: 50320 - protein, 244 aa, Mycobacterium leprae TN
MWYWLFKYIFMGPALSVLGRPKVEGLEYVPSSGPAILASNHLAVADSFYLPLVVRRRITFLAKSEYFTGTGLKGWFTSWFYRATGQVPIDRTDADTAEAALNTAERLLGHGKLIGMYPEGTRSPDGRLYKGKTGVARLTLQTGVPVIPVAMIGTNVVNPPGSKMWRFGRVTVRFGKPMDFSRFEGAAGNRVIERVITDEVIYELMELSGQEYVDIYAASVKGHSSSSGAKLTNEAVRIPDTAVG

SEQ ID NO: 50321 - protein, 361 aa, Yersinia pseudotuberculosis IP 32953
MKKTYRIAAIPGDGIGHEVMPEGINVLQAAALRWDLDISFENIEWASCEYYQHHGQMMPNDWQRQLQCFDAIYFGAVGWPATVPDHISLWGSLLKFRRDFQQYVNLRPVRLFPGIPCPLVGKQPGDIDFYVVRENTEGEYSSVGGRLFEGTEQEMVLQASIFTRRGVDRILKYAFELAQMRPRKRLTSATKSNGLAFSMPYWDERFEVMAAQYPQISADKQHIDILCARFVLNPERFDVVVASNLFGDILSDLGPACAGTIGIAPSANLNPERDFPSLFEPVHGSAPDIYKRNIANPIAMIWAGAMMLDFLGQGDERYHAAHNGILNAIEQVIAQGPKTPDMCGDASTQQVGSAIVQVLSH

SEQ ID NO: 50322 - protein, 386 aa, Mycobacterium avium subsp. paratuberculosis K-10
MKCRAAVIRGVGRDWEIAEIELDPPRSGEVLVRMAVAGICHSDDHLFTGDVVPTPEVVAASGQPAPDWFPLLGGHEGAGVVAEVGPNVTSVRPGDHVALSFIPACGSCRFCVNGQSYICDIGASLFQREMPTDGTCRRHLGAENLLAYGQLGTFAEYAVLSERSVIKIDEAIPFHAASLVSCGVSTGWGSATVSAGTEPGDTVVVIGAGGVGMNALQGARAVGAKYVVAVDPVAAKRDSAKIFGATHTAASARDAIPLVREITAGLMADRVVVCPGVVHVDLIPLALALLRKGGVCVLTGITPFTEPPVPLVLQEMTLSAKQLRGALYGGMNPRTSVPMLLSLYQAGDLKLDELVTRHYRLDEINEAFADLREGRNIRGVIDFASR

SEQ ID NO: 50323 - protein, 432 aa, Brassica napus
  misc_feature (423)..(423): Xaa can be any naturally occurring amino acid
MVGAKPVKMVENGSDGTSLLNGRYEIGRLLGHGTFAKVYHARNVTTGKSVALKVVAKEKVAKAGMEEQIKREISVMKMVKHPNIVELHEVMASKTKIYFAMELVRGGELFAKVAKGRLREDAARVYFQQLISAVDFCHSRGVYHRDLKPENLLLDEEGNLKVTDFGLSALTEHLKQDGLFHTTCGTPAYVAPEVILKKGYDGAKADLWSCGVILFVLLAGYLPFQDDNLVNMYRKIYRGDFKCPGWLSSDARRLVTKLLDPNPNTRISIDKVMDSAWFKKHSTRSKNEAEDLDISVHKSKEETETLNAFHIIALSEGFDLSPLFEEKKKEEKREMRFATSRPASSVISSLEEAARVGDKFDVRKSESRVRIEGKQNGRKGKLAVEAEIFAVAPSFVVVEVKKDHGDTLEYNNFCSTALRPALXDIFWTSTPV

SEQ ID NO: 50324 - protein, 416 aa, Oryza sativa Japonica Group
MKSQKNNLPLPKRSAAIAAPIALLLVVGLISLYDFTFADRYPNIDAASSSSSSSSSPSPATVSKCNLTRGEWVPDGEAPYYTNLTCPFIDDHQNCMKFGKPSLEYVSWRWKPDGCELPRFDAARFLEAMRGKSMAFVGDSLARNHFKSLLCLLSKVAQPVELVGAAPEIDVTGRAVRRDFRYDSHGFTASLFWSPFLVKANLANATLGLWDLHLDTADARWAAHVAEFDYVVLSDTNWFLRPSVYYEGGRAVGRNGAAPVTNATEIAVPRAVRAAFSTALGALAAAPGTFRGKAILRSVTPAHFENGEWNTGGDCVRTRPFRRDERALGAVEAEYLAVQVDAVREAEAAVRRNGGELRLLDITEAMDLRPDGHPSRYGHPPGGSVEGSFVVDCLHWCLPGPIDLWSELLFHMLVDQ

SEQ ID NO: 50325 - protein, 247 aa, Treponema denticola ATCC 35405
MRLVLVRHGESEWNKLNLFTGWTDVDLSEKGVEEAKEGGTYLKKEGFDFDICYTSYLKRAIHTLNYILSQMDREWLPVIKTWKLNERHYGGLQGLNKAETAEKYGEDQVKIWRRSFDIAPPVLEEGDKRCPYLQEQYRGIEKSELPLTESLKDTIARAVPFFEKTIKPQMLEGKRILITAHGNSLRALVKYFENLSDEEIISVNIPTGVPLVYEFDKNFKVLSKRYLGDQEKINAKINAVANQGKKK

SEQ ID NO: 50326 - protein, 274 aa, Brassica napus
MEGEEEVSIKELASNLTTYKEQLQQVRQLLSQDPRNSEYADMVKELKEVIALTEELLATATQNEIPLSDAGATPESPDLLEGAWQKMESRNDPIHEGKFPIGTKVQAVYSYDGEWYDATIEAHTINGYYVSYNEWGNKEEVDPDNVRAIETNALLEAERIAEAAKNALKRKVEQAASSDYQSKTLPAKLKIDPNDPEDVKIAKRKKIHAFKSKARQEQLEVTQNKKQNAWQQFQTTKAKTKKVGFFTGRKKESIFKSPEDPFGKVGVIGSGKGL

SEQ ID NO: 50327 - protein, 381 aa, Idiomarina baltica OS145
MSILASQSANRAILVLADGTIFHGTAIGAEGSAVGEVVFNTAMTGYQEILTDPSYTEQLVTLTYPHIGNTGTNNEDEESPEVWAKGLIIRDNALKASSFRKQETLTEYLQRQNVVGIADIDTRKLTRILREKGAQNGCIMAGPIDEDKALQLAREFPGLKGMDLAKVVSCEETHAWSEGSWQLGEGHTSPAQDKFHVVAYDYGCKQNILRLLADRGCRITVVPAQTSADEVMALNPDGVFLSNGPGDPEPCDYAIDAIKALLEKDIPIFGICLGHQLLGIASGAKSTKMKFGHHGANHPVQDVRTKRVMITSQNHGFAIDETSLPDNIEVTHVSLFDGTLQGMRRTDKPAFSFQGHPEASPGPHDADALFDHFIELMQARA

SEQ ID NO: 50328 - protein, 78 aa, Pseudomonas syringae pv. phaseolicola 1448A
MSTIEERVKKIVAEQLGVKSEEVVNTASFVEDLGADSLDTVELVMALEEEFETEIPDEEAEKITTVQAAIDYVTSHQA

SEQ ID NO: 50329 - protein, 362 aa, Synechococcus sp. RS9916
MTSTPNSNDPLATVPSDRLWLRSELMGTQVITRDTGRRLGVVGEVIVDIDGREVVALGLRDNPLTRFLPGLPRWMPLDRIRQVGDVILVDSIDSLSETFSPERYSRVINCQVITESGSVLGRVLGFSFDIETGELTTLVMGAVGVPLLGEGVLSTWEIPVDEIVSSGADRIIVYEGAEDKLKQLNSGVLEKLGVGGPSWEEQERERYRVNVVPVENQLSSGQPAEEQQKQLQASSAEAFAPEEELEYVEVEERRSEQQTRRRYMDDLPERDYRDFDDRRDPYADQRPPAYGEQERYDRPRYDEDRYAPEPEAEPLPERFEARPRPAARRPVEPPGDPLDVEPLGSEQPSVGRSTGSDLDDPW

SEQ ID NO: 50330 - protein, 385 aa, Glycine max
  misc_feature (188)..(188): Xaa can be any naturally occurring amino acid
  misc_feature (372)..(372): Xaa can be any naturally occurring amino acid
MFSFLFPSKVQNGIARKASKMLKEKEKERLFLWICKFAGRKKVGMLFLCLISAAVFVWVLFVGKAEDSQDGNTVSSINVNESVSASDSTSENSTTNAMGLTKRSVLPPPPAGYFLGYRLPPGHPCNSFTLPPPPADKKRTGPRPCPVCYLPVEEAIGLMPALPSPSPVLGNLTYVYEENLSRDGEFGXGSDFGGYPTLKQRNDSFDIRESMTVHCGFVRGIKPGRNTGFDIDGADLFEMEQCDGVVVASAIFGNFDVINEPNNISDYSRKTVCFLMFVDEQTEKYLISSGKLGISKKIGLWRTIVARNLPYPDARRTGKIPKLLLHRLVPNARYSIWLDGKLELVVDPYQILERVLWRKNATFAISKHYRRXDVFIEAEANKAAG

SEQ ID NO: 50331 - protein, 192 aa, Oryza sativa Indica Group
MEPCLQIHATEHTWLIICRQDLALIESLIIVVILYDINVHCLETLRVKDEELQNLANNIRARDATIKEIADKLTQTAEAAEVAASAAHKMDEHRRLLCSEIEHLRHYKQWKDKWNNSWSRLSKEKDQLLKERDAALQEAHMWRTELGKAREQAVVQEATIARADEKLRASEADAWVYCLHIAICYSAVVVPD

SEQ ID NO: 50332 - protein, 175 aa, Pseudomonas syringae pv. phaseolicola 1448A
MSYSKIPAGKDLPNDIYVAIEIPANHAPIKYEIDKETDCLFVDRFMATPMFYPANYGFIPNTLADDGDPLDVLVVTPYPVSPGSVIRARPVGILHMTDDGGGDAKVIAVPHDKLSQLYVDVKEYTDLPALLLEQIKHFFENYKDLEKGKWVKIEGWGDADAARAEITKSVAAFKG

SEQ ID NO: 50333 - protein, 260 aa, Zea mays
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRVPPVDVSVVDLTVRELAELKAACE

SEQ ID NO: 50334 - protein, 411 aa, Bordetella bronchiseptica RB50
MNTIYDSAAVAAGRRVAARMARVTTSKIYLAIAKVADMQAQGMQVASLTAGEPDFDTPAHVIEAAVQAMRGGDTHYTPVRGSLAMREAVRQKFQRENGLAFRDEEVMVGTGSKQVIANALAVTLETGDEVLLPVPYWAAYTGMVYAAGGVPTFVGTRAEDGYKLTPQALRAALGPRTRWVILNTPSNPSGLVYGSDELRALGEVLRERPDVLILTDEIYEHLNYTAEPPASLRKLCPDLAERIVVVNGVSKAYAMTGWRLGFAGGPADIIEAMANLQAQTTLAPCSISQAAAVAALNGPRESIDAMAAAYRRRRDLVMQIAGGQPGVRLQRPDGAFYAMLDLSEALAGGERFRGDPEPDQAFCEWLLETRHVAAVPGSVFGAPGSVRISFATDEQTIERGLTGLLDAAAHC

SEQ ID NO: 50335 - protein, 404 aa, Thermus thermophilus HB8
MDLSALREDFPLFAQRPELVYLDSAATSQKPRRVIEALRRYYETLNANVHRGAYRLSAEATEAYEEARRRLARFLNAEPKEIVFVRNTTEAMNLVAYAWGLRNLKEGDEVLVTEMEHHAGLVPWHLVAGLTGAKVKAIPLTEEGRLDLSALEDLLTERTRVVSLVHMSNVLGTINPVAEIARRAKEAGALVVVDGAQSAPHLPVDVKALGADFFALSGHKMLGPTGAGVLWGRYEVLEGMMPFLGGGEMILEVHVDRSTYAPPPQRFEAGTPPIAEAIALGEAACYLMEVGMEKVFAHDRALLDYALKRLEEVPRLRVYGPKGLDRGGVIPFTLGRLHAHDLATFLDQEGIAVRAGHHCAQPLHRKLGLAATARASFYLYNTKEEVDRFVEALLRIEAKYRAWL

SEQ ID NO: 50336 - protein, 252 aa, Idiomarina baltica OS145
MSNASLVIANWKMNGNRALTRNMSEVLRDNQADFKGVNVVICPPYTLLSEMAGHIYYDDVALGAQNVSEYESGAHTGEVSVAMLQELGVEYVLLGHSERRAEQHESDQLVAAKAATVTQAGLTAVICVGEDKAQREADNTWSVIQAQLEKSLAGLSAKQMARVVVAYEPIWAIGTGETASPAQAQEVHAKIRGWLVENYQQVGAKTPLLYGGSVKANNAESLFSEADINGGLIGGASLNGEDFCAICRAAKG

SEQ ID NO: 50337 - protein, 317 aa, Bradyrhizobium sp. BTAi1
MSAKNGSIKLVAGNSNPALAAGIAAELGLPLTKAVVRRFADMEIFVEIQENVRGSDVFILQSTSYPANDLLMELLIITDALRRASARRITAVVPYFGYARQDRKSGSRTPISAKLVANLITHAGVDRVMTLDLHAGQIQGFFDIPTDNLYAAPLMVRDIKDRFDLSSVMVVSPDVGGVARARGLAKRINTPLAIVDKRRERPGESEVMNVIGDVSGRTCILIDDIVDSGGTLVNAADALLKHGAKDVYAYITHGVLSGGAATRITSSRLKELVITDSIMPTEAVRNAPNIRALPIAPLIAEAIGRTAAEESVSSLFD

SEQ ID NO: 50338 - protein, 541 aa, Campylobacter jejuni subsp. jejuni NCTC 11168
MDNFLEIFLITVAIAIVLNVIFKKFEIPTIIGYIAAGEIISEIYHLSGKGEITHIAEFGIVFLMFTIGLEFSFKHLMAMKQEVFLNGSLQMLTCGFVFMLLAIGILGLGDKSATIVGFALALSSTAVVLKILNDNGDINEQYGRKALGILLFQDIAVIPLLLLVDIFSSNNQNIEKLLFTSLISALILITLLFFIGKYLVDRIFRLIIHTSSQEIFISTVLFMVIGASFLANYFGFSYSLGAFIAGALIAETKYKHKIEADLIPFRDLLLGLFFITVGMQIQLDVVAQNWFLIIVLTLLVMALKFGIVFGFLFLYTKKRVALKTAFAIAQIGEFALAIFSLLQAKNMLDIKTSQILIVVSILTMIITPFILNNIRKITNVVEDIALNTNAVQNIDSNIKLKNHLVVFGYGRLGQEVVQKIKNTGVPYLVLESDLNLVELGVSRGENVVFANAAQEETLKIANIEECAVAIITVTNEAKLEILCQVLANYPKPIDTIIHVNGTLKKMLFSSIDENIRIIRSEKVIARNLVQEALECRIHKNT

SEQ ID NO: 50339 - protein, 192 aa, Schizosaccharomyces pombe 972h-
MGKAKTTRKFAQVKRVINLKDQRLQKKDQKKEKEKTTKNGELVREIPQMASNLFFQFNESLGPPYHVIIDTNFINFCLQQKIDLFEGLMTCLYAKTIPCISDCVMAELEKLGIRYRIALRIAKDERFERLPCTHKGTYADDCIVQRVMQHKCYLVATNDKNLKQRIRKIPGIPILSVANHKIRVERLVDVVD

SEQ ID NO: 50340 - protein, 325 aa, Listeria innocua Clip11262
MNLNKHSERKFDLITVGRACIDLNAVEYNRPMEETMTFSKYVGGSPANIAIGTAKLGLKVGFIGKISDDQHGRFIEKYMRDLNINTDGMVKDTAGRKVGLAFTEIKSPEECSILMYRENVADLYLTPEEISEDYIKETRVLLVSGTALAQSPSREAVLKAVHLAQKNDVIVAFELDYRPYTWKNTEETAVYYSLVAEQADVIIGTRDEFDMMENQIGGNNEMTIDNLFKHKAEIIVIKHGVEGSFAYTKAGETFRAQAYKTKVLKTFGAGDSYASAFLYGLFSGENIETALKFGSAAASIVVSKHSSSDAMPTADEIKALIANAD

SEQ ID NO: 50341 - protein, 319 aa, Striga asiatica
MAAALVISLVTIVLSSNFHCSSNALSVNYYQKTCPRAESTITKVVKEGMTNDKTVAAAILRMHFHDCFIRGCDASVLLNSKGNNQAKKDGPPNISLHAFYVIDNAKQQVEKMCPGVVSCADILALAARDAVTLSGGPTWDVPKGRKDGRISNALDTRQLPAPTFNISQLQQSFSQRGLSVDDLVALSGGHTLGFSHCSSFKNRIHNFSNKTEVDPSLDTSFAAQLRQVCPVGNTNKNAGANLDSSPFVFDNAYYKLVLQGKSIFSSDQALLATSRTKALVAKFASSQKEFYEAFVKSMIKMSSISGGGSEIRLDCRAVN

SEQ ID NO: 50342 - protein, 591 aa, Schizosaccharomyces pombe 972h-
MKRSSSVSVEDEKSARRKLDVVPKLHFVGCSHLTDYHLMEKLGEGTFGEVYKSQRRKDGKVYALKRILMHTEKEGFPITAIREIKILKSIKHENIIPLSDMTVVRADKKHRRRGSIYMVTPYMDHDLSGLLENPSVKFTEPQIKCYMKQLFAGTKYLHDQLILHRDLKAANLLIDNHGILKIADFGLARVITEESYANKNPGLPPPNRREYTGCVVTRWYRSPELLLGERRYTTAIDMWSVGCIMAEMYKGRPILQGSSDLDQLDKIFRLCGSPTQATMPNWEKLPGCEGVRSFPSHPRTLETAFFTFGKEMTSLCGAILTLNPDERLSASMALEHEYFTTPPYPANPSELQSYSASHEYDKRRKREQRDANSHAFEQTANGKRQFRFMTRGPSDPWYGIRRPNYNSQPQYQRGSYNREGGNMDRSRNVNYQPKRQQNFKPLTSDLPQKNSEFSETNAMNQTSNHSHADGQRYYRPEQDRSQRLRNPSDYGRQGRQSSQSQQPAWNVSSRYQNNSKVQTTSRASENADTNKTQHNIKYIDSYVPEYSIARQSANQKTNEQHPSSTSLHQQSTSDLKSPSFHENSNVDDTPK

SEQ ID NO: 50343 - protein, 365 aa, Bradyrhizobium sp. BTAi1
MGFKCGIVGLPNVGKSTLFNALTETAAAQAANYPFCTIEPNVGEVAVPDPRLEKLAAIAKSGQIIPTRLTFVDIAGLVRGASKGEGLGNQFLANIREVDAIAHVVRCFEDSDITHVEGKIAPLADIETIETELMLSDLDSLEKRVDNLAKKAKGGDKDAKEQHDLVTRALGLLRDGKPARLLERKPEEERAFGMLGLLTSKPVLYVCNVEEGSAKDGNSFSQAVFARAKEEGAVAVVISAKIESEIATLSREERADFLETLGLEEAGLDRLIRAGYQLLDLITYFTVGPKEARAWTIHRGTKAPAAAGVIHTDFEKGFIRAETIAYADYVALGGEAGAREGGKLRLEGKEYVVADGDVMHFRFNN

SEQ ID NO: 50344 - protein, 358 aa, Solanum tuberosum
MSCYKGKYADELIKNAAYIATPGKGILAADESTGTIGKRLSSINVENVESNRRALRELLFCAPGALQYLSGIILFEETLYQKTAAGKPFVDVMKEGGVLPGIKVDKGTVELPGTNGETTTQGLDGLAERCQKYYEAGARFAKWRAVLKIGANEPSQLAINDNANGLARYAIICQQNGLVPIVEPEILVDGSHDIKKCADVTERVLAACYKALNDHHVLLEGTLLKPNMVTPGSDAPKVVPEVIAEYTVRALQRTMPAAVPAVVFLSGGQSEEEATRNLNAMNKLQTKKPWTLSFSFGRALQQSTLKAWSGKEENIGKAQAALLTRCKANSEATLGKYAGSSNLGDGASESLHVKDYKY

SEQ ID NO: 50345 - protein, 233 aa, Arabidopsis thaliana
  misc_feature (142)..(142): Xaa can be any naturally occurring amino acid
MASSSDPWIREYNEALKLSEDINGMMSERNASGLTGPDAQRRASAIRRKITILGTRLDSLQSLLVKVPGKQHVSEKEMNRRKDMVGNLRSKTNQVASALNMSNFANRDSLFGTDLKPDDAINRVSGMDNQGIVVFQRQVMRXQDEGLEKLEETVMSTKHIALAVNEELTLQTRLIDDLDYDVDITDSRLRRVQKSLALMNKSMKSGCSCMSMLLSVLGIVGLALVIWLLVKYL

SEQ ID NO: 50346 - protein, 589 aa, Mycobacterium avium subsp. paratuberculosis K-10
MTSMHTRGRRTPGAAVQSSAVSDAAHVGDIVGAFGRIRRDGGGADGAAGGRWRRLRTLAVITGPGLIVMVGDNDAGGVATYAQAGQNYGMGLLWTLVLLIPVLYVNQEMVLRLGAVARVGHARLIFERFGRFWGAFSVGDLLILNALTIVTEFIGVALALGFLGCPKIVAVPAAAALLFAVVAGGSFRRWERLMFLLIAVNVLIFPMVMLVHPAPKATVAGLIPQFPGGLNSTVLLLVVAIVGTTVAPWQLFFQQSNVVDKRITARWIPYGRADLVIGIVVVMVGATALMAVTAFGLAGTAAAGHFTDAGAVAAGLSAHLGRTVGVLFAIILLDASLIGANAVGLATSYAVGDAMGKRHSLHWKITEAPLFYGGYAVLLAVSAAVSFSPDHILGLVTQGVQALAGVLLPSATVFLVLLCNDRAVLGPWVNTVRQNIAAWTIVWCLVLLSLALTATTFFPDLSTGTIEAGLAAGAVLGVVAGAVMIVVGRRQRDLAEAEAIVRTLGGGLDPEQVDELDDASSLTRAERRAVRRQDRENWQTPSLALLDRPAMSPMRRAGLFTLRGYLVVAVVFVIIKLVQAGVVGPAGSL

SEQ ID NO: 50347 - protein, 479 aa, Shewanella sp. ANA-3
MPARVTHHRIFALSNSDTQPSMAFSTLKLKPELLENLTTMGYHEMTPIQAQSLPAILAGEDVIGQGKTGSGKTAAFGLGLLNKLDVKRFRIQTLVLCPTRELADQVAQEIRTLARGIHNVKVLTLCGGVPMGPQIGSLEHGAHIIVGTPGRIVDHLERNRLDLSNLNMLVLDEADRMLEMGFQPQLDAIIEQSPRERQTLLFSATFPEQIQSIAKQIMYDPVMVKVAVTHEKSTIEQHFYHLDDDKARMQALQLLLLDRKPESAVVFCNTKRETQKVADELSDAGFSVIALHGDLEQRDRDETLLQFANKSACVLVATDVAARGLDIDALDAVFNYHVAYDTEVHIHRIGRTGRAGSKGAAFTFFDDQDGYKIALLEEYLERDIQSEALPSLSLLGTAPNAPTMITLQIDGGKKEKLRPGDILGALTGENGIEGSQVGKILVTDYRAYVAVNRKVAKKALSKITSGRIKGKSYRAWLMK

SEQ ID NO: 50348 - protein, 471 aa, Arabidopsis thaliana
MSRTRTAASEAHDSMESEERVDLDGDNDPEEILEEEVEYEEVEEEEIEEIEEEIEEEVEVEEEEEEEDAVATEEEEEKKRHVELLALPPHGSEVYLGGIPTDATEGDLKGFCGSIGEVTEVRIMREKDSGDGKGYAFVTFRSKDLAAEAIDTLNNTDFRGKRIKCSTTQAKHRLFLGNVPRNWMESDIKKAANRIGPGVQIVELPKEPQNMGRNRGFAFIEYYNHACAEYSKQKMSNPSFKLDDNAPTVSWAESRSGGGGDSSASQVKALYIKNLPRDITQERLKALFEHHGKILKVVIPPAKPGKEDSRYGFVHYAERTSVMRALKNTERYEIDGHMLDCTLAKPQADQKTNTNTVQNVQKSQLQPNYPPLLSYGMAPSPFGALGGFGASAYSQPLMHAGGHAAGGMSMMPIMLPDGRIGYVLQQPGLAAMPQPPPRHSPPYRGGSGSSSSSGSKRSSDNGRGRSRYNPY

SEQ ID NO: 50349 - protein, 636 aa, Debaryomyces hansenii CBS767
MKRAVEEESSSSSDSSDDDLVGPSLNDIPSKFENPQLVKKRKKKTIIDESKLIENIQFNEEYGDSYTQEANISCVALNPIDDSILVAGLKNGAVKFWRKKSTTGDGKNKDNNKEDKETYTGQLEFIKQFSAHPQKEVSQLIIDIDGARLASIAKNDSNVKIFDLITLDMIQVLNLNFIPSTRSNYVSCWYKSRNTNHLVISEQDTNKIHILNPDDDDFEIIKTIHRNPLNVINYNPKYQCIISADIKGIVEYWTPQEENTPKSVQFKYKSETDLLEFAKNKSPPSCINFSPDFETFVSISYPDNCIRLFDFKSGKLLKSYDESIKAYEKNETNIQLKLINSERKLYIDDPEDILKQGNIIFDESGKFLLFGTLLGIKILSLQTNKVIRVLGTSDQLQLNLRFHQLALSNKSSISNFSMEMLSSNNSILNSSLNKVPILICSAVNSDKLYLFNTLQTPRHNDIDLTVKVKGKKQKPVAVNKSSKIILHTTLGDIKLKLFNELVPKTTENFIKLCEKGYYNSTIFHRVIKTFMIQAGDPLGNGTGGESYWGGYIKDEFNSLLRHSKPFMVSMANSGPNTNGSQFFITTEKAPWLDNKHTIFGEVTDGFEAVKSIEDIETDSDDKPLDQVILLSTSLED

SEQ ID NO: 50350 - protein, 844 aa, Magnaporthe grisea 70-15
MSTTGAKVGQGLAAALGIKLRNNEPYQDEVTRGESILSVQTADTFVETRPTTKEFFQELVPSGKDVATYTRSLFPFLDWIGKYNLQWLLGDLVAGITIGAVVVPQGMAYAVLANLEPQFGLYSSFMGVLIYWFFATSKDITIGPVAVMSTLVGGIVIEMKEKFPEVPGHVVASALSIITGAIVLFLGLTRTGFIVDLISLTSLSAFMTGSAISIVIGQIPTMMGISGVSTRDASYLVLINTLKNLKTTKLDAAMGLSALAMLYIIRSACSFGAKKWPEKQKLYFFLGTLRTVFVILLYTMISWLVNMNHRSDPKFKILKDIPGGFQNAAVPVVETRVIGAMASNLPAAVIVLLIEHIAISKSFGRVNNYSINPSQEMVAIGVTNLLAPFLGGYPSTGSFSRTAIKSKAGVRTPFAGVITAVVVLLAIYVLPPVFFYIPSASLAAVIIHAVGDLITPPNTLYQFWCVSPLEVLIFFIGVIITVFSTIENGIYATVAISAAILLGRILKARGRFLGPVRVHSVLDDRIIGDDHREYGTFGQTGTGTGGASTRNIFLPIDHGDGSNPDVEVESPYPGVFIYRFTEGFSYPNASHTLEYLTRYVFAHTRRTNLTQYARPGDRPWNDPGPSKRELKRAQRSGGNLHIAGENPDLPTLKAIILDFSSVNHVDVSSVQQLIDVRNQLDRYAAPDPVDWHIACIGNRWTKRALVAGGFGYPTPRDEGSHRWKSIFSVAEIGGSDSAAAVAEKEEEQERRHAAASDADDLEKGVNVAPVHKATDGTETPRTEASSTETERAAAASGAGLKGLRPAARAVTVHGLNRPLFHVDLTSALQSAIANIEARRGGDGL

SEQ ID NO: 50351 - protein, 355 aa, Erythrobacter sp. SD-21
MKLAIFPGDGIGPEVIAEAVRVLDALFFPQLTLWEGDVGGIAYKRHGHPLPTETIEMACAADAVLFGAVGNPECDDLPREHRPEQAILGLRSELGLFANLRPAAGYPGLEDMSSLKPEIARGIDLLVVRELNGDVYFGDKGERASDGGREGWDAMSYNEAEVRRIAHTGFRAAQKRRGRLTSVDKANVLESSRIWRETVVEVAKDYPDVTLDHMYVDNAAMQIVRSPGQFDVILTGNLFGDILSDQASACVGSIGLMASASMGERQTEYGTFGLYEPIHGSAPDIAGQGKANPIAAILSLAMLLRHSLGREGEAGRIERAVAKVVAGDVRGADLGGTASTSQIGDAVLNALAAES

SEQ ID NO: 50352 - protein, 266 aa, Listeria innocua Clip11262
MKKIGFIGAGNMGAAMIRGLAKANLGKEEDILVCGRDMEKLKPLKTEFNGIQLTTDIAQLAEQADIIILSVKPYTIPEILTAVKDKITPEKIVISVAAGVTIKDLEELTSTETKIVRVMPNTPALVGEAMSSISPNSNVTAEETAHISTIFSSFGKAEVVAENLMDAVVGVSGSSPAYVYMFIEALADGAVLKGMPRDKAYKFAAQAVLGAAKMVLETGEHPGKLKDMVTSPGGTTIEAVKSLEDTGFRSSVISAVQAAANKNSSM

SEQ ID NO: 50353 - protein, 337 aa, Thermus thermophilus HB8
MKTYALVMAGGRGERLWPLSREDRPKPFLPLFEGKTLLEATLERLAPLVPPERTLLAVRRDQEAVARPYADGIRLLLEPLGRDTAGAVLLGVAEALKEGAERLLVLPADHYVGDDEAYREALATMLEAAEEGFVVALGLRPTRPETEYGYIRLGPREGAWYRGEGFVEKPSYAEALEYIRKGYVWNGGVFAFAPATMAELFRRHLPSHHEALERLLAGASLEEVYAGLPKISIDYGVMEKAERVRVVLGRFPWDDVGNWRALERVFSQDPHENVVLGEGRHVALDTFGCVVYADRGVVATLGVSGLVVAKVGDEVLVVPKDWAREVREVVKRLEAQE

SEQ ID NO: 50354 - protein, 82 aa, Triticum aestivum
  misc_feature (61)..(61): Xaa can be any naturally occurring amino acid
  misc_feature (65)..(65): Xaa can be any naturally occurring amino acid
  misc_feature (67)..(70): Xaa can be any naturally occurring amino acid
  misc_feature (73)..(74): Xaa can be any naturally occurring amino acid
SAALKMVEEVRRQFNTIPGLMEGTAKPDYATCVKISTDASIKEMIPPGALVMLTPLIVGTXFGVXTXXXXLGXXCFGGKIQE

SEQ ID NO: 50355 - protein, 371 aa, Schizosaccharomyces pombe 972h-
MSQTEIVKKPKHKRFKRPDKSRFVQQTLPAWQFIFTPWTVLPLLFLLGIVFAPLGAGMFVASRRVKELRIDYTDCMNIGDEFKQVPSTNIEFQYKNVKNVTAMWKSSGDVCTLRFQIPEEMTSPVFAFYRLKNFYQNHRRYTVSADMFQLLGEARTVAQLKSYGFCKPLEANEEGKPYYPCGIIANSLFNDSYSSLLRYESFDSSNSLGLYNMTTNGTAWPEDRERYKKTKYNASQIVPPPNWAKMFPNGYTDDNIPDVSTWDAFQIWMRAAALPTFSKLALRNVTTALQPGIYEMNITYNFPVTEYKGTKTIMFSTTSVIGGKNYFLGILYFVIGGLCAASGVILSIACLIKPRRVGDPRYLSWNRGKSS

SEQ ID NO: 50356 - protein, 450 aa, Erythrobacter sp. SD-21
MAETYDYDLFTIGAGSGGVRASRVSAAHGAKVAIAEEHRVGGTCVIRGCVPKKMLVYGAHFAEDLEDCQRFGWEIGEKKFDWAKLRDNVLADVDRLEGAYTDTLNNHEVTIFKERAEITGPHEITLASGRKVTAKYILIATGARPRMPECQGAEHAISSNEAFHLDELPKKIIIAGGGYIANEFAGIFNEFGCDVHIVNRGDRLLRSYDEAVRDRLLQISTMKGIKFRFNTTFEYIKPCDEGGYFVKMSDSDEEKADLVMFAVGRIPNTEGLGLDKAGVELGEGGEIKVDRFSKTSVDHIYAVGDVTDRVQLTPVAIREGQAFADMVFGGCDPVAVDHSCIPSAVFSHPPIAAVGMTEGEAKNQLGSVKVYLSDFRPMKNVLAGRNERSLMKMVCDGDSGKIVGIHLIAPEAPEMMQAAAIAVKAGLTKADFDATTAIHPTMAEELVLMR

SEQ ID NO: 50357 - protein, 455 aa, Erythrobacter sp. SD-21
MTQFTDLGLSQPVLQALDIKGYTTPTPIQAQAIPPVLEGRDLMGIAQTGTGKTAAFMLPSIDRLRDADKQSPFKSCRMLILAPTRELAGQIADSAKDYGALAGLKVHSIVGGTSVNKDRNKLHRGTDILVATPGRLLDLIDQKAFTLDKVEILILDEADQMLDLGFIHALRKISELVPDDRQTLFFSATMPKQIQELVGKYCRNPVKVSVTPESTTAERIDQYLFMVQQDEKQTLLEMILSERHQVPGKFERVLIFARTKHGCDRIVKKLGQSGIPANAIHGNKSQPQRERALDEFKRAKTPILVATDVAARGIDIPGVSHVLNYELPNVPEQYVHRIGRTARAGRDGVAIAFCAEDERDYLKDIRKKTDAEFERLPLPDNFRAVVEGVGPTKREQKPKLARPKVRPTGGAAKPKPKQKHPARKGKPAGAGQGGRPGGRPGGNRNRSRNRRSSQG

SEQ ID NO: 50358 - protein, 553 aa, Oryza sativa Japonica Group
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 50359 - protein, 339 aa, Francisella tularensis subsp. holarctica
MNKKILVTGGVGYIGSHTVVELLDRDYQVVVVDNLSNSKVSVIDRVKKITNKDFDFYQLDLLGKAKLTKVFQEHDIYAVIHFAGFKAVGESVEKPLEYYHNNIQGTLNLLELMQEYKVYNFVFSSSATVYGMNNKPPFTEDMPLSTTNPYGATKLMLEDILRDLQNANNNFNITCLRYFNPVGAHSSGMIGEDPQGIPNNLMPYVAQVGAGKLAKLSIFGGDYETIDGTGVRDYIHVVDLAIGHILALEKLSQDKPSWRAYNLGSGNGYSVLEIVKAYQKALGKEIPYQIVARRTGDIAASFADVAKAKRELGFETQKTIDDICDDMLKWQKYAKENNI

SEQ ID NO: 50360 - protein, 222 aa, Francisella tularensis subsp. holarctica
MKHIQINPSILSADLARLGDDVKAVLAAGADNIHFDVMDNHYVPNLTFGPMVLKALRDYGITAGMDVHLMVKPVDALIESFAKAGATSIVFHPEASEHIDRSLQLIKSFGIQAGLALNPATGIDCLKYVESNIDRVLIMSVNPGFGGQKFIPAMLDKAKEISKWISSTDRDILLEIDGGVNPYNIAEIAACGVNAFVAGSAIFNSDSYKQTIDKMRDELNKV

SEQ ID NO: 50361 - protein, 260 aa, Mycobacterium leprae TN
MTAMAADIDLQGDRESELMHALATVRSRLAAASQAAGRNVGEIELLPISKFFPATDVAILSRLGCRSVGESRAQEASTKAAEFAELLGVSREEKSSIHWHMVGQIQRNKVRSLAQWAHTAHSIDSLQLVAALDRAVAAALAGGRREQPLQVYVQISLDGDISRGGVNVTAPGAVDRVCAQVEESKSLELVGLMGIPPLGWNPDQAFEQLRLEHRRVLRSHPDAIGLSAGMSNDFEIAVKHGSTCVRVGTALLGPSRLRSP

SEQ ID NO: 50362 - protein, 127 aa, Oryza sativa Indica Group
MAAAARFLAVLLLVLAVAAASSAAASLAGSGDRHLQLGMLSTGGECRGTVGECLEGGDVDGEEGELGSASGEAHRRVLAGRGYISYQSLRRDSVPCSRRGASYYNCRPGASANPYHRGCSRITRCRG

SEQ ID NO: 50363 - protein, 481 aa, Sorghum bicolor
MTRAHLPAAAAGAAQRRPTVALLLGLALAFCLAVLSIQSSFFAAPGAPSRRLDLDADDVRELAGFQSRVQQCVASRGLGLTADIIDHCKLVLKFPEGTNSTWYNTQFKIFEPLEYKYDVCEAILLWEQYRNMTTVLTREYLDVRPDGWLDYAANRIAQLGADKCYNRTLCDELLSILLPAKPPFHPRQFATCAVVGNSGDLLKTEFGQEIDAHDAVFRDNEAPVNKKYAKHVGWKRDFRLVVRGAARNMAPILKGSSNEALIIKSLTHKEINAVIKELPNPVYLFQGIVLRRGAKGTGMKSIELALSMCDIVDMYGFTVDPNYTEWTRYFSPPRKGHNPLQGRAYYQLLECLGVIRIHSPMRAKRVEDWSDIVSKEEIRRAHAAAFHLKKHETGQSAELGPFSNCKVWGTVDPDNGPVSGTSDMSETRKNSNYSKWELLPLEKLRREAQEHHIQMGGVSLYKMDGNKLDDLVCVRHQRSSS

SEQ ID NO: 50364 - protein, 508 aa, Oryza sativa Japonica Group
MEGGGRGGGPVVAALLLAALLLAAVAPASASSYPAKVVSGFLSNAASSVMKRLWSLKSTTKTGSGGKSMVKYEGGYTVETVFDGSKLGIEPYAVEVTQGGELLVMDSMNSNIYRIALPLSRYSRPKLVAGSPEGFPGHVDGRPREARMNHPKGFTVDGRGNIYVADAMNMAIRKISDTGVTTIAGGKSSRGGHVDGPSDDAKFSTDFEVRYIGSSCSLLVIDRGNQAIREIQLNFDDCVYQYEAGFPLGVAVLLAAAFFGYMLALLQRRVLGMVSTEDEPETQTPLKASIASIPPYQKPLKQSVRPPLIPNEDESEKQEVEEGFFTSIGKLIVGAKSSVAEIVGAAFSRKKRLNIHQQQARVRSWPVQESYAIPRDETPPPLDTRTPTPRKNYAFMSKEPEKIHHIRHGRSQFNGWNGDAPQQQQQQQQQQQIHHQQYLQHHRQYSSGPQTFYEPSCEATNEIVFGAVQEVDSKRRAVEIKPMNHGDPQYDQDGLRHRSSYTGYSNNW

SEQ ID NO: 50365 - protein, 134 aa, Cryptococcus neoformans var. neoformans JEC21
MVVNGRRDARSKWPAVAANSQGIQTLLEAEKEAAKVVQKARQYRVQKLKDARSEAAKEIEAYKAKKEEEFKRFESEHISRTSTSQTSIDSTTKTQLSELDDAVAKNKEEVVKKIVSRVLQSKPHLHPNLKKLEA

SEQ ID NO: 50366 - protein, 419 aa, Treponema denticola ATCC 35405
MIKTVKDVNLKDKRIIMRVDFNVPMKDGVVQDDTRIRAALPTIKYILEQGARSLVLMSHLGDPSKDAKKAKEKAEKDGKPFDEEAYINGKHRMKPVAEYLSGLLKLPVDFAPSCMGQLERVKALPQGGILMLENTRFHKEETSKEKAEQQILAKELSLYGDIYVNDAFGTAHRSHASTAEIANFVNTRVAGFLMEKEIKYLEPMLNNPAKPMTAIIGGAKVSSKIAVLESLLKNASSLIIGGGMAYTFLKVQGKKIGKSLFEEDFMDTAKNLLDKAEKQGVKIILPVDHICSETFSPNAEAVLVESTDIPDNLMGMDVGPKTLALYKEIILSSKSIVWNGPVGVFEFEAFSKGTEETARLVAAATEKGALTIVGGGDSVAAVNKFNLADKMSHVSTGGGASLEFLEGKVLPGIACLDTI

SEQ ID NO: 50367 - protein, 459 aa, Rickettsia akari str. Hartford
MQEFDLVVIGSGPAGYTGSIRAAQLGMKVVCVEKNDTLGGTCLNIGCIPSKALLNSSEKYEEALKHFESIGITADVKLDLQKMIANKDKVVSDLTKGIESLFAKNKITRIKGEAKIIASNIVEVNNEQIKAKNILITTGSSVIEIPNIKIDEEFIVSSTGALKLSKVPETLIVVGGGYIGLELGSVWRRLGAKVTVIEYAPSIVPMLDKEIATQFMKLQQKQGIEFKLNTRVLSAEVKSGKVNLTIEEGGKSAVVTSDVILMAVGRKAYTQNLGLESVGIITDKQGRIEINDRFQTAISNIYAVGDVVKGAMLAHKAEEEAVAAVEIMAGQAGHVNYNLIPSVIYTYPEVASVGETEEQLKAKGINYKVGKFPFLANSRARAIGSTEGLVKILADSKTDRVLGAHIIGANAGTLIAELTAYMEFGAASEDIARTCHAHPTLSEAIKEAALSVDKRSINM

SEQ ID NO: 50368 - protein, 499 aa, Arabidopsis thaliana
MSIFLCFLLLLPLFLVFYKRLLPSKGKLPPGPISLPIIGNLHQLGKSLHRSFYKLSQEYGPVMFLRFGVVPVVVFSTKEAAEEVLKTHDLETCTRPKLSATGLFTYNFKDIGFAQYGEDWREMRKLAMLELFSSKKLKAFRYIREEESELLVKKVTESAQTQTLVDLRKALFSYTASIVCRLAFGQNFHECDFVDMDKVEELVLESETNLGSFAFIDFFPAGLGWAIDRISGQHSRLHKAFARLSNFFQHVIDDHLKPWQSEDHSDIVGVMLDMINKESKVGSFKVTYDHLKGVMSDVFLAGVNAGAITMIWALTELTRHPRVMKKLQQEIRELLGDNKEKITEQDLEKVHYLKLVIQETFRLHPPAPLLLPRETMSDVKIQGYNIPKNTMIEINTYAIGRDPNCWTNPNEFIPERFVDSPIDYKGQHFELLPFGGGRRICPGMATGMTIVELGLLNVLYFFDWSLPYGMAIADINMEEAGAFVIAKKVPLELVPVLHY

SEQ ID NO: 50369 - protein, 523 aa, Treponema denticola ATCC 35405
MKKKPLSAKIVFMKITEKILIVDFGGQYNQLIARRVRDLNVYSDIVPASKALDYIRENKPIGIIFTGGPNSVYEEKAPLPPKEIFNLNIPILGICYGMQAMAHCLGGKVEKSLKREFGKTLTKFDTGIPLFKNIKDKSSVWMSHVDCVSRLPEGFVSAAQTANTKNAAMANKEKKLYGIQFHAEVEHSEEGQNIIKNFLYNVCGAKGDWNMKSFLAEAIKDVQNTVKDGKVLLALSGGVDSSVLAALLNRAVGKNLTCIFVDHGLMRKNEGDEVEAAFRDTPMNFIRVNAESRFLGKLKGVSDPEKKRKIIGEEFIRVFEEEAEKIGTVDFLAQGTIYADVVESGTKGSAVIKSHHNVGGLPDHISFKSLIEPLKTLFKDEIRNLGTELGLPDYLVHRQPFPGPGLAIRIMGEITEEKLDILREADAIWRSELEHADIKKDLSQYFAVLTSTKTVGVMGDFRTYDYTLALRAVKTSDFMSADWVRIPYEVLDKVSSRIINEVKGINRIVYDITSKPPATIEWE

SEQ ID NO: 50370 - protein, 168 aa, Triticum aestivum
  misc_feature (55)..(55): Xaa can be any naturally occurring amino acid
MSFCRLESRGNGFLVLTMASADEHNYLTEEAITELVEVLKKVGNNAEAKGLVTTXRAGTFCAGLDYDHHAESEEQAEHLAGRVAEVIRLLLELPVPTVAAVRGNATSLGLALALAHDHCFVWDHAVLGLPEARRGRRLPDYVATLLRDKLSFARLRKLLMLRSQTCTG

SEQ ID NO: 50371 - protein, 637 aa, Shewanella sp. ANA-3
MISINQAQLIRGSKTLLDEASLTIYPGHKVGLVGANGTGKSSLLALIMGHLSLDKGEFSMPSGWQIATVAQETPALEVSALEYVLDGDKEYRQLEADLHIAQEHNDGHAIATLHGKIDAIGGYAIRARAGALLAGLGFSEAEQNNPVKSFSGGWRMRLNLAQALLCRSDLLLLDEPTNHLDLDTMYWLEGWIKSYQGTLILISHDRDFIDEIVDEIVHVENQKLNYYKGNYSAFERIRAERMAQQQVAYERQQKERAHMQSFVDRFRYKASKAKQAQSRLKALERMTELLPSQADSPFYMEFRPPEALPNPLIKMEQVAVGYGDKQILSRVHLNLVPGARIGLLGRNGAGKSTLIKLLSGQLSPMTGLYEPNPGLNIGYFAQHQIEFLRLDDTPLQHLVRLAPNAREQELRNFLGGFGFHGDMALSPVRPFSGGEKARLVLALLVWQRPNLLLLDEPTNHLDLEMRHALTMALQTFEGAMVIVSHDRHLLRLTCSDYYLVDQGQVQAFDGDLEDYHQWLLDAAKAASANSTVNGDDAKPAVDKKQQKRLEAELRQKVSPLKRKQAKLETDQQKLSERLAELEHLLADSELYDQDNKAKLTSVLSERTSLTQTLEESEMQWLELQEEIDAMELELMGQ

SEQ ID NO: 50372 - protein, 262 aa, Hyphomonas neptunium ATCC 15444
MTGQDSKERIVSFGFEDVTETEKVARVKGVFRSVASRYDLMNDLMSAGVHRLWKHDAMNRINPQPGERHLDVAGGTGELGRAFLDLADKAGKRRGDTRQATAIVSDINDAMLEAGKARSDNARWGDRLSWVCADGQKLPYPDKSFDVVTVSFGIRNFADRVAGLKEFRRVLKTGGRLAVLEFSHMTAPILQDAYDRYSFAVIPRLGELITSDRDSYQYLIESIRKFPDQQTFKSEIEDAGFSQVSVTNYSGGIAALHFGWAV

SEQ ID NO: 50373 - protein, 196 aa, Microcystis aeruginosa PCC 7806
MTHAPISPVVLVILDGWGYRPQRSDNAIAMAKTPIMDSLWEVYPHTLIRTSAKDVGLPEGQMGNSEVGHLNIGAGRVVPQELVRISDAIEDGSIQQNQALLKLCDEIRPKKSKLHLIGLCSEGGVHSHLDHLLGLLDLAKVQGISDVCIHVITDGRDTNVTDGMPAIKRIQEHINKINLGRLVTLSGRYYAMDRDR

SEQ ID NO: 50374 - protein, 326 aa, Arabidopsis thaliana
MLFSGSAIPLSSFCSLPEKPHTLPMKLSPAAIRSSSSSAPGSLNFDLRTYWTTLITEINQKLDEAIPVKHPAGIYEAMRYSVLAQGAKRAPPVMCVAACELFGGDRLAAFPTACALEMVHAASLIHDDLPCMDDDPVRRGKPSNHTVYGSGMAILAGDALFPLAFQHIVSHTPPDLVPRATILRLITEIARTVGSTGMAAGQYVDLEGGPFPLSFVQEKKFGAMGECSAVCGGLLGGATEDELQSLRRYGRAVGMLYQVVDDITEDKKKSYDGGAEKGMMEMAEELKEKAKKELQVFDNKYGGGDTLVPLYTFVDYEAHRHFLLPL

SEQ ID NO: 50375 - protein, 400 aa, Synechococcus sp. RS9916
MAQESASGQPLIYLDHAATSQKPLAVLDALRDYYSCDNANVHRGAHQLSARATEAFEGARLITAQFVAAASPREIVFTRNASEAINLVARTWGDAELKPGDEVLLTVMEHHSNLVPWQQLAQRTGCVLRHVGVTEQGTLDLEDLRAKLNARTRLVGLVHISNTLGCCNPVDDVVALAAQHGARVLLDACQSLAHKSLDVGQLGIDFLVGSSHKLCGPTGMGFLWAREALLESMPPFLGGGEMIQDVFLDHSTWAELPHKFEAGTPAIGEAIGMGAAITYLQTLGLEAIQAWEAQLTAHLFSRLQAIDGLRILGPTPEQQPERGALATFLVDGLHANDIAAMLDLSGVCIRSGHHCCQPLHRFYGVPGSARASLSFTSTFDEIDRFVDELTSTINFLREHS

SEQ ID NO: 50376 - protein, 262 aa, Silicibacter pomeroyi DSS-3
MTGELSPIDKAKFVAAKRAADLVEDGMRVGLGTGSTAAWLVRCLGDMVRKEGLKMRGVPTSTRTAQLAREVGIEVITLDEARWLDITIDGADEFDGDLNLIKGGGGALLQEKIVATASDQMVVIADLGKEVSRLGAFPLPVEVIPFGWQTTQALLEETLISMDVLGRTATLRMNGDTPFVTDEGNHILDLHLQRIGNARQLALVLNQIPGVVENGLFIDICDTVVVGHGDGRVEIRDINQGTVEHDRLDFVESDNLFTDLAD

SEQ ID NO: 50377 - protein, 452 aa, Silicibacter pomeroyi DSS-3
MSFDYDLFVIGGGSGGVRAARVAAGETGAKVALAEEDRYGGTCVIRGCVPKKLMVFASEYSGMVEDAQAYGWNIQPGAFDWDVFRSKLYTELDRLEGVYRNILKNNGVETFDMRARLVDAHTVELSDGTRKSAKHILIATGGRPVKPEIKGAELAITSNEIFHLDKLPERMLIVGGGYIACEFVGIMNGMGVEVTQYYRGAQILRGFDDEARGLVSEEMCQNGIKLHLGTNVLEMEREGDRIRVKATNGDEELFDQVMFATGRVPNADHLGLEGLGVELGRKGQIVVDDYSQTAVPSIYAIGDVTDRVNLTPVAIREGMAFVDTVFRGKPTPVDHALIPTAIFTQPEMGTVGLSEEEAAAQEPVEIYATSFKPMQTAFAGRSQRVLMKLIVSKATRKVLGCHIVAPGAGEMIQLVGIAVKMGATKEDFDRTVAVHPVMAEELVTLRQPVRSA

SEQ ID NO: 50378 - protein, 231 aa, Arabidopsis thaliana
MATSSTQLLLSSSSLFHSQITKKPFLLPATKIGVWRPKKSLSLSCRPSASVSAASSAVDVNESVTSEKPTKTLPFRIGHGFDLHRLEPGYPLIIGGIVIPHDRGCEAHSDGDVLLHCVVDAILGALGLPDIGQIFPDSDPKWKGAASSVFIKEAVRLMDEAGYEIGNLDATLILQRPKISPHKETIRSNLSKLLGADPSVVNLKAKTHEKVDSLGENRSIAAHTVILLMKK

SEQ ID NO: 50379 - protein, 511 aa, Campylobacter jejuni subsp. jejuni NCTC 11168
MKKADILVLDFGSQYTQLIARRLREQGVYAEILPFNVSLADIKAKEPKGIILSGGPASVYATDAYFCDKGIFDLNLPVLGICYGMQLMAHHYKATVAPAGHKEYGKANIEIKKDNALFKNLPKKQTVWMSHSDKVENLPQGFEVLATSENSPFCVFGNEDKKFFALQFHPEVQHSEFGKNILKNFAKYACNCESIWNMGSFAKTQAEKIREEVGNDKVLCAVSGGVDSSVVAALLASAIKEQIIVVFVDNGLLRSGEKEQVEFMFKNTLGIDLISIDASEIFLSRLVNVTDPEQKRKIIGNTFIEVFEEEAKKHKDVKYLAQGTLYTDIIESSVVGASKTIKSHHNVGGLPEKMNLKLIEPLKEIFKDEVRALGLELGLSKEVVYRHPFPGPGLAIRIMGEVNRASLELLRKADVILLEELKSTGWYDKTWQAFCVLLNVKSVGVMGDNRTYDNAVCIRVVDASDGMTATFSHLPYEILENISRRIINEVEGINRVVYDISSKPPATIEWE

SEQ ID NO: 50380 - protein, 462 aa, Glycine max
DEARRINAPHDHHLFSAKYVPFNADPSSSTTESYSLDEIVYRSQSGGLLDVQHDMDALKRLDGEYWRNLFDSRVGKTTWPYGSGVWSKKEWVLPEIHDDDIVSAFEGNSNLFWAERFGKQFLGMNDLWVKHCGISHTGSFKDLGMTVLVSQVNRLRKMNRPVVGVGCASTGDTSAALSAYCASAAIPSIVFLPANKISLAQLVQPIANGAFVLSIDTDFDGCMQLIREVTAELPIYLANSLNSLRLEGQKTAAIEILQQFDWQVPDWVIVPGGNLGNIYAFYKGFKMCQELGLVDKIPRLVCAQAANADPLYLYFKSGWKEFKPVKSSTTFASAIQIGDPVSIDRAVHALKSCDGIVEEATEEELMDATAQADSTGMFICPHTGVALTALFKLRNSGLIKATDRTVVVSTAHGLKFTQSKIDYHSKDIKDMACRYANPPMQVKADFGSVMDVLKTYLQSKTH

SEQ ID NO: 50381 - protein, 481 aa, Pseudendoclonium akinetum
MVLSIQTNKNVGSITQIIGPVIDAAFAPGQLPNIYNALVIKGTNQAGQEVAVTCEVQQLLGDHCVRAVAMNATDGLMRGMNIVDTGKPLTVPVGKVTLGRIFNVLGEPVDGLEAVDSKESLPIHRKAPAFVDLDTKLAIFETGIKVVDLLAPYRRGGKIGLFGGAGVGKTVLIMELINNIAKAHGGVSVFGGVGERTREGNDLYMEMKESGVIQEKNMSASKVALVYGQMNEPPGARMRVGLTALTMAEYFRDINKQDVLLFIDNIFRFVQAGSEVSALLGRMPSAVGYQPTLATEMGGLQERITSTKDGSITSIQAVYVPADDLTDPAPATTFAHLDATTVLSRGLASKGIYPAVDPLDSTSTMLQPWIVGEEHYSCAQNVKETLQRYKELQDIIAILGLDELSEEDRKVVARARKIERFLSQPFFVAEVFTGSPGKYVSLKETIQGFNKILTGELDDLPEQAFYLVGTLDEAVAKAATL

SEQ ID NO: 50382 - protein, 395 aa, Thermus thermophilus HB8
METRTLEDWRALLEAEKTLDSGVYNKHDLLIVRGQGARVWDAEGNEYIDCVGGYGVANLGHGNPEVVEAVKRQAETLMAMPQTLPTPMRGEFYRTLTAILPPELNRVFPVNSGTEANEAALKFARAHTGRKKFVAAMRGFSGRTMGSLSVTWEPKYREPFLPLVEPVEFIPYNDVEALKRAVDEETAAVILEPVQGEGGVRPATPEFLRAAREITQEKGALLILDEIQTGMGRTGKRFAFEHFGIVPDILTLAKALGGGVPLGAAVMREEVARSMPKGGHGTTFGGNPLAMAAGVAAIRYLERTRLWERAAELGPWFMEKLRAIPSPKIREVRGMGLMVGLELKEKAAPYIARLEKEHRVLALQAGPTVIRFLPPLVIEKEDLERVVEAVRAVLA

SEQ ID NO: 50383 - protein, 297 aa, Schizosaccharomyces pombe 972h-
MENYQKVEKIGEGTYGVVYKARHKLSGRIVAMKKIRLEDESEGVPSTAIREISLLKEVNDENNRSNCVRLLDILHAESKLYLVFEFLDMDLKKYMDRISETGATSLDPRLVQKFTYQLVNGVNFCHSRRIIHRDLKPQNLLIDKEGNLKLADFGLARSFGVPLRNYTHEIVTLWYRAPEVLLGSRHYSTGVDIWSVGCIFAEMIRRSPLFPGDSEIDEIFKIFQVLGTPNEEVWPGVTLLQDYKSTFPRWKRMDLHKVVPNGEEDAIELLSAMLVYDPAHRISAKRALQQNYLRDFH

SEQ ID NO: 50384 - protein, 525 aa, Erythrobacter sp. SD-21
MTKSAADIWSELAALPKPTLLELFSASRDGGEGADEPGGKDRVAMLSGRIELAGEAKGDPMAPGGILFDWSKTHLDWAVLGKFAELAEAMDFAGMRAKLFGGEIVNPTEGRAADHATLRGVGDEAKVEEAAALIDRMGMLVEAIHEGALGEIEHLIHIGIGGSALGPALGVDALAREFARCDVHVVSNIDGVALETAFAKCDPAKTLIAVASKTFTTIETMTNAASALKWLGENGVSDPGGRVVALTANPEAAVEWGVDETRVLPFQESVGGRYSVWSSIGFPIAMAVGMDEFREMLAGAAEVDAHFRDTPLEDNLVLRAAFADLYYTRVRGCQTRAVFAYDERLGLFPDYLQQLEMESNGKRVTADMQPVDGPTAPITWGGVGTDAQHAVFQLLHQGTHLIPVDFIASIAPGDALDPAHHRILLMNCFAQGAALMAGKKGEDPARNYPGDRPSATILCDDLDAATLGALIAFHEHRTFAGAVLMGINPFDQFGVELGKQMAKAIENGEADFDASTRRLLEQAGL

SEQ ID NO: 50385 - protein, 480 aa, Ashbya gossypii ATCC 10895
MLRCREVYNICKGAMSNEVKHYDYLVIGGGSGGVASSRRAASYGAKTVLIEGKALGGTCVNVGCVPKKVMWYASDLAHRLLHARDYGLLQEVDISKEKLHFNWKEFAGKRNAYVERLNGIYERNLAKEGVEYVHGWARFNSEGQVEVTRPDQTTEKYTADHILIATGGEPVLPEGIPGAEYGVDSDGFFRLEEQPKKVVISGSGYIATEFAGVFNGLGTETHIVIRKDHVLTKFDPSIQEIVTEHYEKEGVNIHKKESIQRVEKDPNTGKLTVHLSGKIIEDVDQLVWAIGRKSLLGIAPENVGVKLGETGHVVVDEYQNTSTKGIYALGDVVGNMELTPVAIAAGRKLANRLFGPEQMRAQKQDYDNVPSVVFSHPEAGSIGLTEPQAIERYGKENIKIYQTKFTAMYYAMLEDKSPTKYKLICAGPEEKVVGLHIVGDGSAEILQGFGVAIKMGATKADFDSCVAIHPTSAEEIVTLK

SEQ ID NO: 50386 - protein, 236 aa, Ashbya gossypii ATCC 10895
MKLNISYPVNGTQKTIEVDDEHRVRVFYDKRIGQEVNGEAVGDEFKGYVFKIAGGNDKQGFPMKQGVLLPTRVKLLMAKGTSCYRPRRNGERKRKSVRGAIVGPDLAVLALIITKKGDQEIEGITNESVPKRLGPKRANNIRKFFGLTKDDDVRDFVIRREVVKGDKTYTKAPKIQRLVTPQRLQRKRHQRALKVRNAQAQREAAAEYAQLLAKRLTEKKAEKAEERKRRASSLKA

SEQ ID NO: 50387 - protein, 577 aa, Physcomitrella patens subsp. patens
MKWAGSWVLATVLAVAGLAKAAVVEYHFKVAYMSAAPDCYSKTIIGINGGYPGPTIRATQGDTVKVTFENHVVTEGITMHWHGIRQIGSPWADGTAAISQCPILYGESFTYEFIVDRPGTYFYHGHFGCQRAAGFYGPLIVDLPKDKHEPFTYDGEHMIILNDWWHRSIVGQEQGLESINFAWVGEPQSLLLEGRGRYNCSNVPEYKPAGLSCNQSDERCAPHVWSVERGKTYRLRLASVASLSSLNFKIEGHSMKVVEADGHSIEPFWTDNLDLYSGETYSVLVKADKQGDNFHLGLNVRGRNDEQVPTGLGILNYKDKPVQQPTTPAPKGPAWNDFEASKRQAKTYKALQNNPDPTSHPFDASAPVTRTLVLLTTQNKVEGRIKWSINNLTYAPLQTPLLAGLVYNISGAYDTTPPPDYPAHGYNIFAPPEPPHTNVGSGMYQFNTGDVVDVIIQNAAALNNVSEIHPWHLHGHDFWILGYGEGQFDPAESPKSYDLKSPPTRNNVATFPFGWTAVRVHLDNPGAWPFHCHVEWHFHMGMGVVFTHGIDSVRARGIPNSVLGCGLTKQLFSLPSP

SEQ ID NO: 50388 - protein, 365 aa, Thermomyces lanuginosus
DLKPENVLIEVGDVEQIVKTYVKEEPKKEEKDNRNGRRRRRTLITGSQPLPSPLNASFGHTDKYGSHNSLNHMVNDGGGKDSLNVPEDERQQREKTADLLEREVSGISLDKKTEPQKQQTDIISVKIADLGNACWVGHHFTNDIQTRQYRSPEVILGAKWGASTDVWSMACMVFELITGDYLFDPQSGTKYGKDDDHIAQIIELLGHFPRSLCLSGKWSQGNLQPQRRTPKHPSAAPLGAPGRAAGRNTISLSRRASRSATFCCQCCIWFRRNGPMPAVWPVMSGSRIHQAWTALIWEFRRGLGARASKAGHARSNGGDFMILCFVALYSGWMDGIYCVLDKLDVDLISFMMTYRELCRRGLPMI

SEQ ID NO: 50389 - protein, 381 aa, marine gamma proteobacterium HTCC2143
MSGLSATHTLDKIGLTMSTPARVVVLPNGSNSLEVQDLIIPDPGPHQVVVKQFASGICHSQLHQMRGTERDSSLMLGHESTGVVLQTGSDVKGLSEGDIVLVTWVPKDAANTPRAPESATLETADGSIAISQAVFTWATHTIADEQYVVKVEGDIDTQVTSIIGCAVITGAGAVENTAGVKAGDSVAIFGVGGVGMSAIVAAKKLGANPIIAVDLDADKLVFARQFGATHTINGKEEDPVAAIKALTQHPGKRDFMGDDISGADFVFDCIGVKETMETIPQAARGGHFGVDNGGTAILVGVPHTSVELNAIDMLLNEKKFIGSFAGSCTPSRDFSKYVDWHRSGDLDLDALVTERYSIDDINEATTRLGNGLISGRAIIEF

SEQ ID NO: 50390 - protein, 189 aa, Desulfotalea psychrophila LSv54
MKQVLTVPNILTGFRFALVPVLVVLLSLEQNTWVEFWAWFVFFVAAVTDFVDGWVARRYKIETVLGKLMDPLADKVLVSTGLIMLIPLGKVAAWVCLLIICREIIVTGFRGLAATTGKVVAAGQIGKYKSTMQYFGIGLLIFPLNVVPFPYQYETGTFLLYVSMVLSVWSAVVYFYNLRSVFLETSTSF

SEQ ID NO: 50391 - protein, 371 aa, Zea mays
MENLRSQNCHQGVAMEGVKFAPEKANTNRRALSDIKNIIGGPHQHLAVSKRALSEKPAAAAAANAKDQAGFVGHRPVTRKFAATLATQPTVALLDPIGSERLKRNADTAFHTPADMESTKMTDDSPLPMVSEMDEMMSPELKEIEMEDIEEAAPDIDSGDAGNSLAVADYVDEIYRFYRKTEGASCVPTNYMSSQTDINEKMRGILIDWLIEVHYKLELLEETLFLTVNIIDRFLARENVVRKKLQLAGVTAMLLACKYEEVSVPVVEDLILICDRAYTRADILEMERRIVNTLNFNMSVPTPYCFMRRFLKAAQSEKKLELLSFFMIELSLVEYEMLQFCPSMLAAAAIYTAQCTINGFKSWNKCWFALG

SEQ ID NO: 50392 - protein, 124 aa, Triticum aestivum
  misc_feature (12)..(12): Xaa can be any naturally occurring amino acid
  misc_feature (36)..(36): Xaa can be any naturally occurring amino acid
MQQGIIKYKKKXRAWDEQANSWKRTYCYGCVNDDRXVPIVEAKLTDEPGVDPFAQRREEKKSSIDKQEINRRGNLKNGPSSDFLPGEGRRSGDWLRRRWPPSAERQLAYNEDLHKGATRSAWTS

SEQ ID NO: 50393 - protein, 470 aa, Pseudomonas fluorescens Pf-5
MSTSNQQPQPAAPRSTQDYQAADAAHHIHAFLDQKALNAEGPRVIVRGEGLHLWDNDGKRYLDGMSGLWCTNLGYGRKDLAAAASAQLEQLPYYNMFFHTTHPAVVELSELLFSLLPGHYSHAIYTNSGSEANEVLIRSVRRYWQILGQPQKKVMIGRWNGYHGSTLAATALGGMKFMHDMGGLIPDVAHIDEPYWFAHEGNLTPAEFGLRCARQLEEKILELGAENVAGFIAEPFQGAGGMIFPPESYWPQIQRICRQYDVLLCADEVIGGFGRTGEWFAHQHFGFEPDTLSIAKGLTSGYIPMGGLVLSKRIAQVLVEQGGVFAHGLTYSGHPVAAAVAIANLKALRDEGVVSQVKNDTGPYLQQCLREVFGNHPLIGEIQGTGLVAALQFAEDKASRKRFANENDIAWRCRTLGFEEGVIIRSTFGRMIMAPALVASRGDIDELVDKTRRAVERTAGEIEAGTLPSS

SEQ ID NO: 50394 - protein, 473 aa, Pseudomonas fluorescens Pf-5
MSPTSKGGLRRVLGLGSLVSVAVGLVVSQGVMVLMLQGAGMAGLGFFIPLLLAYLLALTYALSFSELALMVPRAGSLSSYTEVAIGHFPAILATFSGYMVVAMFALSAELLLLDLIIGKVYPGALPPMLVAYGVLGVFTLLNLLGIDVFAKLQTVLAVVMVVILLTLGLGAVSSAQADLQLPLDQGWNPLQVGALALAAMAIWGFVGAEFVCPLVEETRNPERNIPRSMIIGLSVIFLVITLYCLGALLCVPRAQLASDPLPHFLFATTVFGEAGKLFLVGAVITATCSTVNSSLAALPRMLYGMAQNGQAFPQFKRLSPRGRTPWVAVLFVAALTGLPILLLGQDPDSISLLLLAAALAWLLAYIVVHIDVIALRRRYPDAPRPFRSPFYPWPQVLGIVGMLFAIYHVSPSPEMTARIFGSAGVVLGVISLIAVVWIKLVMRKPLFVPEPLLPGEPTLATQPSLEPAYRAGE

SEQ ID NO: 50395 - protein, 329 aa, Solanum tuberosum
MAVNGSAPSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEEEARKQIKSIWNYADVIKVSDVELEFLTGSNKIDDECAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTVSEVLTLLKGGA

SEQ ID NO: 50396 - protein, 501 aa, Pseudomonas fluorescens Pf-5
MRECSVFDLGYWQQRAARQTFIDQALIGGQRLSAESGATFDAINPATRQVLARVSACGAAEVDLAVAAARRAFEHGPWARMAPVERKKVLLRLAELMLAHREELALLDSLNMGKPVMDAWNIDVPGAANVFAWYAESIDKLYDQVAPGARNSHASISRVPLGVIGAVVPWNFPLDMAAWKLAPALAVGNSVVLKPAEQSPFSALRLAELALEAGLPEGVLNVVPGLGSEAGRALGLHPDVDCLVFTGSTEVGKFFMQYSAQSNLKQVWLECGGKSPNLVFDDCQDLDLAAEKAAFGIFFNQGEVCSANSRLLVQRSIHEEFVERLKAKARDWRPGNPLDPASRAGAMVDARQTASVMGHIAAALEQGAQLACGGRQLSIDGSDNYIEPTILTGVGPAMAIAREEVFGPVLAVTPFDDEEQAIALANDSVYGLAASLWSDDLNRAHRVAGCLRAGTVSVNTVDALDVTVPFGGGRQSGFGRDLSLHAFDKYTQLKTTWFQLR

SEQ ID NO: 50397 - protein, 287 aa, Solanum tuberosum
MTKEVEAVHEQAAEYSAKDYTDPPPAPLIDFEELTKWSLYRAVIAEFIATLLFLYITVLTVIGYKHQADVDAGGDVCGGVGLLGIAWAFGGMIFVLVYCTAGISGGHINPAVTFGLFLARKVSLIRAVLYMVAQCLGAICGVGFVKAFQSAYYNRYGGGVNVMAPGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 50398 - protein, 310 aa, Aspergillus oryzae
MADFSEYTTPIEEWLVLEKSLPKFPEDITAEQLKAAANRDREALAAKAMVEEGLASQVSMQDYKIPTRDGETLEARTYRPSSVPATQRLPVFIYYHGGGFLMGTLSSEDAICSRVVVAQVAAGSPVVVVNVNYRHTPEYTYPTAWNDAEDSFHWVHDHIDDINGEAENVVVGGISAGAYLTVSLTLAQNIGKDVSLAQRPKIRGQVLMIPALVTEDCYASQVARLRDPSVSSYVGCEHAPILPVSRMRLFMKLLKPAVNGSELETDRRVNPGLATADEVKGLPPTTFGIAGRDPLRDEGLLFAMLLAENG

SEQ ID NO: 50399 - protein, 500 aa, Oryza sativa
CRFSASASARAPSSSPNGVAAAPTRCSLSLAARRAAAVGPAAASPLRRGGLAAGCQPARSLAFAAAADPRLATHVASRCRQAASSSARGTRAVATMAKKSVGDLTAADLEGKRVFVRADLNVPLDDNQNITDDTRVRAAIPTIQYLIKNGAKVILSSHLGRPKGVTPKFSLAPLVPRLSELLGIQVTKAEDVIGPDVEKLVSELPNGSVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVAV

SEQ ID NO: 50400 - protein, 248 aa, Treponema denticola ATCC 35405
MIIIKTEEQINGIRKSCKALAQLFEELKPVIKPGISTKELDDFCVNYIKKIGGVPAWYSEGFPGAACISINEEVIHGIPGKRIVKDGDLVSMDIGIDLGGYISDSCVTYPVGNVSKENLKLLEVTTRCLYAGIEACKAGKRVSDISKAVFNLASAHNYGVVYDYCGHGVGLGVHEDPSIPNVPERMRPNPRLRAGMVVAIEPMINMGTADVEVKKDGWTVVTADRSVSCHMEHTVAIFEDHTEILSQL

SEQ ID NO: 50401 - protein, 554 aa, Coccidioides immitis RS
MKRKQSLASSDDDPLQVEESTPRKRRASPDDPETPQTSTPLSRLRSRSKPNHGHPPVDSPTPKPKRKPVFSTPNKTSKSRGIASDTPSRIKNADRSAKKKSAAILFNPNEDDLWNGGEKLAREIWDIEEETEGEDEINGILDTNEVPEAAKDGLNKSTGAPGCNRQPRTRARRRTPTPDGDLPSHERYFFQNRPGPMLTSDNTLSKLTLLTHEEYFDQLEKLDDPQSKEKEALVDIHERSFPQWNFELIEGFNICLYGYGSKRNLVQRFAGWLYERYSDPPTIVVVNGYATNVTLRSILATIISAVMGPEAPTKLGTQLSEVLDVLQSNLNVRPPKHPITVLINSIDAPPLRRQAHQTLLARLASLPHINIVATADTPNFLLLWDIGLRDQFNFAFHDCTTFAPYDAELNVVDEVHSLLGRKVRRIGGKQGVGFVLKSLPENTRKLYRLLITELLTMLGDQNISEGEVDQATTDPRDKTGNERRETAIEWRTLFHKATEEFISSSELMFRTQLKEFYDHQMIISRTDSSGAEMLGVPLSQEEMESILEDLVIEQ

SEQ ID NO: 50402 - protein, 373 aa, Campylobacter jejuni subsp. jejuni NCTC 11168
MEISYYEILEITQNADKETIKKAYRKMALKYHPDRNQGDKEAEDKFKLVNEAYEVLSNDEKRAIYDRYGKDALKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRMGNQIVQISIKFPTSLNDEQKELLEKLSESFGIKDGMHQEQKGLFEKITNWFKS

SEQ ID NO: 50403 - protein, 370 aa, Glycine max
  misc_feature (196)..(196): Xaa can be any naturally occurring amino acid
MGNCFRKTAADDNKIHKNEYKTPTTNNPRPSPPERLVKETVEERGERPQNNSVPKLINYTLDELKSATRNFGPDTVLGEGGFGRVFKGWIDKNTFKPSRVGVGIPVAVKKSNPDSLQGLQEWQSEVQLLGKFSHPNLVKLIGYCWEENHCLLVYEYMQKGSLESHLLRRGSEPLSWDIRLKIAIGSAHGLALLHTXEEIVIYRDFKSSNILLDGDFNAKLSDFGLAKFGPVNGKSHVTTRIMGTYGYAAPEYMATGHLYIKSDVYGFGVVLLEMLTGRAALDTNQPTGMQNLVECTMSSLHAKKRLKEVMDPNMEEQYSLRAAFQIAQLILKCLESKPKKRPSMEEVLETLEKVEAIKYKPKVKKRSAVR

SEQ ID NO: 50404 - protein, 333 aa, Opitutaceae bacterium TAV2
MQIPSLLPPFTTNSIRLHSTSASPVMKTKLILDTDIGSDIDDAVCLAWLLREPACELLGITTVSGDVATRASLASSICHRLGRPDMPIHPGLAKPIYIPESRQPNVPQASIFAASDKKWPHTPVSAFSRHEAIHFLQRTIRQNPGEVTLLAIGPLTNIAALFTIDPEIPSLLKALVIMGGNFSPVRWHGSIAAGRGEWNIWNDPHAAEIVYRTPVRLHRSIGIDVTMRVEMDVPAVHQKFQVPGLDVVLDMARVWFDSGRPTITFHDPLAAVSIFYPDVCTYTQGRVRVVTEGLMEGFTLFDPQPAAPADAIHEVAEGVSPEKFFEKYFGHFI

SEQ ID NO: 50405 - protein, 351 aa, Opitutaceae bacterium TAV2
MASLIHSTKTSRQGVVVVGSANMDLVIPVPSLPRTGETILGGDMMTNPGGKGANQAVAAQRAAGMPRGGEGGEGRRAGFCKFVGRVGDDVFGEKLRESLESHGVGTDALFVTPGVASGTAAIMVNPAGDNAIVVSPGANARLSPDDVVRARPVIASAAVLAVQLEVPVETVAAALAVAREAGVVTILDPAPAPQPLSPALVATLPEALWQVDIFSPNQTEARLLTGIEPESFDAARVAGERLLALGPKIIVLKLGALGAAIVSREAATGQGGGRGAARGVRFVHVPAMSIPVVVDTTAAGDSFTGALATALAEGRALTDAVRFAGIAGSLACTRAGAQAAIPSRDEILAHF

SEQ ID NO: 50406 - protein, 271 aa, Staphylococcus epidermidis ATCC 12228
MTELYLKKLDEYICQWIRGLDNIIPRLVEKMETSTKKDRFDLVTNVDKQIQNHFQNFLQEHYPTHQLLAEEKDNSDITPYEGHLWIMDPIDGTSNLVKQQEDYCIIIGYFIDGEPKLSYIYDYPHQRLYRAIAGIGAYENNQLMTMPKRIGLREAIISFKPQVLKEETVQSLFQSAFDFRSIGSCGLDSIRVIKGQFGAHINTNPKPWDISAQFLFARELGLIMTQINGEPLDFSKAGPFIISNPGCYDDMIRILNEGRGYSKSSHHIERG

SEQ ID NO: 50407 - protein, 387 aa, Schizosaccharomyces pombe 972h-
MKLLLGDEIGQLKFIEIKKGTDTSNPESEAPVIQKFGELDREKGVLFMLKHEMNVFVARKNGTIECWNVNQEPPILSSLWQLDSSLLETASIVSMKYSNGWLMLALSDGNLLFRHIESSKLRKLQLHGPLSAVELHPRIPGIIAAGGKENDVCLYSCNPTCKSNIDELELWRTENVVKVFQGKNVKNDSLNLRVRVWITGIVFTEDIINVIDGKSEDDESLCFHFATITHYGQLRFYDTKHGRRPVSTFDVSTSPLSHVGLLPSIKLLYFADKRAQISIFDHSKKKVIGRFQGVKGAPSSIHCLGNVVAITGLDRNVRIFDADRKPLANAYIKALPTSIIVINERDAEIIKKEEELEAAKEEEEEIWRNMEQLEDTEDKKPSKRIKL

SEQ ID NO: 50408 - protein, 150 aa, Vibrio parahaemolyticus
FQGISAKTDAGEPCCDWVGNDGAGHFVKMVHNGIEYGDMQLITEAYQFMKEGLGMSADEMQAVFAEWNNTELNSYLVEITADILGYKDEDGEPLVEKILDTAGQKGTGKWTGINALDLGIPLTLISESVFSRCLSALKDQRVEAEKLFGK

SEQ ID NO: 50409 - protein, 496 aa, Oryza sativa
MGENGVVASKLCYPAAAMEVVAAELGHTAGSKLYDDDGRLKRTGTMWTASAHIITAVIGSGVLSLGWAIAQLGWVAGPAVMLLFSFVTYYTSALLADCYRSGDESTGKRNYTYMDAVNANLSGIKVQVCGFLQYANIVGVAIGYTIAASISMLAIKRANCFHVEGHGDPCNISSTPYMIIFGVAEIFFSQIPDFDQISWLSILAAVMSFTYSTIGLGLGVVQVVANGGVKGSLTGISIGVVTPMDKVWRSLQAFGDIAFAYSYSLILIEIQDTIRAPPPSESGVMRRATVVSVAVTTLFYMLCGCTGYAAFGDAAPGNLLTGFGFYEPFWLLDVANAAIVVHLVGAYQVYCQPLFAFVEKWAQQRWPKSWYITKDIDVPLSLSGGGGGGGRCYKLNLFRLTWRSAFVVATTVVSMLLPFFNDVVGFLGAVGFWPLTVYFPVEMYIVQKRIPRWSTRWVCLQLLSLACLAITVASAAGSIAGILSDLKVYKPFATTY

SEQ ID NO: 50410 - protein, 176 aa, Triticum aestivum
  misc_feature (122)..(122): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFXGAPDATQVINEVEEVKKEYPDAYVRIIGFDNMRQVQCVSFIAFKPPGCEESGKA

SEQ ID NO: 50411 - protein, 601 aa, Mycobacterium leprae TN
MPGQSHKEPHRRATSTPRSLKQATSELRWALSLAAPESPAFMRHLLGNAHDKVDITTSSEHVAAFTEHAIVLLNGNAHQTRELLGGKGYNINAMRRHQLAVPPAFCITTEVGVRYLAAPTPTMEAIWNDVLDQMRWLEAETSRTFGWGPRPLLVSIRSGAVQSMPGMMDTILNLGINDPVEQALAAASPSPIPQTFARDTRLRFIRTYRRIVDPLNPPPANTYDQLRAAIESIFSSWNSPRAVAYRTHYGLDDQSGTAVIVQAMVFGNQGAYSGAGTLFSRNPITRESKLFGEWLPGGQGDDVVSGLVEVQPITSLRDEQPTVYDELVDTAGRLERLGSDVQEIEFTTEDSKLWLLQTRVAERSAQVAVRLALQLWQEGLIDDAEALRRVTPVHVETVLLPVLQPENHLSATLLAKGTPTCPGVISGKAYTEVDEALDAAESAEQVILVRDHTRPDDVLGMLASQGVVTEVGGAASHAAVVSRELSRVAVVGCGQGTAVSLAGKQITVDGDKGEVRQGNLTLSAWSENETPELRELADIARRISPLRVHMTEDHTRLDDSSDTAVRLAINTGHADVVSATPLIVMMTTLRLQDSKDSSAKS

SEQ ID NO: 50412 - protein, 861 aa, Cryptococcus neoformans var. neoformans JEC21
MICITGPEVTDAVYRAAKQEAGGHSSLATCFYLISFFFAPSFLLSQARFLLIFLTVTLFTHICSLETRQAHGADKKNSRLTHKRPPPDLILPNMSSSSAPPNMTAFPRENHYELEDQALDVIPTRAGRKLCVRHKQMANQNVNEKLQRSLDNLNPSERAAITQMWSTFSTAPHGKRKIILEGILTMCCFSQLSHLSDSLNQIIRIDPFSLLPRETSLRILGYLDAFSLGRAAQVSRSWKALADDDLLWRRMCGQHIDRKCDKCGWGLPLLERKRLRVELKDRSPAGLVEHDHKHENENGESRLVTRDQVLSGNANTVSSIGGLKSCDTSAMYLFPPNVNATAPKGIKRTAPESSVGAAKKVKMNDSDSDVEIIKPGGSSLTREVRLTRPWKTVYCERLMVERNWRKGRCSTKILKGHTDGVMCLQYHTALTNPSYSVLITGSYDRTVRVWNLDTGEEVRVLRGHTRAVRALQFDQMLLFTGAMDGTVRMWNWRAGECLRVMDGHTDGVISLNYNGYLLATGSADSTINVWNFRTGNRFTLRGHEEWVNNVVLWDGKTSPSDTDPAAIPSFTQAVSNRCQKSKSPAAASNEPTLPNIDPGAMLFSSSDDMTIKLWDLETAACIRTFEGHKAQVQSLRVLMVDMTEEEVAARDRRQRRQATPPTTGFTAASLVSPPGSQAAFGAGGASIHDAPAGFDPLEHRGRSRSDTVQPRVYVHSPDGTHKKSEREQSRGHEKKAIVASGSLDGTVKIWDVETGREQSTLFGHIEGVWAVDIDALRLVSASHDRTIKVWEKESAQCVQTLVGHRGAVTSLQLSDDMIVSGSDDGDVMIWNFASSANNVSNTASVSGPCVDITPSPTPAIV

SEQ ID NO: 50413 - protein, 303 aa, Desulfotalea psychrophila LSv54
MPDHLSSLGDFTGEEIASLIARAIELKEERSRGIRHQQLAGKSVALIFEKPSTRTRVSFESAMYGLGGQVLFLSGRDTQLSRSEPLKDMARVMSRYVDGIVVRTFGQEVVNELAQYATVPVINALTDLHHPCQILSDIMTVIEKKGAIQDLKIVWVGDGNNMANSWIQAAAKLGFELILACPEGYDPDAEILAAAQAEGAKPITLLRDPQTAVLGADVINVDVFASMGQESEQDERLKIFASYQVNAEMMAKAADDAIVLHCLPAHRGEEITEDVLEGPQCVAFDEAENKMHMHKAILERFLG

SEQ ID NO: 50414 - protein, 545 aa, Zea mays
  misc_feature (240)..(240): Xaa can be any naturally occurring amino acid
LKEAGSSSIGSNRERAMGLAWMVTAAVAAVLASWAFNALVHLVWRPYAITRRLRAQGVRGPPYTFFTGSLSEIKRLRAEGAAVTLDVDDHDFIPMVQPHLRKWIALYGRTFVYWTGARPNVCVADVNVVRQVLFDRTGLYPKNLMNPHISRLLGKGLVLTDGNDWKRHRKVVHPAFNMDKLKLMTATMSDCARSMISEWDAQLQKEESGRDGHGHGHVEEELSSRFEELTADVISHTAFXGSSYSEGKRVFLAQRELQHIAFSTIFNVQIPALKYLPTKKNLRTRKLDRQVRAMLMDIIEARLASKDTAGGYGNDLLGLMLEACAPPPEHHGETAPTTLSMDEIVDECKTFFFAGHDTTSHLLTWASFLLSTHPEWQHRLRDEVRRECGDDEVPTGDALNRLKLVNMFLLETLRLYGPVSLIQRKAGSDLDLGGIRVPEGAILTIPIATIHRDKEVWGEDAGEFRPERFENGVTRAAKHPNALLSFSSGPRSCIGQNFAMIEAKAVVAMILQRFALELSPKYVHAPMDLITLRPRHGLPMLLKRL

SEQ ID NO: 50415 - protein, 319 aa, Aspergillus oryzae
MASPTVKLNSGHDMPLVGFGLWKVNNETCADQVYEAIKAGYRLFDGACDYGNEVECGQGVARAIKEGIVKREELFIVSKLWNSFHEGDRVEPICRKQLADWGVDYFDLYIVHFPVALKYVDPAVRYPPGWNSESGKIEFSNATIQETWTAMESLVDKKLARSIGVSNFSAQLLMDLLRYARVRPATLQIEHHPYLTQPRLVEYAQKEGIAVTAYSSFGPLSFLELEVKNAVDTPPLFEHNTIKSLAEKYGKTPAQVLLRWATQRGIAVIPKSNNPTRLSQNLEVTGWDLEKSELEAISSLDKGLRFNDPIGYGMYVPIF

SEQ ID NO: 50416 - protein, 118 aa, Panax ginseng
LCAGGELFDRIIAQGHYSERAAATICRQIVNVVHVCHFMGVMHRDLKPENFLLSCKDEGAMLKATDFGLSVFIEEGKVYHDIVGSAYYVAPEVLRRSYGKEIDIWSAGVILYILLSGV

SEQ ID NO: 50417 - protein, 217 aa, Oryza sativa Indica Group
MAMLARTSRPAPTLLAATSPAVSRRPAAVSFAAAASPGSRGRVALSVAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 50418 - protein, 222 aa, Oryza sativa
  misc_feature (167)..(167): Xaa can be any naturally occurring amino acid
  misc_feature (198)..(198): Xaa can be any naturally occurring amino acid
MAPLGDGAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRXAAKSAGILCSYDPNVRLPLWASEDAAGAGIXSIWRGATLRRARRAHPDGPQKVLR

SEQ ID NO: 50419 - protein, 637 aa, Oryza sativa Japonica Group
MAAEAAAEIVREIAAVGAADLAAAAEPLRADCLRLARKVSLLSHLVAEVAEAGAGGGDADAADSWLGDLVRALQAARRFVELGRAPARPSRASDQDAVCNNVAVQFKFVTWQLQTVLARLPQSCFQISDEVQEEVDLVRAQLRREMEKKGDIDVNIFSKFHDILALHVSTVGSQSEQSHGQPDTPQMENLCNGHLELQNIIMLVSEISGVPKSDAERITSQLIEGLENMRVTDSKKPVSVSQSSDETKASPETHKKSDAVAIPEDFRCPISLELMRDPVIVSTGQTYERAFIQRWIDCGNRTCPKTQLKLQNITLTPNYVLRSLILQWCEEKGIEPPTRSKNDGAYLEVGGERVAIETLVRNLSSSSLDERKSAAAEIRSLAKKSTDNRILLAESGAISALVKLLSSKDLKTQEHAVTALLNLSIYDQNKELIVVAGAIVPIIQVLRKGGMEARENAAAAIFSLSLIDDNKITIGSTPGAIEALVELLQSGSPRGRKDAATALFNLCIYQANKVRAVRAGILAPLIQMLQDSSRNGAIDEALTILSVLVSHHECKIAIAKAHAIPFLIDLLRSSQARNKENAAAILLALCKKDAENLACIGRLGAQIPLTELSKTGTDRAKRKATSLLEHLSKLQVL

SEQ ID NO: 50420 - protein, 157 aa, Microcystis aeruginosa PCC 7806
MRVAGSPLGERKPALLFSSLEVMTATKQAKIYGGGCHCGAIRFQVAIEHDQALDCNCSICQKKGFLHLIVPSAQFTLLSGEDFLSTYTFNTHTAQHYFCRVCGIHPFYRPRSHPDAIDINLRCLDGNVLEDFQIQFFDGANWEDNIEKIRDIDGKRE

SEQ ID NO: 50421 - protein, 306 aa, Idiomarina baltica OS145
MGLLVDGEWHDKWYDTKKHGGRFVRSESQFRNSIEQGGPFLPESGRYHLFVSYACPWAHRALIFRKLKGLEQHIDVSVVHPLMLENGWEFSAAPLNDPLYQSDFLYQLYLKADPNYSGRVTVPVLWDKQQETIVNNESAEIIRIFNSAFNDLTGNELDFYPDHLQQEIDEVNERVYHDINNGVYKCGFATEQRAYEEAFKALFDALEWVEERLDGRDYLVGDQLTEADWRLFTTLVRFDAVYFGHFKANKYRISDYPRMRDYLSRLFHYPGVSETVVMDHIKRHYYGSHKTINPTQIVPVGPELSF

SEQ ID NO: 50422 - protein, 324 aa, Triticum aestivum
MGAQRALLASFLLAALATQAFVSVSARTGPTDKAGQDDVKKPDCVPSLDPHNFPGHGGTTVPLPSHGGSSGTPPYHGGSGTTPSHGGSGSTPSHSGSGSLPDPSHGWYGTPPSHGGSGSLPDPSHSGGGYGSTPDAPSHGGGAYGSSPTPSTGGAYGSSPTPSHDGGAYGSSPTPAHDGGSYSGTPAAPSHSSHGSVTPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAVAGGSDSAAAAQAAAFKKANEGKKV

SEQ ID NO: 50423 - protein, 476 aa, Robiginitalea biformata HTCC2501
MSKFELKLPQMGESVAEATLTSWLKEVGDAIEADEAVFEIATDKVDSEVPSEVDGVLVEKRFEVDDVVKVGQVVAVIELNGESDQPDAGREAAGSPDAEASPGSSDTPGKQAAAKESSGQAEAAAAFVEQGEKTARPAPAPVSHGDRFYSPLVRNMAREEGIGQEELDRIPGTGKEGRVTKSDMLAYLESRGQEGAVRSESEPREAAATEAAGPAMAAAPEKGQAPKPAAAATGSPVSISEGDEVIPMSRMGKLIAKHMAESVSTSAHVQSFVEVDVTRIVEWRDRVKADFEKREGEKLTFTPIFMEAVAKALKKFPMMNISVDGDRVIKKKQINLGMAAALPDGNLIVPVIRNADQLNLVGMARAVNDLATRARNNALKPDEVRDGTYTVTNVGSFGSVFGTPIINQPQVGILALGAIRKVPAVIETPSGDFIGIRSKMFLSHSYDHRVVNGALGGLFVKAVADYLEAWDTERDV

SEQ ID NO: 50424 - protein, 86 aa, Microcystis aeruginosa PCC 7806
MTETLQTIALATRHGYRSVISHRSGETEDTTIADLAVATNAGQIKTGSLSRSERVAKYNRLLRIEEELGDRAVYAPKVGLGPKFLA

SEQ ID NO: 50425 - protein, 434 aa, Pseudomonas syringae pv. syringae B728a
MNSKVDETPHLLRQRDQFVPRGIVTAHPLVIDRAQGSELWDVDGKRYLDFVGGIGVLNIGHNHPNVVKAIQAQLTKVTHACFQVASYQPYLDLAKRLSHLIAGQSGIDHKAVLFTSGAEAVENAVKIARAHTNRPAIISFRGGFHGRTLLGTTLTGMSQPYKQNFGPMAPEVFHTPYPNEYRGVTTDVALAALHELLATQVAPERVAAILIEPMQGDGGFLTAPVEFMKALRALTEQHGIVLIADEIQSGFGRTGKWFGFEHSGIQPDLVTVAKSLAGGMPLSGVVGRAEIMDAPLPGGLGGTYGGNALSCAAALAVIDTYEQENLLARGEQLGNQLRAGLLKLKERYSCIGDVRGTGFMLAMEMVKNDAARSPDADLNQKVIDQARLGGLLVIKCGVYRNVLRFLAPLVTTEQQIDEALGILDAALARVLKSS

SEQ ID NO: 50426 - protein, 168 aa, Physcomitrella patens subsp. patens
MSSSGYGQKEKVLSRIAANRLQKELTEWQVNPPCGFRHRVTDSLQRWIIEVHGAPNTLYEGEEFHLQVDFPEHYPMEAPQALLLRLCLCKFLHCTLTSTAMATFVLVNILYDSWSPAMTVSSICISILSMLSSSTVKARPPDDDQYVRNCRNGRSPKETRWWFHDDKV

SEQ ID NO: 50427 - protein, 251 aa, Triticum aestivum
RNSARGAAGLSRECRRRLETLVGRMLDQATLDDLLVSGDGGGVYDVSLVMRLVRVFASSVEEDGSPSSSQRMRKAGKLVDKYLAEISPDQGLRVSRFLAVAESLPDSARDCYDGVYRALDIYLESHAELTVEERATLCRCLNYEKLTLEACRDLARNRRIPPRIAVQALSLQRPPNSLQSPLSSPTPKRVVPDDDEKEKETLRLNLRLMQGRVAELEMVCKEMRGKARLSPRVAAAKGNKALGGRGLPWMC

SEQ ID NO: 50428 - protein, 188 aa, Hordeum vulgare subsp. vulgare
MAPGALARLVIGRRAASPLLARPFAAKARASQRPKEPEPLSEEDDDFTSGGEAAPIPTEGISKPLAGILKELGKKVPESLLKTRLEDNGFTLKYIPWHLANKVLNAHAPEWSGEVRNIVYSSDGKSVSVVYRVTLYGTDAEIYREATGTASVEDKGYGDPVQKAEGMAFRRACARLGLGLHLYHEDMS

SEQ ID NO: 50429 - protein, 458 aa, Staphylococcus epidermidis ATCC 12228
MENNELQRGLNARQMQMIALGGTIGVGLFMGATSTIKWTGPSVILAYLIAGIFLFLIMRAMGEMIYINPTTGSFATFASDYIHPAAGYMTAWSNVFQWVVVGMSEVIAVGEYMNYWFPSLPNWIPGVIAVLFLMAANLVSVKAFGEFEFWFALIKVVTIVLMIIAGLGLILFGIGNGGNPIGISNLWSHGGFMPNGFIGFFFALSIVIGSYQGVELIGISAGETKNPQTNIVKAVNGVIWRILIFYIGAIFVIVSVYPWNQLGSIGSPFVATFAKVGITFAAGLINFVVLTAALSGCNSGIFSASRMIYTLAKKGQMPKVFTKVMKNGVPFYTVFAVSMGILIGALLNVILPLIIDGADSIFVYVYSASILPGMIPWFMILFSHLRFRRLHPEKVHNHPFKMPGGAIANYLTIMFLLLVLVGMLLNKETVVSVVIGIVFLTAVTLYYLIRYHKKERQI

SEQ ID NO: 50430 - protein, 485 aa, Pseudomonas syringae pv. syringae B728a
MLKNQLKDPSLLVDRAYVDGQWISADDGATLTISNPATGEALAQVPALQGVETRRAIEAADRAWPAWRARPAAERAALLERWHQAMLDNVEDLALIMTFEQGKPLNESRGEIRYGASFVKWFAEEARRSYGETIPAPSADRRLMTLKQPVGVCAAITPWNFPNAMITRKCAPALAAGCPIIVKPSDLTPLSALALALLAERVGIPAGVFNVITGMPTGIGEELTGNPVVRKISFTGSTPVGRLLMRQSAEHIKRLSLELGGNAPFIVFDDADLEQAVTGIMLSKFRNAGQTCVCANRILVQNGIYDRFAARLVEEVSKLKVGNGLEEGVTIGPLINPAAVSKVARHIDDALSQGAKLLHGGSPDGTSQFVQPTVLGDTHAGMLLANEETFGPVAPLMRFTDEAEALALANATPYGLGAYYFTQDLRRSWRFGEALEFGMVGLNTGIISMEVAPFGGVKQSGLGREGSSYGLDEYLEVKAFHVGGL

SEQ ID NO: 50431 - protein, 129 aa, Pseudendoclonium akinetum
MTTVEQIIDQLKTLTLIESSELVKQIEETFGVDASAPVGGAIMMAPGQESAGQEVVEEKTTFDVIVKDIASDKRVSVLKVIRKLTSLGLAEAKEFTVSLPKALKEGISKEEAAEAKKDLELAGAVVDIV

SEQ ID NO: 50432 - protein, 483 aa, Pseudomonas aeruginosa
MNTKLFINNVWINSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQCVQEAGLPAGVLNYLNSSPDRSPEIADALISAKEIRRINFTGSTRVGSIIAQKAAQHLKRCLLELGGKSPLIVLDDADIDAAVKAAVFGSFLFQGQICMSTERLIVDEKIADEFVAKFVEKTKRLSAGDPCVTGDCIIGPMVSPNSGERINGLFKDAIDKGAKVVCGGLAQGALMPATILDHVKSDMRIYDEETFGPITVVIRCKGEAEAVRIANDSVYGLSSGVFGRDINRALRVGMSIEYGSVHINGSTVQNEAQAPYGGTKNTGYGRFDGRAVIDEFTEIKWLTIEPFEQQYPF

SEQ ID NO: 50433 - protein, 525 aa, Agrobacterium tumefaciens str. C58; identical to SEQ ID NO: 1580

SEQ ID NO: 50434 - protein, 397 aa, Desulfotalea psychrophila LSv54
MTNESVKERADKVLVGNYGRYPVAFTEGTGCVLTDANGKKYVDFLAGIAVCSLGHCHPRIVNAIREQSERLIHVSNLYYTEAQTRLAELLVENSFGDKVFFCNSGAEANEAAIKLARIHAPAGKNKIISLTGAFHGRTMVTLAATGQARFCAGFEPIPTGFAAAPFADLDALEAMIDDTVCAVLCEPLQGEGGVRPLGREYLQGIRDICDRHGVLLIFDEVQTGVGRSGSLFAHQVFGVEPDIMTLAKGLASGMPIGAIITRDAVAASLVPGSHGSTFGGNPVVCAAASTNLEVILEDGFLAEVKSVAEHLAQSLGKLVKEFPAIFTEERGLGLLRGLVMTEEGKKSGSKIVMEMLEKGFLINFAGGVALRFAPPLVVSREQCDSLAAALREVLSVL

SEQ ID NO: 50435 - protein, 215 aa, Pediococcus pentosaceus ATCC 25745
MIKVAPSILSADPANLMGDINKVEGADYLHVDVMDGSFVPNLSFGLNTVQGLSKDTDIKLDVHLMIQNPENYVEQFVKAGASIVGVHVESTQHIARAIQIIKNAGARAEVVVNPGTPLTELEELLPEIDQVLIMSVNPGFGGQKFLESSISKVKRLSALRQARGLEFDIEIDGGISDKNIKAVYDAGVDVAVAGSYVFGAEDYTKQVQLLKELTK

SEQ ID NO: 50436 - protein, 296 aa, Desulfotalea psychrophila LSv54
MNDTVEKSIERAKVLIESLPYMQEFRHKTIVIKYGGHAMVDEALKKQFALDVILLKQIGINPIIVHGGGPQINNLLDRLDIKPSYVQGMRVTDGETMDVVEMVLVGKVNKEIVGLINHCGGKAVGLSGRDGDLVCAEQLQMNQAQVGDNPPELIDVGRVGQVTKINSHVLETLSQDDFIPIIAPVGVGEDGRAFNINADLVASAIAAELSAEKLILLTDVPGVKNKAGDLLTTLEWQELNGLIEDGTIMGGMIPKVRCCEDAVKGGVAKTYIVDGRVEHAILLEIFTRDGVGTEIY

SEQ ID NO: 50437 - protein, 184 aa, Streptomyces coelicolor A3(2)
MLTVGDKFPEFDLTACVSLEKGKDFQQINHKTYEGQWKVVFAWPKDFTFVCPTEIAAFGKLNDEFADRDAQILGFSGDSEFVHHAWRKDHPDLTDLPFPMLADSKHELMRDLGIEGEDGFAQRAVFIVDQNNEIQFTMVTAGSVGRNPKEVLRVLDALQTDELCPCNWSKGDETLDPVALLSGE

SEQ ID NO: 50438 - protein, 193 aa, Mycobacterium leprae TN
MVDCVRIANLANILTGLRLMLVPVFLVALFAGNGHEIVGRIAAFVIFTVACITDRLDGLLARRYGMATEFGAFVDPIADKTLIGAALIGLSMLGDLPWWVTVLIMTRELGVTLLRLAVIHRGVIPASWGGKLKTVVQAVAIGLFLLPLTQLSVPFHVGAAVVMAVAVVLTVVTGVDYVAGTIRAVRGVHQTAS

SEQ ID NO: 50439 - protein, 603 aa, Vitis vinifera
MARNPRVLAAYRAMRALGIAEATVKPVLKNLLRLYEKNWELIEEENYRALADAIFEYEETKDAEQPQTLAERQPQGIAETPEPSVGNIRPELHPVSSPQAHLRAESDLLHTQQRLRDKGKEPLSPQIAAKEKRSIPVRSFHLNAEPGIILSPKQKVHDTPALMKPKDEPFTDDILQLEVPIAVIHPDPLHKGNLPENYSTGKLDGPQPPVNSRVDGEDEVNGTHTEESHEGSINTTPTENGQEKETNGPNNANSLSLVVVQQRQLTPDDIRFIHDVDDITKGEEKVRIPLVNETNSEFPTPFHYISQNLVFQNAYMNLSLARIGIENCCSTCFGDCLSSSTPCACACESGGDFAYTLEGLVKEDFLEECISRNRDPQQHQLAFCQECPLERSKAEDILEPCKGHIVRKFIKECWSKCGCSKQCRNRLVQRGITCNFQVFLTPDGKGWGLRTLEDLPKGSFVCEYVGEILTTVELYERNMQSKQTYPVLLDADWALRGILKDEEALCLDATFYGNVARFINHRCLDANLVEIPVEVESPDHHYYHLALFTTRKVNALEELTWDYGIDFDDQDHPVKTFRCCCGSKFCRNMKRTSKCIYSSITRI

SEQ ID NO: 50440 - protein, 439 aa, Mycobacterium avium subsp. paratuberculosis K-10
MHERSSHRPAGRGPPASRGPSPKLLQGIGFAVSRRTMMRRLSRRYGNVFTLRLPMWGPVVMVSDPQLAKQIFTTTPDELGNIQPNLSRLFGSGSVFGLEGDDHRRRRRLLAPPFHGKSMKNYESIIEEETLRETAGWPEGESFPTLPPMMRITLNAILRAVFGAEGAELDELRRLIPPWVTLGSRLAALPKPQRYPRFGPWGQLDRWRRHYDGVIERLIAAEQADPNFAERTDVLALLLRSTYDDGAAMSHKEIGDELLTLLAAGHETTASTLAWAFERISRHPELLARLVEEADNGGNELRQATILEVQRARTVIDFAGRHVYPDVYRLGEWVIPRGYSIIVGIAQIHDNPDVFPDPRRFDPQRFIDNKPSALSWIPFGGGTRRCVGAAFANMEMDVVLRTVLRHFTIETTDAPDEPWHCRGVAFTPKHGGRIVVHRR

SEQ ID NO: 50441 - protein, 740 aa, Cryptococcus neoformans var. neoformans JEC21
MNPVSPTSSRGMREYIPQGMEDEDLDGEYLDMEEPIEGDFTLRAILAGLGVGVVLCMTNIYFGLQTGWVSMMSLQSALLGFAIFRVPTFLPRLFPSMRPFTPQENVVLQTTAVATGTMPLAAGLVGIIPALSMMSPEIDGREPLFMGWGDLIMWCLAVAFFGVFLAVPLRKQVIVKEKLVFPSGTATAQLISLLHHTPPVEVQGARTTAYRRLRRSSTSVSPNRSRRHDNDEEDEWGEDREAEWEEEKDVDIMTGKGWWALGASFIASGSLTVLSFLFPILFSIPVFDVLSLPFGSSLAASWMWWFTPSLSYVGQGIIMGFPVTVSMNIGMVVGWAMLSPLSKHLGWAPGPVSSTTDGARGWILWVALAIMIAESIISLLPITFSYVSTAFRQYRQRNYRPGIFASAPRSPSSQVSGEDDYFTPPDKDEEPEHEPPERLVPNSWVLWGLGVSGVMGVILVWFVFGSDGIHPWATAIGLLLASILSLIGVRALGETDLNPVSGIGKISQLFFAILQPGNVVANIIAGGVAEAGAQQAGDLMQDLKTGHLLRASPRSQFYGQMIGSLASVFVATAGYKFYTSAYTIPGPEFAVPSAGIWLNLARLLNNGHLPSHVIPFMLGFGALFACLSFVKAFRSSFPASIASSRLVTLLPSGIAFAVGFLNSPSFSIARLIGGYIAYRAAKATRTGETPLLMIVVASGFVLGEGVVSVITLGLTSAGVGAISCWGCGINGGGYCSGGCS

SEQ ID NO: 50442 - protein, 287 aa, Yarrowia lipolytica CLIB122
MAIPTRALKNAPKAGTVIPVIGLGVYSSNSTTKSVTEALNLGYRLFDTANEYQNETDTAKGISEWLKSNPNVKREDVWYCTKIDDARGGYEGTKSRVEEALTKAKVGGLDYIDMLIIHAPYTAPPHTETRMKVWKALSEFVDDGKIRTLAVSNYGVKHLKEFWDADTKYKPVLNQIESSPWNVHQDIHDYCNEHDIVVEQYSPLIRGKKFDEPGVQSLAKKYNKTPAQILIRWGIDKGMLPIPKSDQPQRQKSNADVFDFKLTPDEVTALQDLDSYLYLEWDPTVAP

SEQ ID NO: 50443 - protein, 387 aa, Glycine max
HLQCQGVGGDALPSYMRGAVYWEPNKPLTIEEFNMPRPKAGEVLIKTKACGVCHSDLHVMKGEIPFSSPCVVGHEITGEVVEHGALTDSKTIERLPVGSRVVGAFIMPCGNCSYCSKGHDDLCEAFFAYNRAKGTLYDGETRLFFRNSGKPAFMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFDEAGKAFQDLNEGKIVGRAVIEII

SEQ ID NO: 50444 - protein, 550 aa, Zea mays
MAATVRRAASSVLSRFLLTKPSPSPASAAGNNSALLGSGAAALHRFSTAPASAAAAAEEPIQPAVEVKHTQLLINGNFVDAASGKTFPTLDPRTGEVIARVAEGDSEDIDRAVAAARRAFDEGPWPRMTAYDRCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALSSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 50445 - protein, 173 aa, Yarrowia lipolytica CLIB122
MADERSKLEQAGEGTNFSSDEIDRLRKRFMKLDTDASGILETNEFLSLPGVAANPLASRLMDVFDENHSGDVDFQEFINGLSTFSTKGNKKEKLRFAFKVYDIDRDGYISNGELFIVLKMMVGNNLKDAQLQQIVDKTIMEADKDGDGKISFEEFEAQVGGTNVYQSMTLDLF

SEQ ID NO: 50446 - protein, 339 aa, Treponema denticola ATCC 35405
MIKRVLVTGGAGFIGSHIVADLCEKGYEPIILDNFSNSSPKIIPVLEKICSKKLELVQIDIKDKEKLFNFFKSTSIDAVIHLAAYKAVGESVEKPLKYYENNISGLVNLLLAMQEHKVKNFIFSSSATVYGDAKVVPIPENSPISAANPYGRTKLMSEEILKDTAFSDKDLSIIALRYFNPIGAHKSADIGELPSGIPNNLFPYIAQVALGKLPHLNVFGNDYDTPDGTCIRDYIHILDLASGHTVAIEKIASGFKGFDVYNLGTGIGYSVLDIVNAFKKASGIDLPVKPAARRAGDVPRSCANPDKANKELNWKAKYNLEEMCKDGWAWYKKHPEGFV

SEQ ID NO: 50447 - protein, 127 aa, Triticum aestivum
  misc_feature (77)..(77): Xaa can be any naturally occurring amino acid
  misc_feature (98)..(98): Xaa can be any naturally occurring amino acid
EYSSSLATSSLPSFGTRLSPTKMPTVTRAYLDQRLAVANRCSKEAAMAGAKAAAVATVAAAVPTLASVRMLPWAKSXLNPTGQALIISTVAGMAYFIXADKTILSMARKHSFQNAPDHLKEHLLPLD

SEQ ID NO: 50448 - protein, 874 aa, Silicibacter pomeroyi DSS-3
MLPVRTWCLRRLQTPLFCTQTRGAAVQNNPNTTLITSTAPVATSTHGGRAKCLQRLVRLDLPVPRTVALSFGAVHDIAQGQLPDIAAIVSQFDPTALLCVRPSSEDPDWGGPGAVLNIGMNDARFVELSDRMGAEAAAALYLRFVQTFAIHVARLDPDVFDEIEADGREGLRQSLRAYEDETDESFPQDPGEQLAAVLRSMARAWEGTSARLLRQAKGAPADAGLGLVVQEMIPGLGQGECGSGVLQLVEPATGLPQITGRYLSQSQGRDALGAGAEALYLEKDPRGISLEDVAPEAFAALKQHAALMREKLREEMQVEFVIESGRVHILDGVRVPRSARAALRIAVRLAEDGIIPQQEAVMRIDPHSVNELLHRQVHPQARRDVLTTGIAASPGAATGKIVFTAAEAQASAARGEPCVLVRRETSPEDVRGMHAAVAVLTERGGMTSHAAVIGRGLGLPCIVGASDMEFQTKARQIKAPDGRVFRTGDILTIDGSTGQVLAGQPEMIDAALDDSFQTLMAWADAERDIGIRANADTPADAQAARNFDAQGIGLCRTEHMFFEPGRLTVMREMIFAATPSGRKAVLERLLPMQRQDFVQLFRIMEGKPVCIRLFDPPLHEFLPTTRSGQRELAEALDLPVSDVTRRVEAMSEYNPMLGLRGVRLGVTVPEIYDMQARAIFEATLEASRKGEPVVPEVMIPLVSAKREVELVKARIDAVASAVASERGQEFDYRLGVMVETPRACLRADEIAACVSFLSFGTNDLTQMTYGLSRDDAGRFMSAYVRQGVFSEDPFHVLDRDGVGELLKLGVERGRRGQPGVTVSVCGEHGGNPESIAFCRAAGFDYVSCSPFRVPVARLAAAQLAISDKLGISSD

SEQ ID NO: 50449 - protein, 386 aa, Haemophilus influenzae R2866
MSVIKMTDLDLVGKRVFIRADLNVPVKDGKVTSDARIRATIPTLKLALEKGAKVMVTSHLGRPTEGEFKPEDSLQPVVDYLKNAGFNVRLEQDYLNGVEVKEGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLMPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 50450 - protein, 470 aa, Zea mays
MSCWAAGRRSSASAMAENAGARGAKEAVVTSGKRVALGNISNVFRGSWGSGAANSASDAKLSSTKPDDVKKGSYACLRNVNTERGSSRRLASEQFDQAVSLLQKNTSLPSVPDVVSTGCSSPGLSQDCSVSMEDAMSTCNSTESSDVEYLNNNDDPSMTSSSHWWASDRPHFSDSMDVAEFNWRKHSPNHYTYKDPRLSTTLACEIYESLREAETRKMPPTNFLETTQTDMSKTMRAILIDWLVEVTEEYRLVPETLYLTVNYIDRYLSVKEISRHRLQLVGVACLLIAAKYEEICPPLVEELCYITDYSYTKEEVLQMEASVLNNLKFEMTVPTAKCFLRRFVRVAQVPDKGSSLHLEFLVNYICELSLLEYSLLCYLPSMVAASSVFLAKFILMPIKNPWNSSLSYYTRYTPSELRGCVRVLHRLFRLGPGSNLPAIREKYSQHKYKFVAKKYCPQSIPTKFFQDLTS

SEQ ID NO: 50451 - protein, 302 aa, Gossypium hirsutum
MASSWFFIVFLVLTVASVRCTTVDHMPSTDEDARDYSKLKTKTEEATDEHHSRTQQAKDELKSKADHAANEVKSNTQQAKDRASEVGKEAKEYTESWTEWAKEKISEGLGFKQDDDPKGSVEKAFDSVADTATKTKDKLQDMASGAGEYSAGKAKDMKDTAYKKTDDVKNAAKGKSSEMRQATTEKARELADSAKENANTAYIAAKEKVRDMADRTSEMTNEAQERGARKAEEAKEVVAEKAEGAAEETKKKNEERGESLKWAKEKAKQGYDAAKSKAEETIESAKDTIASGYESRSRNHKN

SEQ ID NO: 50452 - protein, 264 aa, Gossypium hirsutum
MSQGQPRRPQQPAGQGENQEPIKYGDVFNVSGELANKPIAPQDAAMMQTAETQVLGQTQKGGTAAVMQAAATRNEQVGVVGHNDITDIAGEQGVTLAETDVAGRRIITEAVAGQVVGQYVQATPVMTSQVGVVLQNAITIGEALEATAKTAGDKPVDQSDAAAVQAAEVRATGSNVIIPGGLAATAQSAAAHNATLDRDEEKIKLNQVLTGATAKLPADKAVTRQDAEGVVSAELRNNPNVATHPGGVAASMAAAARLNENVNA

SEQ ID NO: 50453 - protein, 319 aa, Bacillus halodurans C-125
MNRGVICLGEALIDFIPMDSTNEIYQKSPGGAPANVAVGLAKLGAKSTFVGKVGDDLLGRFLKETLTKANVNTEHMLFSKEVRTGATFVTLAANGERSFDFYINPSADRFLEKGEIAPTLFEEHGVLHFGSISLISEPARTATRHAVSLAKKNGLMISYDPNLRLNLWEDEEQARLLITSMLGEADVLKISEEELAFITGEQTIEAGLDQLVAYNIPLVFVTLGEKGSIVSYNGIQRKIPAMAVQTVDTTGAGDAFVSAILFKLQEERKQVAELSIKEVEQMARFASVSGGLAAATKGAMTALPTLEKVNDILRNEQME

SEQ ID NO: 50454 - protein, 152 aa, Thermus thermophilus HB8
MRIGYGEDSHRLEEGRPLYLCGLLIPSPVGALAHSDGDAALHALTDALLSAYGLGDIGLLFPDTDPRWRGERSEVFLREALRLVEARGAKLLQASLVLTLDRPKLGPHRKALVDSLSRLLRLPQDRIGLTFKTSEGLAPSHVQARAVVLLDG

SEQ ID NO: 50455 - protein, 162 aa, Schizosaccharomyces pombe 972h-
MSNCFFDVIANGQPLGRIVFKLFDDVVPKTAANFRALCTGEKGYGYAGSTFHRVIPQFMLQGGDFTRGNGTGGKSIYGEKFPDENFALKHNKPGLLSMANAGPNTNGSQFFITTVVTPWLDGKHVVFGEVTEGMDVVKKVESLGSNSGATRARIVIDKCGTV

SEQ ID NO: 50456 - protein, 587 aa, Acidaminococcus fermentans
MGFYSMPRYFQNMPQVGKPLKKADAANEEQLKKIEEEIHQLIKEAQEAGKADADVNKRGELTALQRIEKLVEPGSWRPLNTLFNPQGNKNGSVAIVKGLGRVNGKWCVVVASDNKKLAGAWVPGQAECLLRASDTAKTLHVPLVYVLNCSGVKFDEQEKVYPNRRGGGTPFFRNAELNQLGIPVIVGIYGTNPAGGGYHSISPTVIIAHEKANMAVGGAGIMGGMNPKGHVDLEYANEIADMVDRTGKTEPPGAVDIHYTETGFMREVYASEEGVLEGIKKYVGMLPKYDPEFFRVDDPKAPAFPADDLYSMVPLNDKRAYDIYNVIARLFDNSELHEYKKGYGPEMVTGLAKVNGLLVGVVANVQGLLMNYPEYKAAGSVGIGGKLYRQGLVKMNEFVTLCARDRLPIVWIQDTTGIDVGNDAEKAELLGLGQSLIYSIQTSHIPQFEITLRKGTAAAHYVLGGPQGNDTNAFSIGTAATEIAVMNGETAATAMYSRRLAKDRKAGKDLQPTIDKMNNLIQAFYTKSRPKVCAELGLVDEIVDMNKIRGYVEAFTEAAYQNPESICPFHQMILPRAIREFETFVKK

SEQ ID NO: 50457 - protein, 276 aa, Schizosaccharomyces pombe 972h-
MKPFSPSQTNFEKEQLCFGVYQLKDCYQQVIEALSLGIRVIDSAITYRNEKECEQAIQDFCHQNVNIKREDITLITKIPDSLQGFERTWKAVEQSLRRTGRPKLDVVLIHSPKWPVRRIESWRALLQHQKEGRINKIGVSNYNIHHLEEIISLGLPLPAINQVEFSAFNNRPTFLSYCFNHGILVQAFSPLTRGYRLSDIRLLDLSLKYNKTPANILLRYCLQKGVSPIFKASSFVHIHENVKAEQFMLDPSDMDVMDTWDEEFVSKPTWNPIILP

SEQ ID NO: 50458 - protein, 193 aa, Erythrobacter sp. SD-21
MFIETETTPNPASLKFLPGRPVMGQGTREFANPEAAEASPLAQAIFDTGEVVNVFFGGDFITVTSAPGVSWSDLKPQVLSILLDHFVSEAPLFVPGTAGGIAVPAEDEALLVEENAADADIVAQINELLETRVRPAVAGDGGDIQYRGFKDGVVYLQLQGACSGCPSSTATLKHGIEGLLKHYVPEVVEVRAA

SEQ ID NO: 50459 - protein, 290 aa, Agrobacterium tumefaciens str. C58; identical to SEQ ID NO: 926

SEQ ID NO: 50460 - protein, 275 aa, Arabidopsis thaliana
MKGLTRLLNSLSRHTASVTCSPSSSSLLISRRSLFISAATHFPVNFSESITTNASRNCSRSSSFPFNWIEQRRTMFIQTQSTPNPSSLMFSPGKPVMEIGSADFPNSRSAMSSPLAKAIFAIDGVVRVFYGSDFVTVTKSDDVTWDILKPDIFAVVMDFYSSGQPLFLDSQATAAKDTAIHEDDSETVAMIKELLETRIRPSVQDDGGDIEYCGFDTETGIVKLRMQGACSGCPSSSVTLKSGIENMLMHYVSEVKGVEQEFDGEEEGTSSGPME

SEQ ID NO: 50461 - protein, 230 aa, Staphylococcus epidermidis ATCC 12228
MKDAKELKLMTLEDVLSQIENGMTIGIGTGSTIELLIPQIAELIQQKNYTITGVCTSNKTAFLAKELAMNIVDVNDVEKIDLAIDGADEVDSALNLIKGGGGALFREKVIDEMADRFVVVVDESKLVNYLGETFALPVEVDKFNWYQVAKKIERTYDIHVSRRVNEDVPFITDNGNYILDCSLQNRIPAYELHEFLIHLTGVLETGYFLDIADQVIVGTQEGVKILNKET

SEQ ID NO: 50462 - protein, 361 aa, Glycine max
MKALILVGGFGTRLRPLTLSVPKPLVDFANKPMILHQIEALKAIGVNEVVLAINYQPEVMLNFLKEFEAKLGIKITCSQETEPLGTAGPLALARDKLIDDSGEPFFVLNSDVISEYPLKEMIEFHKTHGGEATIMVTKVDEPSKYGVVVMEETTGQVERFVEKPKLFVGNKINAGIYLLNPSVLDRIELRPTSIEKEVFPKIAAEKKLYAMVLPGFWMDIGQPKDYISGLTLYLDSLRKKSPSKLASGPHFVGNVIVHETATIGEGCLVGPDVAIGPGCVVESGVRLSRCTVMRGVRIKKHTCISNSIIGWHSTVGQWARVENMTILGEDVHVCDEVYSNGGVVLPHKEIKSNILKPEIVM

SEQ ID NO: 50463 - protein, 540 aa, Francisella tularensis subsp. holarctica
MLFCDDSKKYLKEQNINLKNEFDKDDKRVEKFSLKHQNIYFDYSKNLINNYILKSLLESAEKSSLKDKIKQMFNGAKINSTEHRAVLHTALRDLSSTPLIVDGQDIRQEVTKEKQRVKELVEKVVSGRWRGFSGKKITDIVNIGIGGSDLGPKMVVRALQPYHCTDLKVHFVSNVDADSLLQALHVVDPETTLFIIASKSFSTEETLLNSISAREWLLDHYEDEKAVANHFVAISSKLDKVKEFGIDLEHCYKMWDWVGGRYSLWSSIGMSIAFAIGYDNFEKLLAGAYSVDKYFKETEFSKNIPVIMALLASYYSCTYNSQSQALLPYDERLCYFVDYLQQADMESNGKSVNIAGGTVNYQTGVVLWGGVGTNGQHAFHQLLHQGNIFIPVDFIAIATSHHNYDNHQQALLANCFAQSQALMFGQSYDMVYNELLKSGLNETQAKKLAAHKVIPGNRPSTTILLDELSPYSLGALIALYEHKIFVQGVLWDINSYDQWGVELGKKLGKNILKAMNDDSSDEYQNLDDSTRQLIAKVKNK

SEQ ID NO: 50464 - protein, 496 aa, Zinnia elegans
MCSTTLNMCDLEFFILASCLVLALFLILKLVKRRTNNGSTRNLPPGNMGWPFIGETIGYLQPYSATTIGKFMEQHISKYGKIYKSSLFGEPTIVSADPGLNKYILQNEGRLFECSYPRSIGGILGKWSMLVLVGDMHRDMRQISLNFLSNARLKTQLVNEVEKNTLWVLDSWKENSPFCAQEEAKKFTFNLMATHIMSLDPGEPETERLKKEYVTFMKGVVSPPLNFPGTAYWKALKSRATILKFIETKMEERIRMDEGNGLGKLDNDLLGWSMKNSNLTKEQILDLVLSLLFAGHETSSVSISLAVYFLEACPTAVRQLREEHEEIVMKKKLLGEKYLTWDDYKKMEFTQCVINETLRFGNVVRFLHRKAIKDVRYKGYDIPCGWKVLPVIAAVHLDPTHFDQPYLFDPWRWQNASVTSSTCSTPPSASNFMPFGGGPRLCTGSELAKLEMAIFIHHLVLKYEWELVDSDEAFAYPYLDFPKGLPIKIRHRKQSC

SEQ ID NO: 50465 - protein, 448 aa, Halomonas halodenitrificans
MQHLEGVTRPQQYRALGLSTLAFTTCFAVWTIFSIIGIQIKQDLGLNETQFGILVATPILTGSISRIFLGIWTEQFGGHRVFSVLMLLTAACVFLLSYVESYAMFLVAALGIGLAGGAFIVGIAYTSYWFEKDKQGTALGIFGAGNAGAAVTNFGAPFLLLALGWERTAVVYAVVLAAVAVGFWVFATEDPLTRARRRGQGAQATSARAQLEPLRHLRVWRFALYYFFVFGAFVALASYLPRYYVGAYGVSIAVAGSLAALYTLPASVFRALGGWMADRYGARAVMYLTFIASLVCLFLLAYPETRYVVQGKEGEIAFTLAMPLWGVVVLTVLLGFFMSLGKAAVFKHIPVYYPENVGSVGGLVGMIGGLGGFFLPILFGIVLDLTGIWTSSYMVIFMLVAVSLIWMHTAIRRMERKNVPELGEERYRYLPEIQEPAEEHARRHGPRP

SEQ ID NO: 50466 - protein, 175 aa, Oryza sativa Japonica Group
MKLRPKRPGWKSLMPLQLSRKSALRFFLFPKVQAAGQSPDDTPVYLNVYDLTPMNGYVYWAGLGIFHSGIEVHGVEYAFGAHDYPSSGVFEVEPRQCPGFRFRKSIFLGTTCLDPIQVRQFMELQSVNYNGDTYHLITKNCNHFCKDMCYKLTGNKIPKWVNRLARIGTIPLFNH

SEQ ID NO: 50467 - protein, 488 aa, Mycobacterium avium subsp. paratuberculosis K-10
MSGRRAARLCSGRTMMTTESVASKTTTSANGTASADIAGTVARLRQTFATGRTRDVEWRKRQLLQLQKLMEENEAAIAAALAEDLDRGPFEAYIADIATTAGEAKYAAKRVRKWTRRRYQLLELPQLPGRGWVEYEPYGTVLIIGAWNYPFYLTLGPAVGAIAAGNAVILKPSEIAAASSRVMAELVPKYLDNDAIAVIEGDGATSQELIAQGLDRVMFTGGTEIGRKVYEGAAPHLTPCTLELGGKSPVIVAADADVEVAAKRIAWMKLLNAGQTCVAPDYVLADAKIRDELVDKIGAAITKFTADKPEGMRVVNQRQFDRISSYLSGSDGKVTVGGACDPSTLRIQPAVVVDPDPDGPLMRNEIFGPVLPVITVQNLDEAIRFVNSRPKPLSAYLFTKTRETRERVIKEVPAGGMLINHLAFQVSTAKLPFGGVGASGMGAYHGRYGFEEFSHRKSVLTKPTRPDLSSFIYPPYTERAFKMARKMF

SEQ ID NO: 50468 - protein, 233 aa, Ostreococcus tauri
MFDAREDALAGARQHANWSPYDNNGGTVLAVAGESYVICAGDTRMSSGYNILTRKFEKIDKMSGKTLMASAGFAADAVTLKKTLKARCKQYEFQNKREIGCVAFAQMLSNTLYYRRFFPYYAFNIVAGLDAEGKGAVFTYDAVGSYERTNYSCQGSGQALIMPVLDNQLKTVSPLVLPAASSATPLSEQEAIDLIKDCFATAAERDIYTGDSVELWIMNAEGVRKEEMALRAD

SEQ ID NO: 50469 - protein, 608 aa, Thermotoga maritima MSB8
MLLDEIKRMSYDELKRLAEDIRKRITEVVLKNGGHLASNLGTIELTLALYRVFDPREDAIIWDTGHQAYTHKILTGRDDLFHTIRTFGGLSGFVTRRESPLDWFGTGHAGTSIAAGLGFEKAFELLGEKRHVVVVIGDGALTSGMALEALNQLKNLNSKMKIILNDNGMSISPNVGGLAYHLSKLRTSPIYLKGKKVLKKVLEKTEIGFEVEEEMKYLRDSLKGMIQGTNFFESLGLKYFGPFDGHNIELLEKVFKRIRDYDYSSVVHVVTKKGKGFTAAEENPTKYHSASPSGKPKMLSYSELLGHTLSRVAREDKKIVAITAAMADGTGLSIFQKEHPDRFFDLGITEQTCVTFGAALGLHGMKPVVAIYSTFLQRAYDQIIHDVALQNAPVLFAIDRSGVVGEDGPTHHGLFDINYLLPVPNMKIISPSSPEEFVNSLYTVLKHLDGPVAIRYPKESFYGEVESLLENMKEIDLGWKILKRGREAAIIATGTILNEVLKIPLDVTVVNALTVKPLDTAVLKEIARDHDLIITVEEAMKIGGFGSFVAQRLQEMGWQGKIVNLGVEDLFVPHGGRKELLSMLGLDSEGLTKTVLTYIKARSREGKV

SEQ ID NO: 50470 - protein, 461 aa, Glycine max
MANRPDPDIDDDFRELYKEYTGPLGTATTNMQERAKSNKRSNAGSDEEEEARDPNAVPTDFTSREAKVWEAKSKATERNWKKRKEEEMICKLCGESGHFTQGCPSTLGANRKSQDFFERIPARDKNVRALFTEKVLSKIEKDVGCKIKMDEKFIIVSGKDRLILAKGVDAVHKIREEGDQRGSSSSQMTQSRSPERSPVSARFQRSEPQRSHSGPRNTSQFQQRFGRQERAVEDRIRDDVQKFSRGSPQAYGNSGARGRSSQSRSPRHAPYTGNSYNSFDDRNQNMGAYRNEGWDSHRRESGIQPGHQFDYNASPQTLEELELEYKNEATELMKIRDREEDEENFKHREAIRDLREKYMSKVSLVRVTHAKQLEEFLQLDAQRRRQQVGQQMSSGYRGFKQQSFPEYDGSTANPPTYAGSNIPLESRNRFSGNMETYPNRPHDNFGEFHRRGDFAKAYNRY

SEQ ID NO: 50471 - protein, 214 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMGIAAAAGIEARGFIFGPAIALAIGAKFIPLRKPKKLPGEVFSESYVLEYGMDCLEMHVGAIEPGERVVVVDDLVATGGTLSAAIRLLERAGANVAECACLIGLPKFKDFYKLNGKPVYILVESRK

SEQ ID NO: 50472 - protein, 768 aa, Nicotiana tabacum
MSRFTMLVVLVLLGLCLCHLSVATIGSTSNKKSTYIVHVAKSQMPESFEDHKHWYDSSLKSVSDSAEMLYVYNNVVHGFSARLTIQEAESLERQSGILSVLPELRYELHTTRTPSFLGLDRSADFFPESNAMSDVVVGVLDTGVWPESKSFDDTGLGPIPDSWKGECESGTNFSSSNCNRKLIGARYFSKGYETTLGPVDVSKESKSARDDDGHGTHTATTAAGSVVQGASLFGYASGTARGMATRARVAVYKVCWIGGCFSSDILAAMDKAIDDNVNVLSLSLGGGNSDYYRDSVAIGAFAAMEKGILVSCSAGNAGPSPYSLSNVAPWITTVGAGTLDRDFPAYVSLGNGKNFSGVSLYKGDLSLSKMLPFVYAGNASNTTNGNLCMTGTLIPEKVKGKIVLCDRGINPRVQKGSVVKEAGGVGMVLANTAANGDELVADAHLLPATTVGQTTGEAIKKYLTSDPNPTATILFEGTKVGIKPSPVVAAFSSRGPNSITQEILKPDIIAPGVNILAGWTGAVGPTGLAEDTRRVGFNIISGTSMSCPHVSGLAALLKGAHPDWSPAAIRSALMTTAYTVYKNGGALQDVSTGKPSTPFDHGAGHVDPVAALNPGLVYDLRADDYLNFLCALNYTSIQINSIARRNYNCETSKKYSVTDLNYPSFAVVFPEQMTAGSGSSSSSVKYTRTLTNVGPAGTYKVSTVFSPSNSVKVSVEPETLVFTRANEQKSYTVTFTAPSMPSTTNVYGRIEWSDGKHVVGSPVAISWT

SEQ ID NO: 50473 - protein, 375 aa, Silicibacter pomeroyi DSS-3
MAALLETVDPEGLEEFSVVFTDRSLNHMSSVFQQVMRDISGMLGAVYNTDAVAVIPGGGTYAMEAVARQFARGARVLVVRNGWFSYRWSQIIETGGLTAETTVMKARRSGNESTAPFAPAPIEDVVTAIREQKPDVVFAPHVETAAGVILPDDYITAMAAAAHEVGALMVLDCIASGCVWVDMKATGVDVLISAPQKGWSASPCAGLVMLSERAEARLAETQSDSFAIDLKKWRDIMKAYEGGGHAYHATMPTDALRAFRDTMAETRDYGFERLREAQWALGNGVRALLRDKGIVSVAADGFGAPGVVVSYTSDPDIQNGKKFAALGMQIAAGVPLQCDEPADFRTFRLGLFGLDKLYDVEGTIARLKRVLDQVL

SEQ ID NO: 50474 - protein, 573 aa, Synechococcus sp. RS9916
MLRLERVSKIYPTGEVLKDVTWEVKPGDRIGLVGVNGAGKSTQMRLIAGLEEPSSGQVVRQGEPRIAYLQQEFDVDPQRTVREELFQAFGEAAEVLNRQRAVEADMGSEKAAEDPEHLDQLIHELGRLQSRFEALHGYELEARIDKLLPTIGFTPEGAERTVADYSGGWQMRIALGKILLQDPDLLLLDEPTNHLDVATIQWLEGYLTEQTAALVVISHDRTFLDRVCNQIVSTERGVSRAYLGNYTAHLEQKAQEREATQAAFDRQQKEIATQQAYIDRFRASATRSTQAKSREKQLDKVELVDAPVESVSGPSFQFPPAPRSGREVARFENLTHSYGDKILFLGAELDVERGDRIAFVGPNGAGKSTLLRLVMGIETPDEGSAGLGEHNIIASYFEQNQAEALDLTKTVIDTLFEAVPDWTQTQVRSLLGSFCFSNESVFKEVGKLSGGEKARLALALMLLTPCNLLVLDEPTNHLDIPAKQMLENALCDYDGAALLVSHDRYFISRVANRIVELRDGELILYRGDYDYYLQKKQEEAEQARLAKVAAEKEAKRKANQAKQKQKQAKRKKG

SEQ ID NO: 50475 - protein, 768 aa, Nicotiana tabacum
MSRFTMLVVLVLLLLCLCHLSVATIGSSSNKKSTYIVHVAKSQMPESFENHKHWYDSSLKSVSDSAEMLYVYNNVVHGFSARLTVQEAESLERQSGILSVLPEMKYELHTTRTPSFLGLDRSADFFPESNAMSDVIVGVLDTGVWPESKSFDDTGLGPVPDSWKGECESGTNFSSSNCNRKLIGARYFSKGYETTLGPVDVSKESKSARDDDGHGTHTATTAAGSIVQGASLFGYASGTARGMATRARVAVYKVCWIGGCFSSDILAAMDKAIDDNVNVLSLSLGGGNSDYYRDSVAIGAFAAMEKGILVSCSAGNAGPGPYSLSNVAPWITTVGAGTLDRDFPAYVSLGNGKNFSGVSLYKGDLSLSKMLPFVYAGNASNTTNGNLCMTGTLIPEKVKGKIVLCDRGINPRVQKGSVVKEAGGVGMVLANTAANGDELVADAHLLPATTVGQTTGEAIKKYLTSDPNPTATILFEGTKVGIKPSPVVAAFSSRGPNSITQEILKPDIIAPGVNILAGWTGGVGPTGLAEDTRRVGFNIISGTSMSCPHVSGLAALLKGAHPDWSPAAIRSALMTTAYTVYKNGGALQDVSTGKPSTPFDHGAGHVDPVAALNPGLVYDLRADDYLNFLCALNYTSIQINSIARRNYNCETSKKYSVTDLNYPSFAVVFLEQMTAGSGSSSSSVKYTRTLTNVGPAGTYKVSTVFSSSNSVKVSVEPETLVFTRVNEQKSYTVTFTAPSTPSTTNVFGRIEWSDGKHVVGSPVAISWI

SEQ ID NO: 50476 - protein, 484 aa, Haemophilus influenzae R2866
MSVKGDIGVIGLAVMGQNLILNMNDHGFKVVAYNRTTSKVDEFLQGAAKGTNIIGAYSLEDLAAKLEKPRKVMLMVRAGDVVDQFIDALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYEEMQAIFAEWKKTELDSYLIDITTDILGYKDVDGQPLVEKILDTAGQKGTGKWTGINALDFGIPLTLITESVFARCVSSFKDQRVVANQLFGKTIAPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 50477 - protein, 412 aa, Escherichia coli K12
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENRDRIRQAIRGIKAMFRADGLLPASSKHIHENAE

SEQ ID NO: 50478 - protein, 494 aa, Haemophilus influenzae R2866
MQTDNNCIVIFGASGDLTHRKLIPALYNLYKIGRLSENFSVLGVARSDLNDETFREKMRESLIHNEETTPDTLDAFCSHLYYQAVNTSDAQDYGKLVPRLDDLHDKYQTCGNTFYYMSTPPSLYGVIPECLAAHGLNTEEYGWKRIIVEKPFGYDEKTAQTLDVQIHRFFEEHQIYRIDHYLGKETVQNLLVLRFSNGWFEPLWNRNFIDYVEITGAESIGVEERGGYYDGSGAMRDMFQNHLLQVLAMVAMEPPAIINANSMRDEVAKVMHSLRPLTSEDMENNLVLGQYTAAEINGKMEKGYLEEKGVPANSRTETYIALRCEIENWRWAGVPFYVRTGKRLPARVTEIVIHFKTTPHPVFSQNAPENKLIIRIQPDEAISMRFGLKKPGAGFEAKEVSMDFRYADLAGAQVLTAYERLLLDAMKGDATLFARTDAVHAAWKFVQPILDYKANGGRIHEYEAGTWGPVAADKLIAKQGKVWRKPTGLMKKKV

SEQ ID NO: 50479 - protein, 228 aa, Capsicum chinense
MPESNLNGAYYGPSIPPPSKSYHRHGRGSSCNPCSCLFGCLCNCIFQIIFTILIVLGVIALVLWLVLRPNKVKFYVTDATLTQFDLSTANNTLYYDLALNMTIRNPNKRIGIYYDSIEARGMYKGERFASQNLEPFYQGHKNTSSLHPVLKGQSLVLLGDREKSNYNNEKNSGVYDIEMKLYMRIRLKIGWIKTHKIKPKIECDIKVPLESNGRSSANFEETRCHLDW

SEQ ID NO: 50480 - protein, 831 aa, Escherichia coli K12
MLTIQFLCPLPNGLHARPAWELKEQCSQWQSEITFINHRQNAKADAKSSLALIGTGTLFNDSCSLNISGSDEEQARRVLEEYIQVRFIDSDSVQPTQAELTAHPLPRSLSRLNPDLLYGNVLASGVGVGTLTLLQSDSLDSYRAIPASAQDSTRLEHSLATLAEQLNQQLRERDGESKTILSAHLSLIQDDEFAGNIRRLMTEQHQGLGAAIISNMEQVCAKLSASASDYLRERVSDIRDISEQLLHITWPELKPRNKLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDNKRIDIAANIGTALEAPGAFANGAEGVGLFRTEMLYMDRDSAPDEQEQFEAYQQVLLAAGDKPIIFRTMDIGGDKSIPYLNIPQEENPFLGYRAVRIYPEFAGLFRTQLRAILRAASFGNAQLMIPMVHSLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTTAHQRGKWVGICGELGGESRYLPLLLGLGLDELSMSSPRIPAVKSQLRQLDSEACRELARQACECRSAQEIEALLTAFTPEEDVRPLLALENIFVDQDFSNKEQAIQFLCGNLGVNGRTEHPFELEEDVWQREEIVTTGVGFGVAIPHTKSQWIRHSSISIARLAKPIGWQSEMGEVELVIMLTLGANEGMNHVKVFSQLARKLVNKNFRQSLFAAQDAQSILTLLETELTF

SEQ ID NO: 50481 - protein, 210 aa, Oryza sativa Japonica Group
MSEEDTNAAAGQPRRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDISELSPHRLQEIKRFFEDYKKNENKEVAVDAFLPANTARDAIQYSMDLAAQNILHS

SEQ ID NO: 50482 - protein, 170 aa, Bacillus subtilis subsp. subtilis str. 168
MDLKQYVTIVPDYPKEGVQFKDITTLMDKGDVYRYATDQIVEYAKEKQIDLVVGPEARGFIIGCPVAYALGVGFAPVRKEGKLPREVIKVDYGLEYGKDVLTIHKDAIKPGQRVLITDDLLATGGTIEATIKLVEELGGVVAGIAFLIELSYLDGRNKLEDYDILTLMKY

SEQ ID NO: 50483 - protein, 78 aa, Glycine max
MVARLCMFKSQVLDKEVFQKQMLEKLIWICSVMLVGAPHGGVSVGVMDKEFRSEVSFAIYIFSKLICNFVWINFSINI

SEQ ID NO: 50484 - protein, 612 aa, Erythrobacter sp. SD-21
MGDSPENTDGLPWETDVEDDAPSAAELEAAGQDSMFGDTPEPQAAPAPEPAPTPAPASVEPSAAAIQTQESAEPAQPYRVLARKYRPQTFAELIGQDAMVRTLANAIARDRLAHAFLMTGVRGVGKTSTARLIAKALNCIGPDGEGGPTISPCGVCEPCTAIAEGRHIDVIEMDAASHTGVDDVREIIEAVRYAAVSARYKIYIIDEVHMLSRNAFNALLKTLEEPPAHVKFLFATTEVDKLPVTVLSRTQRFDLRRIPVELLEAHFAEICRKEGVEAEDEALHIAANAAEGSVRDGLSILDQAIAHADMDTGGKVTADRVRDMLGLADRGAQRRLFAHILDGDAKAALAAVDDQYALGVEPLALMRSLMDLTHRIALTQVSGSEAEATTAEERDQLTEWSKRLEVGQVHRLWQLLLKGHEEVRHAPDPLVSARMALLRVLHAAGMPDPGKLAKQLEELAARGPAPAASAGEGGAGAPTAALDWEELIEKVSAAGKLQAESIMRLQIRPISVEMGKLVYTRDAKYGDAIEPVLKDALYAVTETRWQLETGDPALATPSLEEQRQAKAEAAKAAMKEHPMVKAVEAAFPDAEMIEDRADVPPMQREVPWNRRA

SEQ ID NO: 50485 - protein, 262 aa, marine gamma proteobacterium HTCC2143
MNRLEGKVAIITGAASGIGKATAQLFAREGARVVLGDLAGDDLQQVISQINADGFSAIGQTTDTSKQLSVDELVALAMDNYRQVDVLFNNAGIVGAVEDVADSSDEGWLRVHAVNVLGPVHGVKAVAPIMRKNQYGSIINTASVAGVRAGAGPNAYSASKAAVINFTQTAACDLGVSNVRVNAICPGLIETGMTKPAFDYAKEAGKEEKLGSRCELRRYGKPIEIANTVLFLASDDASYITGQAICVDGGNTASLNLPGMKY

SEQ ID NO: 50486 - protein, 349 aa, Solanum tuberosum
MAGSNINQPLLDQLPKTLQNVDSRRRRLRRLKSAPMPEFVPGEMNDIKDDQSLPRYESILDKLHPSFRKVILYLAIYLTIGTTCFYFVQNQIQGKKVNGVLDSVYFCVVTMTTVGYGDLVPNSATAKLLASFFVFSGMALVGMVLSKGADYLVEKQETLLIKALHMRDKVGPSVILEEIETNKVRYKCFVITATLVVLIVVGTVFLAEVEKLSTIDAFYCVCSTITTLGYGDKSFSTKAGRIFAIFWILTSTLCLAQFFLYVAEFNTERKQKELVQWVLSRKMTNVDLEVADLDNDRVVAAAEFVVYKLKEMGKISQDDVSLLLDEFECLDVDQSGTLSTTDLSLAQSS

SEQ ID NO: 50487 - protein, 358 aa, Penicillium marneffei
MGCINSKVEPEDKEAVRINAGIDKQIRSDKKTYDRTVKMLLLGAGESGKSTIIKQMRIIHSGGFPEDERRQNRAVIYSNLVVAFKVLMDIMQTQKIEFEKESNQALGIFLAKTEADVDTDEAFADLEIKEAMTELWSDSGVQKAVARGHEFALHDNLHYFFNSLDRLFTPGWLPDNQDMLHSRLRTTGITETLFELGQLNFRMMDVGGQRSERKKWIHCFEGVQCLLFMVALSGYDQSLLEDQNANQMHEAMMLFESLANGEWFKRKPIMLFLNKMDLFRTKLPLSPINKHFPDYSGSSTDFDTAAKYFADRFRSINRMPDREIYIHYTNATDTTLLKATMDSVQDMIIQKNLHTLIL

SEQ ID NO: 50488 - protein, 329 aa, Solanum tuberosum
MAVNGSAPSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEEEARKQIKSMWNYADVIKVSDVELEFLTGSNKIDDECAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTVSEVLTLLKGGA

SEQ ID NO: 50489 - protein, 364 aa, Zea mays
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFDEGMKNHSVIIAKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 50490 - protein, 694 aa, marine gamma proteobacterium HTCC2143
MVAVSNMVDLTVEDGVAILTVDNPPVNALSSGVRAGLSDGVAQAAADDNVTAIVLICAGRTFIAGADITEFGGKATGPSLHEALEAMENCSKPIVAAIHGTVLGGGLETALVCHYRVSDAKARFGLPEVKLGLLPGAGGTQRLPRVVGVEKALQMVTSGDQIGADEALASGLISEIVTDLRGDAIAFAKKVVAEGKPLVRIRDQNAEIDAAKAKPELFSNIRKAIARKSRGFKAPEYNIRCIEAAVNSDNFDDGLKVEADLFRELMTGGQSAAQRHFFFAERQAAKIPDVPKETPEIEINSVGVIGAGTMGGGISMNILNIGTPVTIVETTQEALDRGIAIVRKNYENTAKKGRISQQDVEDRMALLTGSLNIEDLADCDLVIEAVFENMKVKKEIFAKLDKIVKQGAILASNTSALDVNEIASATVRPESVIGLHFFSPANVMKLLEVVRGDKSSHPVIKTSMAFAKRIGKVAALVGVCPGFVGNRILAPRQQQAQQLILEGALPHQVDKVLFDFGKPMGPFQMSDLAGLDIGWSEETSNGKEVLRDRLVEAGRRGQKTSAGYYDYDENRVPSPSPEIEKIILEFSEKNGKTRREISDEEILIRCIYPMINEGAKILEEGIAIRSSDIDVVWVYGYGWPIYRGGPMFYGDSIGLPKIVAKMRELKEQTGDPMWEPAALMVKLAEEGKGFKDFA

SEQ ID NO: 50491 - protein, 364 aa, Zea mays
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKDHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKAIVVECVLPVNTEATPKAQGVFHVDMIMLAHNPGGKERYEREFRELAKGAGFSGFKATYIYANAWAIEFIK

SEQ ID NO: 50492 - protein, 246 aa, Mycobacterium avium subsp. paratuberculosis K-10
MGRVDGKVALISGGARGMGAEHARLLAAEGAKVVIGDILDDEGKAVADEIGDSVRYVHLDVTQPDQWDAAVETAVGEFGKLNVLVNNAGTVALGPLKSFDLAKWQKVIDVNLTGTFLGMRVAVEPMIAAGGGSIINISSIEGLRGAPMVHPYVASKWGVRGLAKSAALELAPHNIRVNSVHPGFIRTPMTKHLPDDMVTVPLGRPAESREVSTFVLFLASDESSYATGSEFVMDGGLVTDVPHKQF

SEQ ID NO: 50493 - protein, 521 aa, Yarrowia lipolytica CLIB122
MLEILIGVTLFFTLWRVLVLADLKRRQKKSGYGYPPIASNGLLGWRGLVHQLSGFVKDIGPAGWGAQFKEHGKTHLYPVFPTQLLVTRDPDNVKAILATQFKDFSFGIRKEALCPSLGYGIFTVEGSSWSHSRALLRPQFSREQISRLDSVEHHFQEFAQCVDNFKGEYFDIQKLFFAQSMDTSTDFLLGESVGCLKELLETRDGDESSKKFGANFQHAFDRVQRLVALRVVFQENYWIIGDVFFRNEFRQVNELIQKFVQGYVDKALKARAHKAPIYTNPDKYIFLYELARDTTNPRVLRDQVLNILIAGRDTTAATLSWLMFELAQKPHIFHKLRKAVIEDFGTTIENISFESLKQCEYLRYVLNEVLRLHPVVPINLRVALKDTTLPRGGGPNGDEPIFVPKGQKINYAVYWTHRDEQYWGEDAEEFKPERWDTTNHPGPLGKGWEFLPFNGGPRICLGQQFALTEMGYILTRLVQEYSDIGIDEEYHDRPLRVRHSITMSHGDGVHVRLSREGTVVS

SEQ ID NO: 50494 - protein, 512 aa, Francisella tularensis subsp. holarctica
MKKTTLLVILDGWGYSDSDYFNAIKNANTPTWDSIWQEFPKTLINASSLEVGLPRSQMGNSEVGHVNIGCGRVVYQELTKIDKAIEEKTFGDNKAICAAIDNVIKNDSNLHLIGLLSPGGVHSHEEHIFEMIKIAKQKGIKRLYLHAFLDGRDTPPRSAEKSIKKADKLLQDLNLGYIASVCGRYYAMDRDNRWDRVEKAYNAIVNANADFIYDSALEALEQSYARDQSDEFVIPTCIKKDGHLVKVQDNDSVIFMNFRADRAREISHAFTDESFDHFPRKKHLNINFTTLTEYDSKLKCAVAFPPEQPINTLGEVLMKNHKTQLRIAETEKYPHVTFFFNGGREEQFEGEDRILIPSPKVATYDLQPEMSAPEVTDKLVAAINSGKYDCIVCNYANSDMVGHTGNYEAAMQAIEYLDKCIARLKDAILEHDGNMFITADHGNADMMVNPETQKPHTAHTTNLVPFIYVGHKKAQVALEHGKLSDIAPTLLNVMGIAQPKEMTGKTIFNFEK

SEQ ID NO: 50495 - protein, 529 aa, Magnaporthe grisea 70-15
MATMPTNGNVNHQDQNAASASSRSQSNTESSSLSKDEVGWYFVEQYYTTLSKNPERLHLFYGKHSQLVYGLEAEVANVSVGRQQIQERIKSLDLQDCKVRVSNVDSQASEESIVIQVIGETVNKGGEPKKFVQTFILAKQPSGYFVLNDILRYINDDAEEDAAETAAAEEEAAAPETQAAAEPEAAKVEPEAAKPEAEAAEVDAAVSKDAEKTAESKEAPAAEAASTQPATQKDAVATPAKAESAAATPDPEKVAEEIAEEEVKKPELPKDPSPTPVAPRPAAPAAAEPEKAKEPPKPMTWASRAAAAARPAVALPKPAVPAAAPAARPAAAAPAATPAAAAPAAAAPKPAAPAPAAEAPAAQESGSEWQTAGADSKRQKGSQSVVGAPQEDKGTLGYVKFVTEKVKTENLKTHLSSFGELVYFDINRTKNCAFVEFANIAGYTAAAAANPHTVDGEQIYVEPRRPKASAYGGSNYSNRGGSVPGRGRGGFDGNRSGSQGGRGSYGNQGRGGRGGAPRGRGGVSQPTNA

SEQ ID NO: 50496 - protein, 191 aa, Chlamydomonas reinhardtii
MTNHKGRYLEGLSVSLKAVHEQGDDIQSADFARLCDHILEAFDHLGTIMYFAKVEMGGKVESIRKVSAQLKTLREVVDADVRAGRATTKGSCARNLHRLMLVITFVRLLLQQLLDSPSTQLKDALWVAYKGSLHPIHTYMVQTAVWAGLGMVPSRAAFMASIGEDEDSARQHVPEVLAAAAELAGRLERMY

SEQ ID NO: 50497 - protein, 282 aa, Thermotoga maritima MSB8
MRIDTVNVLLEALPYIKEFYGKTFVIKFGGSAMKQENAKKAFIQDIILLKYTGIKPIIVHGGGPAISQMMKDLGIEPVFKNGHRVTDEKTMEIVEMVLVGKINKEIVMNLNLHGGRAVGICGKDSKLIVAEKETKHGDIGYVGKVKKVNPEILHALIENDYIPVIAPVGIGEDGHSYNINADTAAAEIAKSLMAEKLILLTDVDGVLKDGKLISTLTPDEAEELIRDGTVTGGMIPKVECAVSAVRGGVGAVHIINGGLEHAILLEIFSRKGIGTMIKELEG

SEQ ID NO: 50498 - protein, 95 aa, Triticum aestivum
MDSGNTQTEGSQPLPKNPAMTSCRKKKTDDDVTFLEDVKEHIDEFIHASMDEHKTCFKKTIQKMFGMSKVVAERSAAAKEAEVESALPLQTSVSQ

SEQ ID NO: 50499 - protein, 388 aa, Silicibacter pomeroyi DSS-3
MAQNPLSKPTACLVLADGTVFYGTGFGATGQTVAELCFNTAMTGYQEIMTDPSYAGQIVTFTFPHIGNVGVTPEDDETTDPVAAGMVVKWDPTAASNWRAAEELKGWLARRGRIAIGGVDTRRLTRAIRQQGAPHVALAHDPEGKFDLAALIAAARGFAGLEGMDLAKDVTCAQSYRWDEMRWAWPEGYARQEAPKHKVVAIDYGAKRNILRCLASSGCDVTVLPATATAAEVLAHAPDGVFLSNGPGDPAATGEYAVPMIREILDTTSLPVFGICLGHQMLALALGGRTVKMNHGHHGANHPVKDLETGKVEITSMNHGFAVDAQSLPEGVVETHRSLFDGSNCGIRMSERPVFSVQYHPEASPGPQDSFYLFERFAAAMDAQKAEV

SEQ ID NO: 50500 - protein, 385 aa, Thermotoga maritima MSB8
MYLMNTYSRFPATFVYGKGSWIYDEKGNAYLDFTSGIAVNVLGHSHPRLVEAIKDQAEKLIHCSNLFWNRPQMELAELLSKNTFGGKVFFANTGTEANEAAIKIARKYGKKKSEKKYRILSAHNSFHGRTLGSLTATGQPKYQKPFEPLVPGFEYFEFNNVEDLRRKMSEDVCAVFLEPIQGESGIVPATKEFLEEARKLCDEYDALLVFDEVQCGMGRTGKLFAYQKYGVVPDVLTTAKGLGGGVPIGAVIVNERANVLEPGDHGTTFGGNPLACRAGVTVIKELTKEGFLEEVEEKGNYLMKKLQEMKEEYDVVADVRGMGLMIGIQFREEVSNREVATKCFENKLLVVPAGNNTIRFLPPLTVEYGEIDLAVETLKKVLQGI

SEQ ID NO: 50501 - protein, 277 aa, Bordetella pertussis Tohama I
MKNDLSIAFIGGGNMAAALASGLAGKVCPAANIHVVDINADSHAGWRARGMSAAAAPDATLAGCRVWVYAVKPQHMREAVAGTRPWLRPDTLIVSVAAGIRADTLAGWLGEPGQPWQRLVRCMPNTPALVGAGMTGLAALPGVTPQDRELAGQLLTSVGEVVWVDGDAGLDAVTALSGSGPAYVFLFIEALIAGGRAVGLTDEQARQLALGTLAGATRLAAQSDEPPAVLRERVTSKGGTTAAALDVYAQGDFAGLVERAMQAAARRSRELAEEFGR

SEQ ID NO: 50502 - protein, 264 aa, Yarrowia lipolytica CLIB122
MSVIETFPLPQKGQSERQQLLILTDKPDYYLLEFNSAPENRLSKDFIDAFVEALYYLLLKKGDSPKPLVTSSTTPKFYSNGLNWEQAKSTPEFFHRYLGRLQRAFIEFPWPTIAHVNGHAFAGAFIVANHHDFKVMNPNKGWLCMNEISFDASLQACLMSVHSHQYGPRLARKICMTGHRFTAAEALKEGLIDAAGGWPEVDELAKKIKPLVGKYNYRQMRMAIFAPVLEQTKNFYHYARLDKAAQNEADDFRREREEEIKAKL

SEQ ID NO: 50503 - protein, 436 aa, Pseudomonas putida
MNYLSPAKIDSLFSAQKAYFATRATADVGFRKQSLERLKEAVINNKEALYSALAEDLGKPKDVVDLAEIGAVLHEIDFALAHLDEWVAPVSVPSPDIIAPSECYVVQEPYGVTYIIGPFNYPVNLTLTPLIGAIIGGNTCIIKPSETTPETSAVIEKIIAEAFAPEYVAVIQGGRDENSHLLSLPFDFIFFTGSPNVGKVVMQAAAKHLTPVVLELGGKCPLIVLPDADLDQTVNQLMFGKFINSGQTCIAPDYLYVHYSVKDALLERLVERVKTELPEINSTGKLVTERQVQRLVSLLEATQGQVLVGSQADVSKRALSATVVDGVEWNDPLMSEELFGPILPVLEFDSVRTAIDQVNKHHPKPLAVYVFGKDMDVAKGIINQIQSGDAQVNGVMLHAFSPYLPFGGIGASGMGEYHGHFSYLTFTHKKSVRIVP

SEQ ID NO: 50504 - protein, 224 aa, Haemophilus influenzae R2866
MKPYLIAPSILSADLARLGNDVQNVLNAGADVIHFDVMDNHYVPNLTFGPAVCQALRDYGITAPIDVHLMVKPIDRIIPDFAKAGANYITFHPESSEHIDRSLQLIRDCGCKSGLVFNPATPLSYLDYVLDKVDVVLLMSVNPGFGGQSFIPATLKKLQQARKIIDESGYDIRLEVDGGVKVDNIAEIAAAGADMFVAGSAIFGKPDYKQVIDQMRTQLASVSA

SEQ ID NO: 50505 - protein, 486 aa, Streptomyces avermitilis MA-4680
MADPKGFLTHGREVARTRPVEERVKDWNEVYVPGSLLPIISKQAGRCMDCGIPFCHNGCPLGNLIPEWNDYAYREDWTSASERLHATNNFPEFTGRLCPAPCESACVLGINQPAVTIKNVEVSIIDKAWDTGDVKPQAPERLSGKTVAVVGSGPAGLAAAQQLTRAGHTVAVYERADRIGGLLRYGIPEFKMEKRHINRRIEQMRAEGTKFRTGVEIGRDIDAAKLRRRYDAVVVAAGSTTARDLPVPGRELKGVYQAMEYLPLANKVQEGDFVAPPITAEGKHVVVIGGGDTGADCVGTAHRQGAASVTQLEILAKPGEERAAHQPWPTFPMLYKVTSAHEEGGERVYSVSTTHFEGDEDGNVQWLHLVEVEFVDGKLTQKPGTERRIPAQLVTLAMGFTGTDQDNGLVTQFGLGLDERGNIARDADFQTNVPGVFVAGDAGRGQSLIVWAIAEGRSAAKGVDRFLTGASELPAPIRPTDRSLMV

SEQ ID NO: 50506 - protein, 325 aa, Pseudomonas aeruginosa PAO1
MAKRIQFAAYGGPEVLEYRDYQPAEPGPREVRVRNRAIGLNFIDTYYRSGLYPAPGLPSGLGSEGAGEVEAVGSEVTRFKVGDRVAYATGPLGAYSELHVLAEEKLVHLPDGIDFEQAAAVMLKGLTTQYLLRQTYELRGGETILFHAAAGGVGLFACQWAKALGVQLIGTVSSPEKARLARQHGAWETIDYSHENVARRVLELTDGKKCPVVYDSVGKDTWETSLDCVAPRGLLVSFGNASGPVTGVNLGILSQKGSLYVTRPTLGSYADTPEKLQAMADELFGLIERGDIRIEINQRFALAEAARAHTELAARRTTGSTVLLP

SEQ ID NO: 50507 - protein, 429 aa, Salmonella enterica subsp. enterica serovar Paratyphi A str.
MKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDSFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 50508 - protein, 1003 aa, Coccidioides immitis RS
MAGHDDEEARIETVKDAVTDMKLERQSSTESVAPNGILDTITPKDEPNGHLSSKPSTPSLKPPKSRSRSSNSLAKDEVPEEKVGGDITIKQEPGQPPKLARSASQKLPPRAAPLFTDLPDKTTEATSTFQLMEVCTYANKYLGYTEHAMDCDCAEEWACGEDSDCINRATKMECFGDCGCGDSCQNQRFQRREYAKVSVIKTEKKGYGLRADCDLRPNEFIFEYIGEVINEPQFRRRMIQYDEEGIKHFYFMSLNKGEFVDATKKGNLGRFCNHSCNPNCYVDKWVVGEKLRMGIFAERYIKAGEELVFNYNVDRYGADPQPCYCGEPNCTGFIGGKTQTERATKLSHATIEALGIDDPDGWDTAVARRPRKKKAGEDDEEYVDSLQPKSLDENGVTKVMAALMQCKEKWIAVKLLGRIQRCEDERVRHRVVRMHGYQILNSQLNTWKDDFNVVLQILDILDKFPRLTRNKIIDSKIEGTVSPLQECDDERVAEKAKALLEIWSALEVGYRIPRMKRDPAAVNNTPTANHYERRETAKDDRKPNSSKSRSRSRSRSRSVDVTRNAPRGPAALTRGGGKGHMHSYRPGQRPFRRPFNPLPKGWFAAESNGRTYYYSATGETTWSRPTAPAVQPPPPPKRESKEKTLQDIIDGIMNAKENTPKAKDKSATPATPADAKIPEKKEHKEKWRSYSEEKQKKLYENTLFPHVKYIVDKFKHKLPKDDLKRYAKEVAKKLVNSDFKNNRVEDPTKISDKQVKQVKKYCKEYFDKAVAKHRAYEEKKAERKSKGSVKATTSATIDKAETTSTKAPPQFDGAAETGDEDSDVQLSDAEYEDGQEESSHHSGLKRKRTDDEDFENDHENGGVSPTKRQRSASLPIIPPPPPPMSPSNLVLDDGSREALKRQRTEGAEDDEYGDSTISSGKRQRSETPPPPPPPPPPADIPPENIESENENDKDQEELQDYDVQEANWGKEDNIAIQSPSHSPFPAQSISNHSNTARETDSHS

SEQ ID NO: 50509 - protein, 517 aa, Pseudomonas aeruginosa PAO1
MWTRLLPFLAWLPGLHRGMLGREAWVGLNGAILALPQSMAYALIAGLPAEYGLYAAMLPVAIACLWGSSRYLVSGPTAAISVLLFSSVAPLAPLGSPQYVQAVLLLTFLAGAFQWLLGVLRVGSLVNFVSHSVMLGFTLGAALLIVLGQLPYLLGLAASGEGAAPGNGWRLLARFAEFDGPSLLVGGFSFALSLLVRRLRPRWPALLLGLLGGATLVWALPGTFASVAHVQALSSALPGWSPLVFDSRSILDLLPAAVACGMLGLVTSLSIARALAARQGDAFDANQEVRAQGLSNLLGPWLSASLSAGSFTRSGLNLEAGARSPLAGAFSALWVALLAVLGARLIEHVPLPAMAAGILLIAWGLIDRPALRALYRSGRAECLVAGLTALATLLLPLQNAIYAGVLASLVFYLRRTSTPRVLRQRNDEEEVLRIEGSIFFGACDYLQRLMRQCDRPRLVLDARQVNFIDFAGAVLLQQEARRLHAEGRRLVLRHARPQVREALGRQADEGCRLHYEG

SEQ ID NO: 50510 - protein, 262 aa, Pfiesteria piscicida
MAKPHALLVFSRHGESEWNVANKFTGWVDVDLSEKGVGEAKAAGELIKQEGLKFDVCHTSYLKRAIKTCNLALESADQLYAPVSKTWRLNERMYGGLTGLDKKETVVKHGAEQVQIWRRSFDLPPPEIDEASPFHPKLEAKYADLDPKDIPKTESLKTVIERVMPYWEGTIMPDLKAGKTVFVAAHGNSIRAIVKYIEGIPDDVIPGLEIPTGTPLVYALDADLKPIACDQAVAPLKYGRYLGDAEKIKAAAEAVKNQTKVG

SEQ ID NO: 50511 - protein, 322 aa, Agrobacterium tumefaciens str. C58
MPEARKPGRGRVYSSITETIGDTPIVRLDKLAKEKGVKANLLAKLEFFNPIGSVKDRIGVAMIEALEAQGKITPGKTTLVEPTSGNTGIALAFAAAAKGYKLILTMPETMSVERRKMLALLGAELVLTEGPKGMKGAIAKAQELAETLPDAVIPQQFENPANPDIHRRTTAEEIWNDTDGTVDILVSGIGTGGTITGTGQVLKSRKPEVKVIAVEPADSPVLSGGNPGPHKIQGIGAGFAPAILDTGVYDEIVTVTNDEAFEIARLAARLEGVPVGISSGAALAAAIKVGAREENAGKNIVVIIPSFAERYLSTALFEGLGL

SEQ ID NO: 50512 - protein, 458 aa, Pediococcus pentosaceus ATCC 25745
MKEDLPQLKRSLTSNQMQMIALGGTIGVGLFMGSSSTIKWTGPSVLLAYGFAGLILYLVMRALGEILYVNPSTGSFADYATNYIHPLAGYLTMWSNIFQFIVVGISEVVAVSQYLNYWWPNLPGWVSSVVVIATLTLANLVSTKAYGAIEFYFALIKVLTIILMIIIGVLVIFMGLGNHWRPVGLSNLWAHGGFFTGGVKGFLFALSIVVGSYQGIELLGITAGEAANPKKAIVASVKSIVWRILIFYLGAIFVIVAIFPWNQLATVGSPFVETFSKVGITGAAGIINFVVLTAAMSGTNSGIYSASRMLYKLSQEGKVPKIFGKLSSHRVPSVAILTISFGILLGIILNIFLSSFKGGAVNLFVLIYSSSVLPGMVPWFVILLSELRFRRANPEIIQNHPFVMPLYPMSNYLAIISLLLIVVFMFINPDTRASVTVGFVFLMVLTINFIIKFRRKRG

SEQ ID NO: 50513 - protein, 238 aa, Oryza sativa Japonica Group
MEESRADGRNPNQLRPFSCTRNPLDRAHGSARWAQGDTIVLAAVYGPKPGTRKGENPEKASIEVVWKPMTGQIGKQEKEYEMTLKRTLQSICLLTVHPNTTTSVILQVVGNDGSLLPCAINACCAALVFAGIPLKHLAVAIGCGVLEDGEVILDTNKAEEQQLKSFAHLVFPNSRKSASSKEPNQKEEDSERGLITSITHGVMSEEDYFSCIERGLAASSRISDFMRTTLQKQAPGDV

SEQ ID NO: 50514 - protein, 237 aa, Vitis vinifera
MENGKVAEEAGPSSGGGSGCSSASAGGKGEKQREMIQKTDDEVVGNDDCDGDDDDDDRDDGFVPGPLIPLKEQLEKDKEDESLRRWKEKLLGCLEEDFNGQMDPEVRFHSIGLVSEDLEEINAPLPVHESQKNDFLFILKEGSHYRRKLTFTVLHNIVSGLTYSNTVWKGGFQVYESKGMLGTFAPQREPYVVTLDDETTPSGVLARGTYSAKLKFQDDDRRCHMELKYSFQIKKRS

SEQ ID NO: 50515 - protein, 291 aa, Mycobacterium leprae TN
MTVPDNDPEQLRCVAESLATEAAAFVRCRRAEVFGTDLGAAGGGAVRAKSTPTDPVTVVDTETERLLRDRLAQLRPGDSILGEEGGGPADLTATPADTVTWVLDPIDGTVNFVYGIPAYAVSVAAQVDGVSVAGAVAEVVAGRVHSAASGLGAHVTDEYGVQVLRCSAVDDLSMALLGTGFAYSVVRRAAQAALLAQMLPVVRDVRRIGSAALDLCMVAAGQLDAYYEHEVQVWDCAAGALIAAEAGACVQLPKRNGPVGGAGLVVAAAPGIADALLAALQRFNGLAPILD

SEQ ID NO: 50516 - protein, 359 aa, Zea mays
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWA

SEQ ID NO: 50517 - protein, 411 aa, Saccharomyces cerevisiae YJM789
MTSATDKSIDRLVVNAKTRRRNSSVGKIDLGDTVPGFAAMPESAASKNEAKKRMKALTGDSKKDSDLLWKVWFSYREMNYRHSWLTPFFILVCVYSAYFLSGNRTESNPLHMFVAISYQVDGTDSYAKGIKDLSFVFFYMIFFTFLREFLMDVVIRPFTVYLNVTSEHRQKRMLEQMYAIFYCGVSGPFGLYIMYHSDLWLFKTKPMYRTYPDITNPFLFKIFYLGQAAFWAQQACVLVLQLEKPRKDYKELVFHHIVTLLLIWSSYVFHFTKMGLAIYITMDVSDFFLSLSKTLNYLNSVFTPFVFGLFVFFWIYLRHVVNIRILWSVLTEFRHEGNYVLNFATQQYKCWISLPIVFVLIAALQLVNLYWLFLILRILYRLIWQGIQKDERSDSDSDESAENEESKEKCE

SEQ ID NO: 50518 - protein, 308 aa, Rhodobacter sphaeroides 2.4.1
MNHFLDIHKTDTAELRQMMDSAHAMKAARKGRPKGQLDEDQPLAGRMVALIFEKPSTRTRVSFDVGVRQMGGQTMVLSGKEMQLGHGETIADTARVLSRYVDLIMIRTFEEATLLEMAEHATVPVINGLTNRTHPCQIMADVMTYEEHRGPIAGRKVVWAGDGNNVCASFLHAAGQFGFDFTFTGPSTLDPEAEFVGYAREKGRRVSIERDPAKAVAGADLVVTDTWVSMHDPQSARERRHNQLRPYQVNETLMAQAKPDALFMHCLPAHRDDEATSAVMDGPHSVIFDEAENRLHAQKAIMRWCLGL

SEQ ID NO: 50519 - protein, 359 aa, Zea mays
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWA

SEQ ID NO: 50520 - protein, 506 aa, Cryptococcus neoformans var. neoformans JEC21
MAPTFTHEFNHAGYKGKVEVPTGIFINGEWASSVDKNAKTIDVYNPTTGEVLTKIPEALEADVNKAVEVAHNAFNNSWGLSVPGFKRGEYLIKIAELMERDLDILASLEALDNGKTFGAAKGFDVIESARTFRYYGGWADKIHGKVIETSSSKLTYTLHEPVGVCGQIIPWNFPLLMFSWKIAPALAAGNTVVIKPSELTPLTAMYMTKLFNEAGLPKGVINVVVGYGQTVGNALAGHPAIDKVAFTGSTAVGRKVMEEASKSNIKKVTLELGGKSANIVFEDADFEEAVKYSAQGIFFNHGQTCCAGSRIYVQKPIYEKFVKAFKEQTSKLKVGDPFDPNTYQGPQVSQIQAERIMSYVDHGKQEGATVITGGKRCGDKGYFIEPTVFGDVTANMKIVKEEIFGPVVVVSPFETEEEALEHANDSVYGLASAVFTSNISRATRVASKLKAGTVWINCYNELHPQVPFGGFKQSGLGRELGEYALENYTEIKAVQINVGAKCAIPT

SEQ ID NO: 50521 - protein, 135 aa, Brassica napus
RPDTKFLLSSVAPLQKQKEVASHVLMGLPKNTVILPTLLSPLGKACSRMDLEAVHEILLKTGYRDDEGKENELSFQEWTQPVQEMLNIKKLGDAAFRDKDFKNAIECYSELVVMMTTVPSATVFARRSFSYLMTG

SEQ ID NO: 50522 - protein, 88 aa, Zea mays
KFIPVFFGQGVPQHNPSRVLGQKGVGDPVKFSTKKGPKTRPNFKGGLFGKPRGKPSLVGFFPKGGGGNVSCPPFRGSVFRPTPAPGAF

SEQ ID NO: 50523 - protein, 359 aa, Zea mays
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWA

SEQ ID NO: 50524 - protein, 487 aa, Bacillus subtilis subsp. subtilis str. 168
MAEIRKLKNYINGEWVESKTDQYEDVVNPATKEVLCQVPISTKEDIDYAAQTAAEAFKTWSKVAVPRRARILFNFQQLLSQHKEELAHLITIENGKNTKEALGEVGRGIENVEFAAGAPSLMMGDSLASIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSENLKRVQSLTGAKNHTIVLNDANLEDTVTNIVGAAFGSAGERCMACAVVTVEEGIADEFMAKLQEKVADIKIGNGLDDGVFLGPVIREDNKKRTLSYIEKGLEEGARLVCDGRENVSDDGYFVGPTIFDNVTTEMTIWKDEIFAPVLSVIRVKNLKEAIEIANKSEFANGACLFTSNSNAIRYFRENIDAGMLGINLGVPAPMAFFPFSGWKSSFFGTLHANGKDSVDFYTRKKVVTARYPAPDFN

SEQ ID NO: 50525 - protein, 514 aa, Francisella tularensis subsp. holarctica
MLNYKESFIGRNIKSDVLSGFVVAVALIPEAIGFSFIAGVSPTVGLYTAFILGLVTALIGGKPGMISGATGAVAVVLVSLGIKVKASLSPEMLNSLTQSGELSSYILQYILLCVIMAGVIQVIIGILRLGKLIRLVPQPAMYGFVNGLVIVIALAQIPLFKGEGIAMYVLVGVTMLIVYFLPKFTDKVPSGLVAIIVITAVVVFFKLQTKNVGDLADIFGAFPSFALPNIHLTMQSFLIVLPYAMIVALVGLIESLLTLSVLDEMDNKHGNGNQECIAQGTGNIVCGFFGGMAGCTMIGQSIINFTNGGRGRLSSLTAALLLISFVVALSGYISYIPVAVLAGIMFMVCINTFECESVNRIRYMPNSDKVVLVAVTVITVFSDLAIAVISGVIISALVFAWKSSQVHSRTHREDDNTKVYEFFGPLFFGSTSSFKSLFDVNYDPENVILDFANSRVMDISGAEAIDDITKKYLDLGKKVTLKHLSEDCRKILKNAGPYCIFEEIDPTYKLVRDV

SEQ ID NO: 50526 - protein, 563 aa, Pseudomonas syringae pv. actinidiae
MSKTDKAGKTGSYVYTMHRLSKVVPPKREILKNISLSFFPGAKIGVLGLNGSGKSTLLKIMAGVDTEFDGEARPMPELNVGYLPQEPQLDPNKTVREVVEEAVSVIKDAQARLDQVYAEYAEPDADFDKLAAEQAKLESILQASDGHNLERQLEVAADALRLPAWDAKVSVLSGGEKRRVALCRLLLSAPDMLLLDEPTNHLDADSVAWLEHFLHDFPGTVVAITHDRYFLDNVAGWILELDRGAGIPYEGNYSGWLEAKSDRLAQESKQQTAHEKAMKDELEWVRKGAKARQSKSKARLQRFEEMQSQEFQKRSETNEIYIPAGPRLGDKVIEFKNVTKGYGDRVLIDNLSFSMPKGAIVGVIGGNGAGKSTLFRMLMGKEQPDSGSIEVGETVQLACVDQSRDDLDGSKSVFQAVSDGSDVIRIGNYEIPSRTYVGRFNFKGGDQQKFVKDLSGGERGRLHLALTLKEGGNVLLLDEPSNDLDVETLRSLEEALLDFPGAAIVISHDRWFLDRVATHILAYEDDSQAIFFEGNYTEYEADRRKRLGEAAAQPHRVRHKKLA

SEQ ID NO: 50527 - protein, 441 aa, Photobacterium sp. SKA34
MSSDTGTKKMGLVGLTVLVAVNMMGSGIIMLPASLAQVGAISMLSWVVTAIGAMCIAYTFAKCGAFCKRSGGMSAYAEEAHGKSSFFISSYTYYVCLVISCVAIAVSAVGYIKPFMPWLDTPVHTFFGVCAILIITMIANFGGPKITGQISAFTVWGIILPVLGLSMIGWWWFDPQTFMSAWNPHHDTTMHSVSSGIALTLWAFLGIESAGANSDAVENPERNVPLAVLFGTGFAAVIYIASTGVIQGIIPNSELAASTAPFGLVFSHMFNPTVGNIVTLAAVIACIGSLLGWQFTNAQVSKAAADEGLFPKIFAKTNKAGAPIAGMLIMLIAELLLAVMTISPNLISQFNALLNLAVFINMVPYILSMTGLEVLLRKNMVSKKQYRLGATVGTLAVLYSIYGVYACGATAVFGGTILTLLGYIFYGFIAARDTKPTVQVN

SEQ ID NO: 50528 - protein, 695 aa, Yarrowia lipolytica CLIB122
MSYKKIGGEDLELNNINSRNYDSPEAPPNDLDDLADLDDFEHDHEDDYSVDDDRADIGEGLLGGKKSTGKQRQFRRKPKISLKLGLVIAFVIVVLIVGFVIRYLKTSKGWSSDVDSLGRRLQPWQRNTLDEYNLSKNGLWNSSSEPQTREYFWTISDIVGAPDGVQRKMTVINGKFPGPLIEANEGDRIIVHVKNEGADPTGMHFHGMFQKGTNFMDGVLGVTQCGIMPGHEFTYNFTLDGQYGTYWYHSHWDLQAIDGVAGPLVIHSPKEDEAYKHLYDEEMVLFVNDWYHEMGREYMPGYLFPNGENDEPVPQAGLIQGMGEFDCSKYTDRECQQLQKQIIPVEENKTYRIRIINAGAMSEIDFSIDQHKFDLIEVEGFSVEPYELQAARVANAQRYSFLVKTDKREIDEQFWLRTEFNPHCYAEMNDELDINVRAIFSYPSHTEKVKKLIAKGDPNYLVAHGDPQDVKWKDFDGTVECLELNTTMLTPKYNDPIPGRGDFVELHAAFHRQQGAIKRGVFNATTWNPAKEATLSQFLREKPLEMFADGPSKHWGPDQLTVTVNSTRTIDLVINNLDDGAHPFHLHGHKFWILDSGNSYFNFGRYDNIPDRGQVMRDTLQVDGYGWVLIRFVIDNPGIWAFHCHFAWHMEAGLSVQFLALPEELMEMQPPSGWNDMCKAALEEEKEGQKEGQTN

SEQ ID NO: 50529 - protein, 446 aa, Citrobacter rodentium
MISEHNSMLERYPRIQKVINSTLPALLFNSSTKYEGKITNIGGTIIKARLPNARIGAFYKIEPGQRLAEVIAINGDEVFLLPFEHVSGMYCGQWLSYQGEEFKIRVGDELLGRLVDGIGRPMGSNIATLYLPFKRSLYAEPPDPLLRQVIDQPFTLGVRAIDGLLTCGIGQRIGIFAGSGVGKSTLLGMICNGASADIIVLALIGERGREVNEFLALLPQSTLSKCVLVVTTSDRPALERMKAAFTATTIAEYFRDQGKNVLFMMDSVTRYARAARDVGLASGEPDVRGGFPPSVFSSLPKLLERAGPAPKGSITAIYTVLLESDNVNDPIGDEVRSILDGHIVLTRELAEENHFPAIDIGLSASRVMHNVVKSEHLRAAAECKKLIATYKNIELLIRIGEYTMGQDPEADKAIKNRKAIQSSLQQSTKDISSYEKTIENLFKVVA

SEQ ID NO: 50530 - protein, 358 aa, Oryza sativa Japonica Group
MAASDSDSDADAAAAAAASLLPAPIHLLPPDALHNVLLRLPLRDAVVCRPSFSPVASSPSLLYLWLESPSPSPPSLPSSSSSSSTASTAHPPKSLAVCNPFAGTYSFLPLSDLPGRATAPSSLARRRRPRAHRARRPLLHPIRIRQVDEASPLAPLQAAEPYTRSGAAAVFALCDVGTPWRSQWKLFSCPLSMLTGGWAPVERSAWGDVFEILKRPRLLAGAGGRRVLMIGGLRSSFAIDAPCSTVLILRLDLATMEWDEAGRMPPNMYRCFTGLCEAAAQGNAMPTAVAGGNNKVKVFGGDGKVWFAGKRVRGKLAMWEEDELGNSGGKWDWVDGVPGYSDGVYRGFVFDGGFTAMP

SEQ ID NO: 50531 - protein, 419 aa, Rhodopirellula baltica SH 1
MMPSRPTSSTEKNLLQTRQRIYLDHAATSWPKADGVTDAMVEFLSNVGSSASRGSYASALKASELVRSLRFKLAQFIHAESDSCISFHSGCTHALNSVIHGLVGSSKAIGDGSHLLVSAIEHNAVIRPILVAAKSGNATVEEVPADKNGLLSADDVISRVNGATRLVALSHVSNVTGAVQPITEIGAAIAEANRSRTESDQILFLCDAAQSLGYLPIDVASLGVHALTAPAHKGCGGPPGIGMLYLSPRWHSAIQPWMQGGTGHDGRSDTMPESMPAKLEPGTMNLPAIAGWLAALESMATSGELNESPNESAALSQRLHVGLNAVDGIKVFGQPGPLPIASLDFGPDLPPDDAAAILDSEFGIEVRSGHHCAARLHRHLGTEAAGTLRISGGHGTTSDQIDAVVAAVSEIAAQITSLA

SEQ ID NO: 50532 - protein, 337 aa, Glycine max
  misc_feature (323)..(323): Xaa can be any naturally occurring amino acid
MAPIKIGINGFGRIGRLVARVALQSPDVELVAVNDPFITTDYMTYMFKYDTVHGQWKHHEVKVKDSKTLLFGEKEVAVFGCRNPEEIPWAAAGAEYVVESTGVFTDKDKAAAHIKGGAKKVIISAPSKDAPMFVCGVNEKEYKSDIDIVSNASCTTNCLAPLPKVINDRFYIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYXTRVVDLIRHMHSTK

SEQ ID NO: 50533 - protein, 47 aa, Populus trichocarpa x Populus deltoides
  misc_feature (38)..(38): Xaa can be any naturally occurring amino acid
LADLEVALCLCTAIKASVLGINLNVPVALSVLVSACGXSIPPGFKCE

SEQ ID NO: 50534 - protein, 619 aa, Zea mays
MAAMHAIVHHRAPPPGRCCRGHGRSVVVRASAATVTTSIPGSAATVPDSPSAAFWDYNLLFRSQRAESPDPVVLRVTEGAIPPDFPAGTYYLAGPGMFTDDHGSTVHPLDGHGYLRSFRFDASGAAHYSARYVETAAKREEHDAGGASWRFTHRGPFSVLQGGSRVGNVKVMKNVANTSVLRWGGRVLCLWEGGEPYELDPRTLETIGPFDILGSLCGGTDEVARDASGEAAHHGRRQPWLQEAGIDVAARLLRPVLSGVYSMPAKRLLAHYKIDPKKNRLLMVACNAEDMLLPRSNFTFYEFDANFALVQKREFVLPDHLMIHDWAFTDSQYVLLGNRIRLDIPGSLLALTGTHPMIAALAVDPSRQSTPVYLLPRTPEAEAEASGRDWSVPIEAPSQMWSMHVGNAFEERNARGGINIQLHMSGCSYQWFNFHRMFGYNWLNKKLDPSFMNIAKGREWLPRLVQVSIDLDKRGTRRGCAVRRLSDQWTRPADFPAINPGFANRRSRFVYAGAASGSRRFLPYFPFDSVVKVDVSDGSARLWSVAGRKFVGEPVFVPTGSGEDDGYVLLVEYAVYDHRCHLVLLDARKIGERNAVVAKLEVPKHLTFPMGFHGFWADE

SEQ ID NO: 50535 - protein, 125 aa, Bordetella pertussis Tohama I
MTDRQLIVLAALNIMVAVGAGAFGAHGLRRVVDPTLLAIWHTGVLYHLIHALGLFVVALLGARFGSPLLSMAGLVMFIGILLFCGSLYVLVLTGTRWLGAVTPLGGVAFLAAWAMVAWAAWRAPA

SEQ ID NO: 50536 - protein, 276 aa, Ostreococcus tauri
MRPAVEAGGAEGTARASSSSSSSDDETPRDDQENEEVRNILRQPRYFDDDYEAAALRCFRCGQGGHREAECELPAKKKPCHLCGYKSHVARDCPHGLCYNCLTPGHQSRDCPYVRGSGRDAQALCCLRCGKSGHVVADCVYRFDANDLAQIHCYVCGSIGHLCCAPQDALPPGVPTCCRCGGNGHLDLACAHARRGFGGGSAPEFSCFHCGERGHIARECPKKDDGDNARPSGNLSHAPQTFHMGSVGTWRGPGGGRAGGRGGDEHWNQLAGRWRS

SEQ ID NO: 50537 - protein, 314 aa, Solanum habrochaites
MGSKYSKATNSISDASNSFESYRFPLVDLEEATNNFDDKFVIGESGFGKVYRGVLRDGTKVALKRHNRDSRESIEEFETEIEILPRRSHPHLVSLIGYCDDRNEMILIYDYMENGNLKSHLTGSDLPSMSWEQRLEICIGAARGLLYLHTNGVIHRDVKSTNILLDENFVPKITDFGLSKKGPQLYQTHVSTNVKGTFGYMDPEYVIRQKLTEKSDVYSFGVVLFEVFCARSTIDPYLRREIVTLAEWAVKSHNNGQLEQIVDPNLAAKIRPESLRKFGETAVKCLALSGKDRPSMGDVLWKLEYALCLQESVI

SEQ ID NO: 50538 - protein, 362 aa, Kluyveromyces lactis NRRL Y-1140
MPRTITYDIPSHYQLVDLVGEGAYGTVCSAIHKPTNTKVAIKKIQPFSRSMFVTRTLRELKLLKFFHSHENIISVLDIVRPTSWHKFEAVYLVQELMETDLQKIINQQNLSEDHIQYFVYQILRALKSLHSAQVIHRDLKPSNLLLNSNCDLKVCDFGLARCLASSDQSRENMVGFMTEYVATRWYRAPEIMLSFQEYTTAMDIWSCGCILAEMIMGKPLFPGKDYHHQLWIILEVLGSPTLEDFEQIKSKRAKEYISQLPMKKGIPWANVLNKEVNPLAIDLLSKMLTFNPDKRISAVEALEHPYLATYHDPDDEPDYPQLNLEDNFWKIDNEARDKNEEDDIPLELLKKMLYGEVMKPLN

SEQ ID NO: 50539 - protein, 329 aa, Shewanella sp. ANA-3
MQVSPRGTASAKLTDFLELANQNIALAKQQNIQYSPQLLRENLNKLAALMSAKPEVSYIADKAWQVKDAQHGDREIGCRVYSPAPNKALPVVLHFHGGGHMCGSVELYDPICRHLASIAQCVVISVEYRLAPEHPYPAGLEDCEYALRHYQSVLTEVQYQQGVSIMGDSAGGALCTSLSQRSLSDSTLNIAKQILVYPSVDYTMASASYQSNGAGFLLETPRVQWYFEQYFQEVAKDAERVKQASPLHGEFNAKLPSTLIFTAGCDPLRDEGIAYANALTAAGVQVQHHQFEDMIHAYMLLQDLVTEECLATYRMIAAFLAEPITATSR

SEQ ID NO: 50540 - protein, 456 aa, Arabidopsis thaliana
MDVPRPAFKCFDDDGRLKRSGTVWTASAHIITAVIGSGVLSLAWAIGQLGWIAGPTVMLLFSFVTYYSSTLLSDCYRTGDPVSGKRNYTYMDAVRSILGGFRFKICGLIQYLNLFGITVGAIKRSNCFHESGGKNPCHMSSNPYMIMFGVTEILLSQIKDFDQIWWLSIVAAIMSFTYSAIGLALGIIQVAANGVVKGSLTGISIGAVTQTQKIWRTFQALGDIAFAYSYSVVLIEIQDTVRSPPAESKTMKIATRISIAVTTTFYMLCGCMGYAAFGDKAPGNLLTGFGFYNPFWLLDVANAAIVIHLVGAYQVFAQPIFAFIEKQAAARFPDSDLVTKEYEIRIPGFRSPYKVNVFRAVYRSGFVVLTTVISMLMPFFNDVVGILGALGFWPLTVYFPVEMYIRQRKVERWSMKWVCLQMLSCGCLMITLVAGVGSIAGVMLDLKVYKPFKTTY

SEQ ID NO: 50541 - protein, 281 aa, Corynebacterium glutamicum ATCC 13032
MDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 50542 - protein, 439 aa, Haemophilus influenzae R2866
MSAKSNKIGVVQLTILTMVNMMGSGIIMLPTKLAEIGTISIVSWLVTAVGSTALAYAFAQCGMFSKKSGGMGGYAEYSFGKAGNFMANYTYGVSLIIANTAIAISAVGYGSELFGTILSPLSIALWTIFTLWLATVLNFGGARITGNISSFTIWGVIIPVVGISIIGWKWFDGSMYVNSWNPHNVPTFEAIGVSISMTLWAFLGLESACANADAVENPEKNVPIAVLGGTLGAAVIYIVSTNVIAGIVPNLELANSTAPFGLAFAHMFDETVGKVIMGLMVMSCFGSLLGWQFTIAQVFKSSAEEGYFPAFFKKITSKDAPVVGMITITALQTLLSLMTISPSLNKQFNVLVDLAVVTNVIPYLLSMAALAVLLKAENVAPQKYKTTVFVAFIGSLYSIYALYAAGEQAMLYGSIVTFIGWTLYGFVSYKFDLKKSQAN

SEQ ID NO: 50543 - protein, 567 aa, Colwellia psychrerythraea 34H
MSRAYTGALSYPQKIVIILLNKISSQHLKGDIFGGLTAAVIALPLALAFGVSSGAGAIAGVYGAIFVGFFAALFGGTATQISGPTGPMSVVMALVFTQLIGSHPDTGLVLAFTCVILAGLFQILFGLLKLGKYFVMVPYPVISGFMTGIGIIIILLQISPLLGSAGDSNALAALMNIPNALSQQNTLATVLGVITLLLMIYWPEKWTKIIPAPLFALITLTVISATFFSQQGISVIGEIPTGFPSLSMPSLSLESLSQVSYFAFLLAVLGAIDSLLTSMVADTLTETHHDSDKELIGQGIANTIAGFFGALPGAGATMRTAINIRAGGKTALSGIIHSITLLIVILWAGDYAQYIPHTVLAGMLIKVGLDIIDWRFIFQIKKVGLFSATLMLLVLLLTVFVDLITAVLVGMFIANLVTLDRLTHIQLDNITFKRGDELLSEISSNETNIALTDDIQNNLSKSLANTLLLEIDGPVSFAVSRELSRRFTENLAFTTLVIDLSNAKLIGTTTAIMITDLIDRTKSKEKTVLVITGNEKINQSLDKLSLATLLDKKYQFTNREQALQTLI

SEQ ID NO: 50544 - protein, 387 aa, Arabidopsis thaliana
MASSRVSDLPHQRGIAGEIKPKNVAGHGRQNRKVLGDIGNLVTGRDVATGKDVAKKAKQPQQQTKAEVIVISPDENEKCKPHFSRRTHIRGTKTFTATLRARSKAASGLKDAVIDIDAVDANNELAAVEYVEDIFKFYRTVEEEGGIKDYIGSQPEINEKMRSILIDWLVDVHRKFELMPETLYLTINLVDRFLSLTMVHRRELQLLGLGAMLIACKYEEIWAPEVNDFVCISDNAYNRKQVLAMEKSILGQVEWYITVPTPYVFLARYVKAAVPCDAEMEKLVFYLAELGLMQYPIVVLNRPSMLAASAVYAARQILKKTPFWTETLKHHTGYSEDEIMEHAKMLMKLRDSASESKLIAVFKKYSVSENAEVALLPSLDDFSVSCA

SEQ ID NO: 50545 - protein, 367 aa, Crocosphaera watsonii WH 8501
MGIDYPYVAEEAQPGTQVLLDDGLLELGVETVEGKAVTCKVIEGGILKSHKGVNFPSLNLRLPSMTEKDKKDLEFGISQGVDIISLSFVRQAADIQTLKAFLAERNVDIPVLAKIEKPQAIEHLEAIVDECNAIMVARGDLGVEMRPEKVPLLQKRIIRMSNQKGIPVITATQMLDSMIRNPRPTRAEASDVANAIIDGTDAVMLSGESAVGDFPVQAVNMLASIARDVEPEITFANYPPRNRDKAHALSEAINAVDQVLDLQCIVALTETGYSAKLAAAERPKVPVVALTPSIEVYHRLNLVWGVRPVLFEYDDLTLEDLVKQMDSLLLERNFVTKRDQVLILGGLPLRQARSTSFLDIHTIGEPN

SEQ ID NO: 50546 - protein, 254 aa, Sulfitobacter sp. EE-36
MQLPSFAGFDLSGKRAFVTGATSGIGLGAATALARAGAHVICAARRAGPLGKLHAAMEAEGLSCETQELDITDVDATRAAFSGLGAVDIVVNSAGMARHGPALDTTPEDFDAVMNVNLRAAYFLSTAAADQMIAAGRPGSIIHVSSQMGHVGGIDRGVYCASKHALEGMVKAMAIEWGPKAVRINTLCPTFIRTPLGEQTLSDPTRLAWIEEKIKLGRVGEIEDIMGPIVYLASDASAMVTGTALMVDGGWTAE

SEQ ID NO: 50547 - protein, 200 aa, Crocosphaera watsonii WH 8501
MIEKPQFFYVHRNSLANKKMQSQQLIKISRFLSYHLRHAPEKLGLELEPGGWISTEKLLKACQNTKFTLTFSDLETVVKDNDKQRFSFNEAKTKIRANQGHSVNIDLQLEPLIPPVILYHGTHQKVVKTILKEGLKKMARHHVHLSERKETALKVGSRRGKPVIFVIKAQQMSEDGCIFYCSDNGVWLVDYIDPKYLTIK

SEQ ID NO: 50548 - protein, 358 aa, Zea mays
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAW

SEQ ID NO: 50549 - protein, 342 aa, Pfiesteria piscicida
MPVGIGINGFGRIGRLVFRAASANADVSIKAVNDPFMDLKYMVYQLKYDSVHNRFQGTIATKTDGDKEFLVVNGVEVQVFHEKDPASIPWGSSGAEYICESTGVFTQKEKAELHIKGGAKKVIISAPPKDAVPIYVMGVNHKDYKASDTVVSNASCTTNCLAPLTKVVHDKFGIIEGLMTTVHATTATQLTVDGPSRGGKDWRGGRCASQNIIPSSTGAAKAVGKVLPALNGKLTGMAFRVPTPDVSVVDLTCRLEKGAKYDEIVAAVKEYAAGDMKGVLDWTDEEVVSTDFVTCKASSVFDVGAGISLNDNFVKLVTWYDNEWGYSNRLVELAVYMKSIDG

SEQ ID NO: 50550 - protein, 375 aa, Aspergillus oryzae
MSREAHVKATLIASIEAFLTESGFTSTGKAFAKEQASKSVSKSLSDSKNAPSLLEIFQNWADNEKATEKSSESSSSESSSSSSSSEESSSSSDESSDSDVEMNDAPKAQSKKQSKNSSSSSSSSSSSSSSSSGSDSDADDESEEETAAPAPAKPQGTKRKAESDSSSSESESDSDKAPQNKKTKIAAKKESSSSDSSASSDSSSSESSSSASDSSDSSSDSNSDSDSSDSDSSDSSSSSSDSDEEDGKENKTSSSSQSSSGSETVQNSDSGVQKSTNISTPVTGSSSASPAPRNGPAQKKHTGARPTPLALLSEQPTDHLLSNDYVPYAYADRAFKDLSVTRGKGFTKEKNKKKRGSYRGGPIDISGGKSFKFED

SEQ ID NO: 50551 - protein, 171 aa, Pringlea antiscorbutica
KLWPNAKYVSSIMTGSMLPYLKKLRHYAGGLPLVSADYGSTESWIGVNVDPHFPPEDVSFAVIPTFSYFEFIPLYRQQNQQDICSDGDFVEEKPVPLSQVKLGQEYELVLTTFTGLYRYRLGDVVEVTGFHKGTPKLSFIYRRKLILTINIDKNTEKDLQRVVDKASQLLS

SEQ ID NO: 50552 - protein, 372 aa, Crocosphaera watsonii WH 8501
MSIPSQPQPLSIPPRLLLGPGPSNANPRILAAMSLPAIGHLDPFYLQMMDEIQTLLRYVWQTENELTISISGTGSAGMEASLANVVEPGDVVLIGVMGYFGNRLVDMATRYGADVRKINKPWGENFSLAELKEALETHKPAILALVNAETSTGVRQPLEGVGELCREHNCLLLVDAVTSLGGVPFYADQWGVDLAYSCSQKGLGCPPGLSPFTMSDRAWEKLQKRTTPVSNWYLDMNLLNQYWGEPRKYHHTAPCNMNYGLREALSLIVEEGIENSWQRHQQNAELLWEGLEKIGLVCHVEKQFRLPTLTTVRIPEGVNGKAVSSYLLQEYNIEIGGGLGELAGKVWRIGLMGYNSRPENVLLLLEALRKVL

SEQ ID NO: 50553 - protein, 339 aa, Frankia sp. CcI3
MGIMTITVGINGFGRIGRSYFRALLTSGADIRVAAVNDLTSAQSLADLLKYDSVYGPLPQQVAAEGSSLRVGDTVVEVLSERDPAQLPWRRLGVDVVIESTGVFNDAAKARAHIDAGASKVVVSAAAKNADLTLVIGINDDLYDPQKHTVVSNASCTTNCLAPMARVLDDGLGIECGTMTTIHAYTQDQNLQDGPHPDPRRARAANLSTIPTTTNAASAIGLVLPNLKGKLDGYSVRVPVPVGSLTDLTVRVDRETTVEEVNSLFRKAADGELARILRYTADPVVSADIVKDPASCIFDSLLTQVIEGRHVHIFGWYDNEWGFSNRLIDTTQLVGGATA

SEQ ID NO: 50554 - protein, 223 aa, Arabidopsis thaliana
MATSSTQLLLSSSSLFHSQITKKPFLLPATKIGVWRPKKSLSLSCRPSASVSAASSAVDVNESVTSEKPTKTLPFRIGHGFDLHRLEPGYPLIIGGIDIPHDRGCEAHSDVDAILGALGLPDIGQIFPDSDPKWKEAASSVFIKEAVRLMDEAGYEIGNLDATLILQRPKISPHKETIRSNLSKLLGADPSVVNLKAKTHEKVDSLGENRSVAAHTVILLMKK

SEQ ID NO: 50555 - protein, 358 aa, Zea mays
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAW

SEQ ID NO: 50556 - protein, 363 aa, Mycobacterium avium subsp. paratuberculosis K-10
MLQRIGAPRPYARSRPITITDVELAPPGRDEVLVRIEAAGICHSDLSVVDGNRVRPVPMLLGHEAAGIVERVGPGVADLAVGARVVLVFLPRCGRCAACATEGLTPCEPGSAANGAGTLLGGDIRLSRAGRPVYHHLGVSGFATHAVVNRASAVEVPPDVPAEVAALLGCAVLTGGGAVFNVGRPAPGQTVAVVGLGGVGMAALLTALTYDGVPVVAVDQLPEKLAAARRLGAHQAYTPQQAVEARVKAAVVIEAVGHPAALQTAIDLTAPGGRTITVGLPPPDARITLSPLGFVAEGRSLIGSYLGSAVPSRDIPRFVELWRAGRLPVESLVSSTIRLEDINEAMDHLADGTAVRQLIRFDA

SEQ ID NO: 50557 - protein, 445 aa, Bacillus subtilis subsp. subtilis str. 168
MEQQVKDDIQRVFQLQKKQQKALRASTAEQRREKLQRFLDSVIAHEEEIIEAIRKDVRKPYHEVKKAEIEGTKKAIRDNMNNLEQWMAPKEVGSSLSPDANGILMYEPKGVTLILGPWNYPFMLTMAPLAASLAAGNSAIVKLSDFTMNTSNIAAKVIRDAFNEKEVAIFEGEVEVATELLDQPFDHIFFTGSTNVGKIVMTAAAKHLASVTLELGGKSPTIIDSEYDLMDAAKKIAVGKFVNAGQTCIAPDYLFIKKDVQDRFAGILQTVVNAGFMEDDHTPDRSKFTQIVNDRNFNRVKDLFDDAIERGAEVVFGGVFDASDRTISPTVLKNVTPDMKIMQEEIFASILPMMNYEDIDEVIDYVNDRDKPLALYVFSKNQDLIDNVLQHTTSGNAAINDVVVHFSDVNLPFGGVNTSGIGSYHGVYGFKEFSHEKGVFIQAAE

SEQ ID NO: 50558 - protein, 142 aa, Erwinia chrysanthemi
STCWSAWCRSSTWSGFRSWCAISTSAVTPANVMDSVVRSMEDYITHITPQFSRTHINFQRVPTVDTSNPFAAKAIPSMDESFVVIHFQGLDHIDYPYLLAMLQGSFISHINTLVVPGGKMGLAMELIMMPLVQRLIEGNHID

SEQ ID NO: 50559 - protein, 429 aa, Aspergillus oryzae
MTGGSQNGSREPNERDALIGDTIRANSGLVPRHKRRPWAYWPVRVVHLTWATLVRDYVNLLLVFVPFGIIAGALGWDSTAVFTLNFLAIVPLASLLSFATEELAAAMGQALGGLMNATFGNAVELIVSIIALKDGQIRVVQASMLGSILSNILLVLGCCFFVGGIRYSEQSFNTTVASTMSSLMTVASASLIIPATLYASLSSTGDEKTRTENILILSHGTAIILLILYVMYLYFQLKSHASFFEEATPDPENSGDDVAEEEEEHILSPWAACVVLVVVTILVAVCADYLVGSIDPIVEKTGMSRTFIGLILIPIVGNAAEHVTAVVVAWKGKMDLAIGVAIGSSLQIALFVTPFLVILGWILDVDMTLHFHIFETVAFFISGLVVTFLIQDGKSNYLEGGLCLGMYVILALAFYVYPDQATDDALFHI

SEQ ID NO: 50560 - protein, 668 aa, Ipomoea trifida
MGVPALQVLPGELSCRFFRRCSSTVASNSLLLLKDHLKVKGKNSRVKCFKDLGTITSSSKLCAVRDFYGLEKPNLLRCYCQPAERGNERIFEDEQGRSVHSIAPNGQTSDAAQQFKNDNGTVPSSKTVNNALPKSSTNSIEEEAWNLLRASMVYYCGNPIGTIAANDPSDSSILNYDQVFIRDFIPSGIAFLLKGEYDIVRNFLLHTLQLQPVLLCINTLPSKQSWEKTMDCYSPGQGLMPASFKVRTVPLDNDENATEDVLDPDFGEAAIGRVAPVDSGLWWIILLRAYGKCSGDLSLLERIDVQTGMKMILKLCLADGFDMFPTLLVTDGSCMIDRRMGIHGHPLEIQALFYSALLCAREMLAPEEASIDLITALNNRLLALSFHIREYYWIDVKKLNEIYRYKTEEYSYEAINKFNIYPDQIPPWLVEWMPSKGGYLIGNLQPAHMDFRFFSLGNLWSIVSSLATTDQSHAILDLIETKWEDLVANMPLKICYPALEGQEWRIITGGDPKNTPWSYHNAGSWPTLLWQGSPFSMLIVKVSLVEQKIEDSASKFDAILAVACVKMKRPEIAENAIKVAERRIAGDKWPEYYDTKRGGFIGKQARLFQTWSIAGYLVAKLLVANPEAAKMLITIEDTELLSAFSSILSSNPRRKRSRKGAVKQSYIV

SEQ ID NO: 50561 - protein, 233 aa, Oryza sativa Indica Group
MDMDSWERLAADARLQDALIGMEEAEGSEGEEEAAEVACPFCDEEFDGFGLCCHIEDEHQAENRAGVYKLIHEVFLSCFHYRVVKVCPICYDAVGMDLVSHITSEHPSFFKGKWRNRRVSHGSHSSTRATLKKDAAYLQYRYGGSTRAASHNTDPDPLLSSFVGNFTNTDLPKDVQQEFRDETDEKSDSLVQKEQKPVESADEPLLPEVKEERTRRSQFVQGLVLSLMFDDIL

SEQ ID NO: 50562 - protein, 116 aa, Triticum aestivum
  misc_feature (52)..(52): Xaa can be any naturally occurring amino acid
MASEQTFIMIKPDGVQRGLIGEVISRFEKKGFYLKGLKLQNVEKSFAEQHYXKIIGATNPLASEPGTIRGDFAVDIGRNVIHGSDSVESARKEIALWFPEGIAEWRSSQHNWIYEA

SEQ ID NO: 50563 - protein, 368 aa, Ostreococcus tauri
MRGDGRAMGDAGLAGAYEVGAATLHEYLRARAADAVEASTSAREAEDCENEAAIVRALARTCAKIGRFVRRAGLTDVKAYVEGKNGAVNVHGEEQAALDDAAHEMCVEALREEGSSAWIASEESEDVVAANPRGRIAVVFDPLDGSSNIECGVGVGTIFGLVGVDENSAAASVYARPGNDMRSVGYVMYGASTILVLSFMSTGAVCAFTYDESLDAFVLTKANIRIPTSGNVYSVNQANYRKWDDVMRAYIDECSKEKKSLRYIGSMVADVHRTLLYGGTFHYPADASNPNGKLRAVYECFPMSAIIERAGGLAISAADTRVLDFVPTSAHERMPIHVGSPADIERLSQMYRESPGGAAAVRSTFSPL

SEQ ID NO: 50564 - protein, 440 aa, Silicibacter pomeroyi DSS-3
MSHVFPRHCHAQLPIAVGGEGCYLIDSTGKRYFDASGGAAVSCLGHSNDRVKQAIKDQVDRLAFAHTGFFTSDPAEELADLLIANAPEGIERVYFVSGGSEAVEAAIKLARQYYLEVGQPERRHLIARRQSYHGNTLGALAAGGNAWRRAQFDPLLIGVSHIAPCYEYAERAAGESLVDYGRRAADELEAEILRLGPDTVMGFIAEPVVGATLGAVAAVEGYFSRIREICDTYGVLLILDEVMCGMGRTGHLFACTGEGVRPDIVTIAKGLGAGYQPVGAMLCSGAIYDAVASGSGFFQHGHTYIGHPVATAAGLAVVQEMLEHDLPARVQALGGAMEAALRSRLDQHPHVGDIRGRGLFWGVELVADRAGKTPFDPGLGLAGKLKRAAFARGLICYPMPGTRDGRNGDHVLLAPPFIMEEADATLIAERLTAAMGDVLP

SEQ ID NO: 50565 - protein, 461 aa, Magnetospirillum magnetotacticum MS-1
MMSLSLFRMPLPRALAWAALIIGAAIVVIDPLPGTEGRVLGLAVAFIGLWATAVIPEPMTAVFFFTTAMLLKAAPAGTVFGGFSSAALWLIFGGLIMGIAFRSTGLGERLGARLSHAFGSSYWGVISGVTLVGLALGFLMPSSMGRAIMLMPIAVGLAERYGFAPGTNGRIGVVLAAAFGCHVPTFSILPANLPNLVLVGAAETLWHYTPHYGEYFLLHFPILGFLKTAIMIPLIVWLWPDTPQPEAATRPLGPMKRQEGQLALLLACALVLWATDFLHHVSPAWISMAAGALLLLPGIGLVDRKAFNEQINYGSMFYVAAIMGLGAIVDQSGLGARLAHAVLDVLPLSPGHAATNFASLSVLSTLVSLLTTLPGAPAVLTPMAGQMAEASGMSVEAVLMSQVLGFSNPIMPYQSAPMVVAMQLGGERLGPAQTLCLWLAGITILVLLPLDFLWWRLLGWI

SEQ ID NO: 50566 - protein, 588 aa, Geobacillus stearothermophilus
MRKEAIYHRPADNFAYAYDSETLHLRLRTKKDDIDRVELLHGDPYDWQNGAWQFQMMPMRKTGSDELFDYWFAEVKPPYRRLRYGFVLYSGEEKLVYTEKGFYFEVPTDDTAYYFCFPFLHRVDLFEAPDWVKDTVWYQIFPERFANGNPSISPEGSRPWGSEDPTPTSFFGGDLQGIIDHLDYLVDLGITGIYLTPIFRSPSNHKYDTADYFEVDPHFGDKETLKTLIDRCHEKGIRVMLDAVFNHCGYEFAPFQDVWKNGESSKYKDWFHIHEFPLQTEPRPNYDTFAFVPQMPKLNTANPEVKRYLLDVATYWIREFDIDGWRLDVANEIDHEFWREFRQEVKALKPDVYILGEIWHDAMPWLRGDQFDAVMNYPFTDGVLRFFAKEEISARQFANQMMHVLHSYPNNVNEAAFNLLGSHDTSRILTVCGGDIRKVKLLFLFQLTFTGSPCIYYGDEIGMTGGNDPECRKCMVWDPMQQNKELHQHVKQLIALRKQYRSLRRGEISFLHADDEMNYLIYKKTDGDETVLVIINRSDQKADIPIPLDARGTWLVNLLTGERFAAEAETLCTSLPPYGFVLYAIEHW

SEQ ID NO: 50567 - protein, 366 aa, Hyphomonas neptunium ATCC 15444
MKTQAAVAYTGQPGFKYETVEIEAPRADEILVRVLGVGLCHTDLVFSSGAAPYPFPAVLGHEGSGVVEAVGADVKKVKPGDSVLITFRSCGACDRCAAGDAAYCRTMPMLNYMGRRTDGTSALSNDAGPVSSNFFGQSSFAGHAITYERNVVKVDAGLPVEIMGPLGCGIQTGAGAVMRSLAAKKGSSLLVTGGGSVGLSAVMGGKIQGCATIILVEPMESRRALAMELGATHCIDPTAVEDVAAAVRAIAPMGIDNALDTTGIPAVQSSALATLGSKGTLGLVGVSAPGTPMPGDVNTVMTFGQSVKGIIEGDSNPDEFIPELIEHYKAGRLPFDRLVKTYRLSEINEAIAAQHHGDCVKAVLIP

SEQ ID NO: 50568 - protein, 97 aa, Schizosaccharomyces pombe 972h-
MSLCIKLLHETQGHIVTMELENGSTYRGKLIEAEDNMNCQMRDISVTARDGRVSHLDQVYIRGSHIRFLIVPDMLRNAPMFKVGPGRSVPLPTRGRR

SEQ ID NO: 50569 - protein, 226 aa, Mycoplasma sp.
RSTRTRCAFEVAAADLGASCTYIGPAGSNFGKKESIEDTAQVLGRFYDGIEFRGFKQSDVDALVKYSGVPVWNGLTDAEHPTQMLADYMTIKEFKGDLKGKKIVFAGDIKNNVARSIMIGAAFTGMNCVLCGPKEQAKIVKTGKGYKEVYEKCLELFKRNGGSITFEDDKIKAAKDADAIYTDVWVSLGEDFSLFEPRIKELGAFQVDMKMIKAAKEDVIFLHCLP

SEQ ID NO: 50570 - protein, 575 aa, Escherichia coli K12
MISGILASPGIAFGKALLLKEDEIVIDRKKISADQVDQEVERFLSGRAKASAQLETIKTKAGETFGEEKEAIFEGHIMLLEDEELEQEIIALIKDKHMTADAAAHEVIEGQASALEELDDEYLKERAADVRDIGKRLLRNILGLKIIDLSAIQDEVILVAADLTPSETAQLNLKKVLGFITDAGGRTSHTSIMARSLELPAIVGTGSVTSQVKNDDYLILDAVNNQVYVNPTNEVIDKMRAVQEQVASEKAELAKLKDLPAITLDGHQVEVCANIGTVRDVEGAERNGAEGVGLYRTEFLFMDRDALPTEEEQFAAYKAVAEACGSQAVIVRTMDIGGDKELPYMNFPKEENPFLGWRAIRIAMDRREILRDQLRAILRASAFGKLRIMFPMIISVEEVRALRKEIEIYKQELRDEGKAFDESIEIGVMVETPAAATIARHLAKEVDFFSIGTNDLTQYTLAVDRGNDMISHLYQPMSPSVLNLIKQVIDASHAEGKWTGMCGELAGDERATLLLLGMGLDEFSMSAISIPRIKKIIRNTNFEDAKVLAEQALAQPTTDELMTLVNKFIEEKTIC

SEQ ID NO: 50571 - protein, 285 aa, Bacillus subtilis subsp. subtilis str. 168
MKVGYLGPAATFTHLAVSSCFQNGAEHVAYRTIPECIDAAVAGEVDFAFVPLENALEGSVNLTIDYLIHEQPLPIVGEMTLPIHQHLLVHPSRENAWKELDKIYSHSHAIAQCHKFLHRHFPSVPYEYANSTGAAAKFVSDHPELNIGVIANDMAASTYELKIVKRDIQDYRDNHTRFVILSPDENISFEVNSKLSSRPKTTLMVMLPQDDQSGALHRVLSAFSWRNLNLSKIESRPTKTGLGHYFFIIDIEKAFDDVLIPGAMQELEALGCKVRLLGAYQSYQL

SEQ ID NO: 50572 - protein, 588 aa, Geobacillus stearothermophilus
MRKEAIYHRPADNFAYAYDSETLHLRLRTKKDDIDRVELLHGDPYDWQNGAWQFQMMPMRKTGSDELFDYWFAEVKPPYRRLRYGFVLYSGEEKLVYTEKGFYFEVPTDDTAYYFCFPFLHRVDLFEAPDWVKDTVWYQIFPERFANGNPSISPEGSRPWGSEDPTPTSFFGGDLQGIIDHLDYLVDLGITGIYLTPIFRSPSNHKYDTADYFEVDPHFGDKETLKTLIDRCHEKGIRVMLDAVFNHCGYEFAPFQDVWKNGESSKYKDWFHIHEFPLQTEPRPNYDTFAFVPQMPKLNTANPEVKRYLLDVATYWIREFDIDGWRLDVANEIDHEFWREFRQEVKALKPDVYILGQIWHDAMPWLRGDQFDAVMNYPFTDGVLRFFAKEEISARQFANQMMHVLHSYPNNVNEAAFNLLGSHDTSRILTVCGGDIRKVKLLFLFQLTFTGSPCIYYGDEIGMTGGNDPECRKCMVWDPMQQNKELHQHVKQLIALRKQYRSLRRGEISFLHADDEMNYLIYKKTDGDETVLVIINRSDQKADIPIPLDARGTWLVNLLTGERFAAEAETLCTSLPPYGFVLYAIEHW

SEQ ID NO: 50573 - protein, 216 aa, Oryza sativa Japonica Group
MTMTMSNEQGKPEANVRGGRRSGHRVHARHLPGLPTLAAAPARTNGSSWAPGKTEHCTAQHKRRLQAVRDKPQQASVMASEGAVSPAFAYTVVYVKDVAKSAAFYSAAFGYTVRRLDQSHKWAELESGTTTIAFTPLHQRETDALTGAVQLPDSAGERGPVEICFDYADVDAAYRRAVDSGAVPVSPPEQKSWGQKVGYVRDIDGIIVRMGSHVRA

SEQ ID NO: 50574 - protein, 409 aa, Carboxydothermus hydrogenoformans Z-2901
MVSLEEVKKASEILGKIAHKTPLVYNTTLSEMTGNHIYLKMENLQRTGSFKLRGAYYKIASLSENEKKRGVVASSAGNHAQGVALAATLYGIRSTIVMPRHAPLSKIKATSQYGAKVVLHGNVYDEAYEEAKRIQLETKATFIHPFNDPQVIAGQGTIALEILEDLPDVEVVVVPIGGGGLIAGIAVAIKNLRPKVHVIGVQAKNMPSMAESLARGQLTNISGHPTIADGIAVRNPGDLTFEIVKHYVDDIVTVDEDEIASAILFLMERAKTVAEGAGAVSVAAVLNRLSHYKKSKIVALISGGNIDVNLLSRIINRGLVKDGRKIFLNTVIPDKPGTLSQLLQIIASTGANVLSVIHNREAINVPLGSAQVELELETAEPEQVEEIQSLLKQHHYFVNISPTLTSLDV

SEQ ID NO: 50575 - protein, 478 aa, Streptomyces avermitilis MA-4680
MRRAKIVCTLGPATDSYDQIKALVEAGMDVARFNLSHGTYAEHEERYQHVRKASDETGRSVGVLGDLQGPKIRLGRFNEGPVLLERGDTFTITVEEGVEGDRQTCGTTYAGLAADVTPGERILVDDGKVCLEVTSVDGPRVHTTVVEGGMVSDHKGLNLPGVAVSVPALSDKDEADLRWALRQGFDVIALSFVRSGKDIKDVHRIMDEEGRRLPVIAKVEKPQAVENIDDIVAAFDGIMVARGDLGVEMPLEQVPIVQKRAIKLARRNAKPVIVATQMLDSMIDNSRPTRAEASDVANAVIDGTDAVMLSGETSVGKYPVETVRTMSRIVEAAEEDILATGLPPLTERNKPRTQGGAVARAAAEMGDFLGAKFLVAFTQSGDTVRRLSRYRSPIPLLAFTPMPATRSQLNLTWGVETFLGPHVDSTDAMVDQVDELLLKYGRCEKGDVVVITAGSPPGVSGSTNLVRVHHIGEDDSPK

SEQ ID NO: 50576 - protein, 303 aa, Escherichia coli K12
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 50577 - protein, 342 aa, Crocosphaera watsonii WH 8501
MTTQPPQNLDNHPETFIDVNSSLSLSPMGCGTWAWGNRLLWGYEQTMDQDLQQVFNLAVSRGVTLFDTGDSYGTGKLKGRSETLLGEFTKAYQGPNQDKICLATKLAAYPWRWTRQSMVNAGKASAQRLGRNIDLVQMHWPTANYFSWQEWPLLDGLGDLYEQGLVKGVGLSNYGPQRIKQIIKRFTERNIPIATLQIQYSLLSTYPVTELGVKEVCDELGIKLIAYSPLALGLLTGKYQENGQVPKGFRGIVFKQMLPKIRPLLQGLEEIAKFREKTMAQVAINWCICKGFIPIPGAKTCQQMEQNLGAMGWRLSDGEVMELDNLTQKVDKQMVQNPFQTK

SEQ ID NO: 50578 - protein, 180 aa, Triticum aestivum
MITPTYLGDTIEYSSYASNALGALPYGRPAGGRTSDFERPPGQVSGINAERARGDNSCKQLDNSVVGIRSTISKLSQLLKRHDEELWRHLEVVTKVNPQFYAFRWITLLLTLEFKFRDCIHLWDALLGDPEGPQATLLRICCAMLILVRRRLLAGDFTANLKLLQNYPPTNIDHLLHIAN

SEQ ID NO: 50579 - protein, 358 aa, Zea mays
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAW

SEQ ID NO: 50580 - protein, 173 aa, Brassica napus
GDVLFDPHSGENYERDEDHLALMMELLGVMPRMIALGGRYSRDYFNRQGELRHIRRLRFWPLSKVLMEKYEFSEEDAVAMQDFITPILEFAPEKRPTAAQCLTHPWLNPVPRSLKSLPSPQKPKEEDSTDENKAKEKDEREAMEVGVGNIAIDGSEEKVSARAGRQSARDLRT

SEQ ID NO: 50581 - protein, 303 aa, Ipomoea trifida
KLCRLFTILDSCYAIYRFYVAEVLLALEYLHMLGVVYRDLKPENILVREDGHIMLSDFDLSLRCAVNPKLLKSSSPVGQPPKKMSSPCSDSSCIEPFCLHPSWQVSCFTPRFLSAAAKTRKLKADIAAQVTPLPQLVVEPTSARSNSFVGTHEYLAPEIIKGEGHGSAVDWWTFGIFMYELLYGRTPFKGTTNEDTLGNVVSQCLKFPETPMISSHARDLIRRLLQKEPENRLGSSKGATEIKNHSFFEGLNWALIRCATPPEMPRIFDLGNLISDTNSQKKQGGKCQKEGTSGEENIEFEMF

SEQ ID NO: 50582 - protein, 979 aa, Arabidopsis thaliana
MQTIIISPLVSHRLCLARAVPCNRLLNNHHRAPPSIRLSNHRSTTSLRLFSSAGSLCVCKSDAEYFAKAAASRDSEMATEDVQDPRIAKIASSIRVIPDFPKPGIMFQDITTLLLDTEAFKDTIALFVDRYKDKGISVVAGVEARGFIFGPPIALAIGAKFVPMRKPKKLPGKVISEEYSLEYGTDTIEMHVGAVEPGERAIIIDDLIATGGTLAAAIRLLERVGVKIVECACVIELPELKGKEKLGETSLFVLLTTLLQEENLKLKSFPIKSLFMAAAILVSPEKEEKMLCACSGEQFRFEDQPGSPESLATRDFSASGLSSRNGGGDWDSKLEDIQVDEAESTLKEALSLNYEEARALLGRLEYQRGNFDAALQVFKGIDIKVLTPRIIKAIVEKTLPCKPRSKAVIVPPTTMSMHSVSLLLEAILLKARSLEELGSYKEAAEECKIILDVVENALPSGMPDGISGFAKLQDIFQKALELLPLLWKKAGNHHETIASYRRALSRPWNLDPQRLAVTQKSLALVLLYGSVEACPKDNIEEAIVLLMLLVKKMVVGDIQWDPELMDHLTYALSMTGQFEVLANYLEQTLPGVYTRGERWYLLSLCYSAAGIDKAAINLLKMALGPSESRQIPHIPLLLFGAKLCSKDPKHSRDGINFAHRLLDLGNSQSEHLLSQAHKFLGVCYGNAARSSKLDSERVFLQKKSLFSLNEAAKRGKADPELDVIFNLSVENAVQRNVQAALDGAVEYSSMVGGVSTKGWKHLAIVLSAEKRLKDAESILDFTMEEAGDIEKIELLRLKAVLQMAQEQPKKAMKTCSSLLGLIRAQEKSEQSEKFETEAWQDLASVYGKLGSWSDAETCLEKARSMCYYSPRGWNETGLCLEAKSLHEEALISFFLSLSIEPDHVPSIVSIAEVMMKSGDESLPTAKSFLMNALRLDPRNHDAWMKLGHVAKKQGLSQQAAEFYQAAYELELSAPVQSFI

SEQ ID NO: 50583 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCSYYTKSFRGSVDPFHVDAVDTTGAGDSFVGALLCKIVDDRAVLEDEARLREVLRFANACGAITTTKKGAIPALPTESEVQSLLKGN

SEQ ID NO: 50584 - protein, 313 aa, Ostreococcus tauri
  misc_feature (1)..(1): Xaa can be any naturally occurring amino acid
XLRRAIERDRGRDGGESLDPSPDRALWVVWITRAKERLTRTFTSTQAPAVRRRCVAVNAGTGKFIVGGNWKCNGTAASVKDLVKALNAGKIDADVDVYVAPPFVFIPRVQAELNSEKYAIAAQNCWVSEGGAFTGEVSAEMLVDANIPWVILGHSERRALCGETSEFVGEKVKYALSKGLKVALCIGETLDQRESGKTMDVCYAQLKAVNDVITAADWDNVVIAYEPVWAIGTGKVATPDQAQDVHAGIRKWCASNISPEVASKIRIQYGGSVNASNCDELATKEDIDGFLVGGASLIGDAFVTICNSAKNSK

SEQ ID NO: 50585 - protein, 230 aa, Ostreococcus tauri
MLSASLSKSAFTPRASALQKSVKGKNFSRSAVRVEARKPLVGYPAPEFSAEAVFDQEFQDIKLSDYRGKYVVLFFYPLDFTFVCPTEITAFSDRYEEFAKLNTEVLGVSVDSKFSHLAWLQTDRNDGGLGDLAYPLVSDLKREICESYDVLYEDGTALRGLYIIDREGVIQHYTCNNAPFGRNVDECLRVLQAIQYVQNNPDEVCPAGWTPGAATMKPDPKGSKEYFKAI

SEQ ID NO: 50586 - protein, 348 aa, Frankia sp. CcI3
MSCALPVLGPWTVPVSTDPTKVSAMPVTKAVIPAAGLGTRFLPATKAVPKEMLPVVDRPAIEYVVEEASRAGLRDVLLVTSRTKKAIEDHFDREADIEAALERKGDDLRLRRVRVSAELAEVHSVRQQSPRGLGHAVLCAAAHVGNEPFAVLLGDDLIDERDLLLEEMLAVQRRFGGSVIALMEVPEDQVSLYGVATVESVGTSAGTGSADDRYGIVRIRDLVEKPPVAQAPSNLAIIGRYILSPTIFDVLRRTEPGRGGEIQLTDALRILALRAVEPAGAAGDAGTDTAAEPVHGVIFTGRRYDTGDRVDYLKAVIRLACERADLGPELYPWIEEYVASGGPKAALS

SEQ ID NO: 50587 - protein, 729 aa, Salmonella enterica subsp. enterica serovar Typhi str. CT18
MLYKGDTLYLDWLEDGIAELVFDAPGSVNKLDTATVASLGQALEVLEKQHDLKGLLLRSNKAAFIVGADITEFLSLFLVPEEQLSQWLHFANSVFNRLEDLPVPTLAAVNGYALGGGCECVLATDYRLATPDLRIGLPETKLGIMPGFGGSVRLPRMLGADSALEIIAAGKDVGAEHALKIGLVDGVVKQEKLIEGAIAVLRQAITGDLDWRAKRQPKLEPLKLSKIEAAMSFTIAKGMVAQTAGKHYPAPMTAVKTIEAAARFGREEALNLENKSFVPLAHTNEARALVGIFLNDQYVKGKAKKLTKDIETPKQAAVLGAGIMGGGIAYQSAWKGVPVIMKDINDKSLNLGMTEAAKLLNKQLERGKIDGLKLAGVISTIHPTLDYAGFDRVDVVVEAVVENPKVKKAVLAETEQKVRPETVLASNTSTIPIGELASALERPENFCGMHFFNPVHRMPLVEIIRGEKSSDETIAKVVAWASKMGKTPIVVNNCPGFFVNRVLFPYFAGFSQLLRDGADFRKVDKVMEKQFGWPMGPAYLLDVVGIDTAHHAQAVMAAGFPQRMQKEYRDAIDALFDASRFGQKNGLGFWRYKEDSKGKPKKEEDAAVDDLLASVSQTKRDFSDDEIIARMMIPMINEVVRCLEEGIIASPAEADMALVYGLGFPPFHGGAFRWLDTQGSAKYLDMAQQYQHLGPLYEVPEGLRDKTRHNEPYYPPVEPARPVGSLKTA

SEQ ID NO: 50588 - protein, 325 aa, Mesorhizobium loti MAFF303099
MSKAIRIHAHGGPEVLTYEDADPGQPGSGQILVRHTAIGLNFIDVYHRSGLYPPPGGFPLIPGSEAAGVVREVGEGVDWLKPGDRIAYSTNVGAYAEQRVIAAGLVVKIPDGISDEQAAAMMLKGMTAEYLLRRTFKVKAGDTILFHAAAGGVGLILGQWAKHLGATVIGTASSTDKIELAKAHGFDHVINYREQDFVAGVAAITGGKKCDVVYDSVGNDTFPASLDCLKPLGMFVSFGQSSGPIPPFSMSLLAQKGSLFATRPTLFVYNAKREDLDASAAALFDVVLSGAVKIQINQRYALKDAGKAHADLEGRRTTGTTILIP

SEQ ID NO: 50589 - protein, 623 aa, Rhodopirellula baltica SH 1
MVKNWNCRYKEPNTNLRSFDRRKSHRIFDSMSTDASETNAAPTDAPAKPIKLSPVEKIKQESGFLKGSIDVELADPVDHFDNANIQLLKFHGTYQQDDRDKRAELKKSGGGKAYSMMIRCRIPGGRLSSDQLVAHLDMCDELGDSTLKITTRQTLQLHGILKGDLRETIRRINEVELSTLAACGDVNRNIMCCPAKRVGGIHAQLNEFTDELTEALAPQTPAYHELWLTDPDTGEKTLAGGGEPEASSAPVIDEPLYGPTYLPRKFKVGIALPDDNCIDIYTQDLGFLAVIRDGQIIGYNVSVGGGMGRTPSAKKTFPALAKRMAFVTPEQAIDVAKAVIIVQRDNGNRSDRKVARLKYLIADWGIEKFRAEVEKVFGGPLADCTEDDVHEFDDHMGWQEQGDGKLSYGLNIENGRLYDNEQVQVKAAIRAVCARFNREIRLTSHQSMIFCDIDPSEKEELIEILKSHGLRTTEETSTVRRWSIACVALPTCGLAITESERRLPSIIDSIEEPLAKLGLSNERFTIRMTGCPNGCARPYNADLALVGRAVGKYTLFAGGGWLGNRLAYIYKDQVKDEDVTAELTGIFAAFKANREEGESLGTFCDRVGAEKLAELAEAAPLPA

SEQ ID NO: 50590 - protein, 347 aa, Physcomitrella patens
MASWKSVSTVLAKEPIGIRSAPAELIKGTSSVKFSYPAKKARFQRARVEAVTDQTARQAAVRTSQYTGKERVDILAEALPFIQRFQGKTVVVKYGGAAMKDESLKDGVIKDLVLLSCVGMKCVLVHGGGPEINQWLGKLGIEPHFKNGLRVTDAATMEVVEMVLVGKVNKSLVSLINKAGGCAVGMCGKDGKLIKARPLSDDLGFVGEITAVDTSVVKGILNSGHLPVIATVAADNDGQAYNINADTAAGEIAASLGAEKLILMTDVQGLMLDHKDSSTLVPEVNIKGVRKLIEDGIVTGGMIPKVECCVKSLAQGVHSTHIIDGRAPHSLLLEILTDEGAGTMITG

SEQ ID NO: 50591 - protein, 271 aa, Bordetella pertussis Tohama I
MHADTAQDAPDAAARYPRADSVADFEHNLAAVRARMAAACQRAGRDPAGVRLLPVSKTVDEARIRMSYAAGCRELGENKVQEAYRKWEAMADLADLRWSVIGHLQTNKAKLVARFAAEFQALDSVRLAEALERRLQAEGRALDVYVQVNTSGEASKYGLHPDEAAAFIRQLPSYGALRVRGLMTLAVLSADAARVRQCFVLLRTLRDRLRQEAPAGVSLDELSMGMSGDYEIAIEEGATVVRVGQAIYGARALPNDYYWPDSGAADRAEDE

SEQ ID NO: 50592 - protein, 282 aa, Pseudomonas syringae pv. syringae B728a
MTAPSLLIAGCGDIGSRLATRLLPHGWTVHGLRRTVSELPAGVHGVAGDLFETQKPAQWPAAALDYVVYCATPSQRDEAGYRMAYVEGLRNVLSWLEQTGQRPKRLIFVSSSGVYGQQNGEWVDETSATEPGNYTGTVMLEAEQVALNSGLPATAVRLTGIYGPGRSDLSNRVRQGHSVRIDPPVYANRIHADDAAGLLEHLLLADQRGVALESCYLGVDDDPAALADVVAWIREYLGVTEWSEEVSVQRVGSKRCSNARARALGWAPMYPDFRAGYAALLG

SEQ ID NO: 50593 - protein, 254 aa, Pichia finlandica
MSYNFHNKVAVVTGALSGIGLSVAKKFLQLGAKVTISDVSGEKKYHETVVALKAQNLNTDNLHYVQADSSKEEDNKKLISETLATFGGLDIVCANAGIGKFAPTHETPFDVWKKVIAVNLNGVFLLDKLAINYWLEKSKPGVIVNMGSVHSFVAAPGLAHYGAAKGGVKLLTQTLALEYASHGIRVNSVNPGYISTPLIDEVPKERLDKLVSLHPIGRLGRPEEVADAVAFLCSQEATFINGVSLPVDGGYTAQ

SEQ ID NO: 50594 - protein, 398 aa, Corynebacterium glutamicum ATCC 13032
MDLFEYQARDLFETHGVPVLKGIVASTPEAARKAAEEIGGLTVVKAQVKVGGRGKAGGVRVAPTSAQAFDAADAILGMDIKGHTVNQVMVAQGADIAEEYYFSILLDRANRSYLAMCSVEGGMEIEILAKEKPEALAKVEVDPLTGIDEDKAREIVTAAGFETEVAEKVIPVLIKIWQVYYEEEATLVEVNPLVLTDDGDVIALDGKITLDDNADFRHDNRGALAESAGGLDILELKAKKNDLNYVKLDGSVGIIGNGAGLVMSTLDIVAAAGERHGGQRPANFLDIGGGASAESMAAGLDVILGDSQVRSVFVNVFGGITACDVVAKGIVGALDVLGDQATKPLVVRLDGNNVVEGRRILAEYNHPLVTVVEGMDAAADHAAHLANLAQHGQFATAN

SEQ ID NO: 50595 - protein, 385 aa, Streptococcus pyogenes M1 GAS
MKITVVGIGYVGLSIGLLLAKEHDVTFFDIDNKKIDLINKRQSPLKEAAINKLLCKAKNINATSSEELAYKDATFIILSLPTNLKFNKLDTSIIEISVSNILKINKKATIVIKSTVPIGFTEYLRNRFHYNDIIFSPEFLREGSTIHDQLYPSRTIVGNESRNSQLFLDILTDISVEKDSPSLLVGSSEAEAIKLFSNAYLAQKIAFFNELDTFAEMQNLDSKKIIEAMGYDQRIGNSHNNPSFGFGGYCLPKDIKQLEYHFKEIPAPIITSISESNLLRKIHIAKMILNSSAKTIGIYRINSKKDSDNCRESSTIDVAKLLKSSGKDVIIFEPLINQKKFLGCPLSNDFNEFIKYSDIIVANRIDDALRKCNSKVFTRDIFQYD

SEQ ID NO: 50596 - protein, 694 aa, Oryza sativa Japonica Group
MGSSSVVLWWEEWQLRILVLGSLFLQCFLAFAAVHRRRSIPASLRFFIWLAYLGSDALAIYALATLFNRHKTDNQGGSHVLATLVSPQGKGGGDDTGLEVFWAPVLLLHLAGPDSITSYNIEDNELWRRHVLTVISQVTVSLYVFCKSWSGENKLLRAAVLLFIAGTLKCIDKPMALKSASIYGLVTSSPFHDQKSQNNDQGENRSLEAYIQEAKGYFSNLKINDVYTELVAAAQNKDLRVMPFWLFVDLASTLCHRLRVLRFFLVLDNKSADSLLQTALCGSFVRLYTKKSMLLSYFWAKDKRNALISTYSHLNRLLAVCLTISAVALFHQSHKQGYNNSDVKVTYTLLWCTAALEVYALFGPKYKFFTWCKNVAQYNLVGFFARDQTPTRLLKLASCFWCKDYVDQHWYVNQCSSSFAITELVIEQVKAGWKNYIEDTSTYWMFNDRRGQLTIQHELCDEELCKSLDVPFDESIIVWHIATDICFYEGAPAANHHHLKAATRCREISNYMLYLLVVNPDILMSGTRANILSNTCKELRSMFEDEKPPSDESDLTREIHRRAQSSNVDAAATEELIPRASKLASQLLAMDGDKRWKVMQGVWVEMLCFSASRCRGYLHAKSLGQGGEYLSYVWLLLWYMGLESVAERQQRSDFRSHVERVASRQLPCTETESSQEPRFKRRKEQLCHCFRRET

SEQ ID NO: 50597 - protein, 585 aa, Kluyveromyces lactis NRRL Y-1140
MSFQLFAKTNSTVEVFQGYPSFEEISSSKSGNDGTEGKVIQSLLSPCGRFMAKSYESKVVLLIGETWEITLVELPLKNVYDLKFSPSGNFLSTWERPLVDDTEHLNCKIWNLNESPLSTEPKYSYKASTQSSWTLQFSKLDDYAIKSFGKELRIIKLSGEDTFKFDKPFATLTPDQPFTTYQISPAEHPTICTFTKEKSGKPAQLTIWPITTGKITKQIVTKQFFKADSCHLKWSDLGNAILCLTTTDFDHSNKSYYGENNLYLLSFQGVNGALGGESVRVSLGKEGPIHDFNWSPTSRQFGVIYGFMPATITFFDLKGNAIHSLNEQRKNTLEFSPNGKYILVGGFGNLQGSVDILDRHDKFRCISKFSATNTSVCKWSPGGEFILTATTSPRLRVDNGLKIWHYSGTLVFVKEYKELLKVDWRTNCPFRIIKDGYVTNGNKLKDEELKQDPKIRKHQLEIHPVVTQFNLKNPNKSSTNLGAKKTTGAYKPPHARKATVVPGTTKTRAPQSTPTPPLQQSAASQTSPEEKKIRSLLKKLRAIESLKVKQTEGVKLENTQVTKIQSEPKILKELELLGWKGELDS

SEQ ID NO: 50598 - protein, 386 aa, Corynebacterium glutamicum ATCC 13032
MSLMKPSTRSNVQPFRVMQMLDRVHRRRREGKDTLMFCAGQPSTGAPEAVIEEAEIALRSGPLGYTEVIGDREFRERIADWHSATYDVDTNPDNVIVTTGSSGGFVASFIATLDHGDYVAMPTPGYPAYRNILESLGAKVLNLRCTAETRFQPTAQMLEELPHKPKAVIVTSPGNPTGTIIDPEELERIAKWCDDNDAVLISDEDYHGMSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 50599 - protein, 371 aa, Pisum sativum
MGFLLPTLFLSLLLLFSSHQTKAHQLNNFNTTITTKTTTISNSSNERKLAGTCNLFRGKWVYDASYPLYDPSSCPFIDPQFNCQKYGRPDTQYQKYRWQPLTCSLPRFNALDFLAKYRGKKIMFVGDSLSLNQFNSLACMIHSWVPKTRTSFSKQSAISTITFQDYDLQLFLYRTPYLVDLDRENVGNVLKLDSIKSGDAWRGMDVLIFNTWHWWTHTGNAQPWDYIQEGGKLYKDMNRFIAFYKGLTTWARWVNINVNPTQTKVFFLGISPVHYEGRDWNQPAKSCMRETQPFFGLKYPAGTPMAWVIVNKVLNRLKKPVYFLDVTTLSQYRKDAHPEGYSGVMSTDCSHWCLPGLPDTWNVLLHAALFG

SEQ ID NO: 50600 - protein, 334 aa, Crocosphaera watsonii WH 8501
MNPLSVAPMMDYTDRHFRYLMRQITRHTLLYTEMIVSAAIKHGDRPKLLDFSPEEKPLSLQLGGDNPQELAECAIIAEDWGYDEINLNVGCPSDRVQSGHFGACLMAKPELVAQCVQKMQQGVNIPVTVKQRIGIDDQDSYEEMARFVAIVAEAGCQRFTIHARKAWLKGLSPKENRNIPPLRYQDVYRLKQDFPHLLIEINGGITNLEQVDNHLKIVDAVMIGRAAYDNPYLFATVDRDIYQEDIIPATRHEIIEKMLPYIDHWVSRGHKLHRISRHLLAMFAGIPGTKAWKRYISENAHLPGADSQVIIEALKRVQRLRDADPVGKTDGFLQ

SEQ ID NO: 50601 - protein, 549 aa, Haemophilus influenzae 86-028NP
MKNINPTHTQAWKSLEAHKAELSNTTIQDLFKQEKNRFDDYSLTFNNQILVDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFRTTPIEKNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQSHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 50602 - protein, 413 aa, Physcomitrella patens subsp. patens
MCALAPSKLGCGITQSSALVKKGTSTGAQGKRPLVVRAAAANADAIEKKYKITVLPGDGIGPEIIGVAVDVLRLVGSQEGFGFEFTEKLVGGAAIDELGTPLPEDTLSTCQQSDAVLLAAIGGYKWDKNPRDMKPETGLLALRSGLGVFANLRPAVVLPQLVDSSTLKREVAEGVDIMVVRELTGGLYFGQPRGFKETNGERVGYNTMVYSASEIDRIARIGFETARKRRGKLCSVDKANVLEVSQLWRERVTAMASVYPDVELSHMYVDNAAMQLIRNPKQFDTIVTGNIFGDIISDEASMLTGSIGMLPSASIGESGPGLYEPIHGSAPDIAGQDKANPLAQILSAAMLLRYALGEENAAQRIEAAVMGALDKGFRTGDIMSPGMEYVGCKKMGDIVLETLEASRPATVLH

SEQ ID NO: 50603 - protein, 371 aa, Pisum sativum
MGFLLPTLFLSLLLLFSSHQTKAHQLNNFNTTITTKTTTISNSSNERKLAGTCNLFRGKWVYDASYPLYDPSSCPFIDPQFNCQKYGRPDTQYQKYRWQPLTCSLPRFNALDFLAKYRGKKIMFVGDSLSLNQFNSLACMIHSWVPKTRTSFSKQSAISTITFQDYGLQLFLYRTPYLVDLDRENVGNVLKLDSIKSGDAWRGMDVLIFNTWHWWTHTGNAQPWDYIQEGGKLYKDMNRFIAFYKGLTTWARWVNINVNPTQTKVFFLGISPVHYEGRDWNQPAKSCMRETQPFFGLKYPAGTPMAWVIVNKVLNRLKKPVHFLDVTTLSQYRKDAHPEGYSGVMSTDCSHWCLPGLPDTWNVLLHAALFG

SEQ ID NO: 50604 - protein, 131 aa, Triticum aestivum
  misc_feature (3)..(3): Xaa can be any naturally occurring amino acid
IPXVSRRSLGIISGLSGAGGNFGAGLTQLLFFTSSKYGTGRGLEYMGIMIMACTLPVALVHFPQWGSMLLPPNANATEEDFYAAEWTEEEKKKGLHIPGQKFAENSRSERGRRNVILATASTPPNNTPQHA

SEQ ID NO: 50605 - protein, 358 aa, Zea mays
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKDHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKAIVVECVLPVNTEATPKAQGVFHVDMIMLAHNPGGKERYEREFRELAKGAGFSGFKATYIYANAW

SEQ ID NO: 50606 - protein, 204 aa, Pisum sativum
FLPDSKHVTASEDDNWILGCLLLLASSVFWSCWMIMQVPISSSCPDHVLSTFWMCLFATIQSAMFALLKEPDLQAWILPSPLQISCSLYAGIGIAVSFFIQSWCISERGPLYCAMFNPLATVITALVAATFLEEKLYVGSLVGAIGVTVGLYIVLWGKAKDFDGTKQELPQSNMVDDERSNRTDLEEPLLAEKSEYVAEIKMEG

SEQ ID NO: 50607 - protein, 204 aa, Pisum sativum
FLPDSKHVTASEDDNWILGCLLLLASSVFWSCWMIMQVPISSSCPDHVLSTFWMCLFATIQSAIFALLKEPDLQAWILPSPLQISCSLYAGIGIAVSFFIQSWCISERGPLYCAMFNPLATVITALVAATFLEEKLYVGSLVGAIGVTVGLYIVLWGKAKDFDGTKQELPQSNMVDDERSNRTDLEEPLLAEKSEYVAEIKMEG

SEQ ID NO: 50608 - protein, 304 aa, Cyanidium caldarium
MNNKSIRTQILIEALPYIQQFRGAIFVIKYGGAAMKDLISKERLIADIVFLSCIGLKLVCVHGGGPEINFWLNKMNVESKFHDGIRITDELTMQVVEMVLAGKINKELVSLLNNKGVKGVGLCGKDGTILTARKAQCGSIDMGLVGEIKSVDPYLILTLLKENYIPVIASVGADETGKTYNINADFVAGEIAASLGAEKLILVTNTSGILADVSQPESLIRDTNIMQLRQLLSRGIISKGMIPKVNCSIRSLAQGVRAVHIIDGTKPHSLLLEVLTNNGIGTRFLYKQSILLQLNCFSFSNVSI

SEQ ID NO: 50609 - protein, 428 aa, Arabidopsis thaliana
MTMTTTISHLPTELLDEIISRVPLKSTRAVRLTCKNWDSLFKNRSFMKEEAAAKEGESRMIVLMDKNLFAMSIFFNGIDIDPSAEQRGKLTCLYDDSEQVKISQVFHCEGLLLCVLEDDKCSLVVWNPYWGQTRWIEPRYFSRIQNCYGRYMYVYALGYNNKSRSHKILRFIDGAFDFPFWYEIYDFDSDLWTTLDVTPQWFINFPPRGCYNRGVTLKGNTYWCAIRRKSNTNWFVDLDHIICFDFTSERFGPLMPLPFVRYTSGSLVTLSCVREEKLAVLFCNNATVEVWITTKIETDKISWSKFLTVNMYVDLLEGSFFIDEVKKVAMIFDIPMNRETVYIVGEAGNVKELHLGQPVDVDKHFSPLFVCSYVPSLVQIKQPPGCQRKQESSLEKRRCDDENISRLIAHEETYVVYGRYVPSRKKPR

SEQ ID NO: 50610 - protein, 116 aa, Brassica napus
MASSAPQGSIDPLTGKDPAKALTAVASGFFENVKKNKQSFFQFAAMTGILLLSFRSVSQKYRIHDLEEDTAVLKKESDTLTDRMSRIKSELLHQASIDSSGVFAARLRLLFGEDKK

SEQ ID NO: 50611 - protein, 359 aa, Vitis vinifera
MDKLKLASLGERLKTGGAQMGRMVSGKVKEILQTPTQESKMVDEATSESLSDPNWGMNLRICAMINSEEFSGAEIVRAIKKKISSKNVVSQRLSLDLLEVCSMNCEKVFSEVASEKLLDDMVRMIDNPQTDHTNKERALQLIQAWGESEDLAYLPVFRQTYMSVKRSGTPPPVQDGSSPPIPYSLESYVHQQPLSPPGSYPIPDAGLHRADSTAFSYNYGILSMKEKKEFLLITRNSLELLSSILDSQTEPKPIKDDLTVSMVEKCKQSQPVVQRIVESTINDEGMLFEALYLHDELQQVISKYEEMEAKSTAQLPENPNTAGGNSAEPVELNEAKTAESPKGESGEASNEASNDQKSI

SEQ ID NO: 50612 - protein, 1135 aa, Zea mays
MSSHDAKLVQNLVLNLASSVESRAVNIRTFLEEAFRHLGDEHYLLNALLAIRKEVDLMEQDAIESKARSDPKKDRMEEQINLAQDAKPVPRQITFTPHPHQNCMTPVTMTPTTPTGPLGIAFGTCNNECLTTTQTILIDHLLPAPIQGPNDPSGYTFRTPWNPYFGMTTPGGPPTQTCFGQPQLVPPIPCPPVPTHVPNQTDPIPFESEAEHSVQEVNSPSKPSDTPGTFRRTKEQNFKPDEDLLLCKTWLEISSDPVISTGQRKEGLWARIEKRYNELRAEFPLRLNRALSSRWEKIRAETGKFAGFYARVLSENQSGLTDNDKTSKAATLYATSQKKPFHFMHCWTRLKNEPKWDAMVHGSPWRGNAGTEPVRSLTPTGSVNEVHTDEGGSKGKRPLGRDSMKASRKKSMSSSSQSTDYLSRIHDIQIARLKQSEEKSNLKQQNIEFMKEVELKKLEVQSKEIEVQEKKLMMEDRKQKVEELNKLFAMDMDALPEELRAPLIADLSSIVARFRRPRGANEVDISCTISFVLDIHVVHNNASSHHLCEPPQITALPPHGTSDAKAKRQTGSSETPRAGRGTPLRSVSHCPPITPPALSRPLPRARSDPPPMATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRTENDKNVLSETGGIPIGIGKNSHIRKAIIDKNARIGENVKVSVFLPAARGLSHPTAAARGFPLPAAAADQPPTSSRRRPPTPQPPAPPPLLPPPPLFPIAGSAPPPALLPPWTPAASPTRPPPLRRPLARAPPPLSLPARAASPTRPPPLRRPLARAPPPLSLPARTRPPLLLLARARPPPRLERAWPQEPPAWPPP

SEQ ID NO: 50613 - protein, 501 aa, Thermotoga maritima MSB8
MVLVVDYGSQYSRLITRRIRENEVYSEVVFPDDKVDLSKVDAVILSGGPRSVYEEDAPKLPEWFQEYKGPVLAICYGMQLIVKELGGEVRRGRGEYGRTLVELSRDPIFEGIPEKVHVWMSHGDEVVRLPEGFHPIAVSETGVIAAATDGKRFWLLQFHPEVHHTEYGDRMISNFLFNVCKLEKNWKIGDLVEEKIRHIKETIGNKKAILALSGGVDSSVAAVLVHRAIGKNLVCVFVDHGLLRKNEREEVERVFKEHFDMNLVVVDARKRFLEKLRGVTDPEKKRKIIGEEFIRVFEEEAKKHDVEFLVQGTIYSDVIESAASGKTTAKIKSHHNVGGLPEKMNLKLVEPLRDLFKDEVRKVGKYLGIPDRIINRHPFPGPGLAVRVLGEVTEEKLEILREADYIFIETLRKHDYYDKVWQAFAVLLPIKSVGVKGDARAYEYVVALRAVNSVEGMTADWSRIPHDILDEAARRITREVKGVGRVVYDITSKPPATIEWE

SEQ ID NO: 50614 - protein, 493 aa, Mentha x piperita
MAALLVFFSVSLILLAVLFHKRKSSLSSRKRPPPSPLRLPVIGHFHLIGALSHRSFTSLSKRYGEVMLLHFGSAPVLVASSAAAAREIMKNQDVIFASRPRLSIFDRLMYSGKGVAFAPYGEHWRNARSMCMLQLLSAKRVQSFGGIREEETSAMIEKIRRSKPTTVVNLSEMFMALTNGVIHRAVLGRKGDGGDDFNRILIKVIKLLGSFNVGDYVPWLSWINRINGVDAEVEKVGTKLDGSMEGILRKYRRKKVGDDETNFVDTLLQFQRESKDTDPVEDDVIKALIFDMVSAGTDTTFAALEWTMAELIKNPRTLKTLQNEVREVSRNKGGITEDDVDKMPYLKAVSKEILRLHPPFAILLPRELTQDANMLGYDIPRGTVVLVNNWAISRDPSLWENPEEFRPERFLETSIDYKGLHFEMLPFGSGRRGCPGSTFAMALYELALSKLVNEFDFRLGNGDRAEDLDMTEAPGFVVHKKSPLLVLATPRQS

SEQ ID NO: 50615 - protein, 779 aa, Persea americana
  misc_feature (260)..(260): Xaa can be any naturally occurring amino acid
  misc_feature (370)..(370): Xaa can be any naturally occurring amino acid
  misc_feature (377)..(377): Xaa can be any naturally occurring amino acid
  misc_feature (379)..(379): Xaa can be any naturally occurring amino acid
  misc_feature (652)..(652): Xaa can be any naturally occurring amino acid
MTVTPKISINDGNLVVHGKTILTGVPDNIVLTPRTGDGLVAGCFIGATASESESIHVFPMGTLEGLRFTCCFRFKLWWMTQRMGMCGKDVPLETQFMLIESKDGAAAIDDDEEEAPTIYTVFLPLLEGQFRAVLQGNESNQIEICLESGDCAVRTNQGMYLVYMHAGTNPFQVINQAVKAVEKHLYSFQHLEKKKIPSFLDWFGWCTWDAFFTDVTDEGVEEGLKSLSGGGTPPRFLIIDDGWQQIGSEETKDDSNCVVXEGAQFASRLTGIKENDKFQKNGKSEHVPGLKLVVDDAKQHHNVKFVYVWHALAGYWGGVKPPAAGMEHYDTALAYPVQSPGVMGNQPDIVMDSLSVHGLGLVHPRKVFNXYNELHAXLXSCGVNGVKVDVQNIIETLGAGHGGRVSLTRSYIQALEGSIARNFPDNGCIACMCHNTDSIYSAKQTAVVRASDDFYPRDPASHTIHVSSVANNSLFLGEFMQPDWDMFHSLHPAAEYHGAARAVGGCPIYVSDKPGHHNFELLKKLVLPDGSVLRARLPGRPTRDSLFVDPARDGVSLLKIWNMNKCLGVVGVFNCQGAGWCKITKKTRIHDAAPGTLSGSIRAHDVEFINQLAGQDWNGEVIVFTYGSGEVVRLPKCASIPVTLEVLEYELXHICPVKEITSNISFAPIGLLDMFNSGGAVEQFDVRMDSNNAEPPLFDGKVASKLSSSLSNNQSPSATVVLRVRGCGRFGAYSSQRPLKCTVDLVETEFNYDSVTGLVTLIIPVPDQEMYKWSVEFQL

SEQ ID NO: 50616 - protein, 251 aa, Salmonella enterica subsp. enterica serovar Typhi str. CT18
MVEDSQETTHFGFQTVAKEQKADMVAHVFHSVASKYDVMNDLMSFGIHRLWKRFTIDCSGVRRGQTVLDLAGGTGDLTAKFSRMVGETGKVILADINDSMLKMGREKLRNIGVIGNVEYVQANAEALPFPDNTFDCITISFGLRNVTEKEKALRSMFRVLKPGGRLLVLEFSKPIIEPLSKAYDAYSFHILPRIGSMVANDADSYRYLAESIRMHPDQDTLKAMMQDAGFESVDYYNLTAGVVALHRGYKF

SEQ ID NO: 50617 - protein, 165 aa, Thermotoga maritima MSB8
MKVVQGDYRGEGLKIAVVVPRFNDLVTSKLLEGALDGLKRHGVSDENITVVRIPGSMEAIYTLKRLLDLGVHDAIIVLGAVIRGETYHFNVVANEIGKAVAQFNMTSDIPIVFGVLTTDTLEQALNRAGAKSGNKGFEAAMVAIEMANLRKRLRRDVFESDSNGR

SEQ ID NO: 50618 - protein, 178 aa, Bacteroides fragilis NCTC 9343
MIMSKEKLIKSIREVPDFPIPGILFYDVTTLFKDSERLQELSDIMYEMYKDKGITKVVGIESRGFIMGPILATRLGAGFIPIRKPGKLPAETMEESYDKEYGKDTVQIHKDALNENDVVLLHDDLLATGGTMKAACNLVKKLHPKKVYVNFIIELKELNGKQVFENDQDVDIQSVLSL

SEQ ID NO: 50619 - protein, 188 aa, Bacillus cereus
SDGGRDVGPQTAKGYIDAANEVIKETGVGQFATVSGRYYSMDRDKRWDRVEKCYSAMVNGEGSTYKSAEECVEDSYANGIYDEFVLPSVIVNEDNTPVATINDDDAVIFYNFRPDRAIQIARVFTNEDFREFDRGEKVPHIPEFVCMTHFSETVNGYVAFKPMNLDNTLGEVVAQAGLKQLRIAATIG

SEQ ID NO: 50620 - protein, 463 aa, Mesorhizobium loti MAFF303099
MAGYDYDLFVIGGGSGGVRAARVAATLGKRVGIAEEYRFGGTCVIRGCVPKKLYVYASQFPEHFADAAGYGWTVPEASFNWQTLVANKDREISRLEAIYKKNVEGAGGETFPSRAMIVDPHVVHLLDDDRTVTADQILIATGGRPAAHPALPGHEHCIFSNEAFDLKELPKAIMIEGGGYIAVEFANIFHGLGVDTTLVYRGKEILSRFDMDLRRTLHETMEKKGIKILCHAVSERVHKRPDGRLDALLTSGQTLTVDQVMLAIGRIPNTENMGLEGIGLEMTQAGAIKVDEYSRTNIDNIWAIGDVTNRVQLTPVAIHEAMCFVETAFKGNPTAPDHDTIATAVFSQPEIGTVGLSEDEAVKRFADVEIYRASFRPMRHTLSGRDEKMLIKLVVDGASRKVLGAHILGPDAGEMAQLLGIPLKAGLSKDDFDRTMAVHPTAAEELVTMYKPTYRVKDGQRVQ

SEQ ID NO: 50621 - protein, 243 aa, Mesorhizobium loti MAFF303099
MDARQLKVEAARAALAHVSDGMRLGIGTGTTAEEFVRLLADKVATGMTVIGVPTSERTAALCRELGVPLSTLEETPELDLTVDGADEVDPELTLIKGGGGALLREKIVAAASQRMIVIADRSKMVETLGRFPLPIEVNQFGLRATEIAIAKTAADLGLSGPITLRMTGGQAFVTDGGHFILDASFGRIPDTRALSNALHAIPGVVEHGLFIGLASTAIIAGGDGIQTVHAARKPGSSTNHDVA

SEQ ID NO: 50622 - protein, 318 aa, Neurospora crassa
MEKAFRPHFFNHGKPDIRSFATHAQLPISIVNREDDAFLNPNFRFIDHSIIGKNVPVADQSFRVGCSCASDEECMYSTCQCLDEMAPDSDEEADPYTRKKRFAYYSQGAKKGLLRDRVLQSQEPIYECHQGCACSKDCPNRVVERGRTVPLQIFRTKDRGWGVKCPVNIKRGQFVDRYLGEIITSEEADRRRAESTIARRKDVYLFALDKFSDPDSLDPLLAGQPLEVDGEYMSGPTRFINHSCDPNMAIFARVGDHADKHIHDLALFAIKDIPKGTELTFDYVNGLTGLESDAHDPSKISEMTKCLCGTAKCRGYLW

SEQ ID NO: 50623 - protein, 175 aa, Mycobacterium sp. MCS
MTSPIQTATATLHTNRGDIKIALFGNHAPKTVSNFVGLAQGTKDYKGENASGSTSGPFYDGAVFHRVIDGFMIQGGDPTGTGRGGPGYQFADEFHPELQFDKPYLLAMANAGPGTNGSQFFITVGKTPHLNRRHTIFGEVVDPESQKVVDAIATTATDRNDRPTDPVVIESVTIS

SEQ ID NO: 50624 - protein, 388 aa, Phormidium lapideum
MKLAARVESVSPSMTLIIDAKAKAMKAEGIDVCSFSAGEPDFNTPKHIVEAAKAALEQGKTRYGPAAGEPRLREAIAQKLQRDNGLCYGADNILVTNGGKQSIFNLMLAMIEPGDEVIIPAPFWVSYPEMVKLAEGTPVILPTTVETQFKVSPEQIRQAITPKTKLLVFNTPSNPTGMVYTPDEVRAIAQVAVEAGLWVLSDEIYEKILYDDAQHLSIGAASPEAYERSVVCSGFAKTYAMTGWRVGFLAGPVPLVKAATKIQGHSTSNVCTFAQYGAIAAYENSQDCVQEMLAAFAERRRYMLDALNAMPGLECPKPDGAFYMFPSIAKTGRSSLDFCSELLDQHQVATVPGAAFGADDCIRLSYATDLDTIKRGMERLEKFLHGIL

SEQ ID NO: 50625 - protein, 134 aa, Physcomitrella patens subsp. patens
QYHVLAVDDSRIDQRVIEKLLKTSSYKVTTVNSALRALELLGLSDSSPSSIKVPLLQKLDINLIMTDYCMPEMTGYDLLKRVKADTSALKEIPVVVMSSENDSNRIERCLAEGAEEFIIKPVQMADVKRLRGHI

SEQ ID NO: 50626 - protein, 180 aa, Pseudomonas aeruginosa PAO1
MTIRSYQGKTPLLGERVFVDPSAVLVGDIEIGADSSVWPLVVIRGDMHRIRIGQRSSIQDGSVLHITHAGPFNPDGFPLSIGDEVTVGHKVLLHGCSIGNRVLVGMGSIVMDGAVIEDEVILGAGSLVPPGKVLESGFLYVGSPAKKARPLSDKERGFFAYTAGNYVKLKDLHIAEDYHA

SEQ ID NO: 50627 - protein, 125 aa, Carboxydothermus hydrogenoformans Z-2901
MMYSEKVMDHFTNPRNVGEIPDADGVGEVGNPSCGDIMRIYIKVDGDKITDVKFKTFGCGAAIATSSMVTEMVKGKTIEEAMKITNKAVADALDGLPPQKMHCSNLAADALKVAIEDYLKKKGQK

SEQ ID NO: 50628 - protein, 455 aa, Bacillus subtilis subsp. subtilis str. 168
MHILVVGVDYKSAPIEIREKVSFQPNELAEAMVQLKEEKSILENIIVSTCNRTEIYAVVDQLHTGRYYIKKFLADWFQLSKEELSPFLTFYESDAAVEHLFRVACGLDSMVIGETQILGQVRDSFKTAQQEKTIGTIFNELFKQAVTVGKRTHAETDIGSNAVSVSYAAVELAKKIFGNLSSKHILILGAGKMGELAAENLHGQGIGKVTVINRTYLKAKELADRFSGEARSLNQLESALAEADILISSTGASEFVVSKEMMENANKLRKGRPLFMVDIAVPRDLDPALNDLEGVFLYDIDDLEGIVEANMKERRETAEKVELLIEETIVEFKQWMNTLGVVPVISALREKALAIQSETMDSIERKLPHLSTREKKLLNKHTKSIINQMLRDPILKVKELAADADSEEKLALFMQIFDIEEAAGRQMMKTVESSQKVHSFKKAESKAGFSPLVSE

SEQ ID NO: 50629 - protein, 177 aa, Arabidopsis thaliana
MKPTSKSIQRVGRFLKKTLGSIKSTICSSDYKNLPNDTPLLSPYSCSRRCPEDSQTQTKESYTVICCDTAVADTTHQKSLNNQHKKKPKKVAEPFEDAKKRGDALAQKMKDLNMVDLRDVDHALDVREALRCYSSIRSPVYLDIVDNFFTDMYYEFSDPRTSAKINGSRRKAGSFRL

SEQ ID NO: 50630 - protein, 359 aa, Zea mays
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDARFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWG

SEQ ID NO: 50631 - protein, 187 aa, Bacillus subtilis subsp. subtilis str. 168
MSLIGKEVLPFEAKAFKNGEFIDVTNEDLKGQWSVFCFYPADFSFVCPTELEDLQEQYAALKELGVEVYSVSTDTHFVHKGWHDSSEKISKITYAMIGDPSQTISRNFDVLDEETGLADRGTFIIDPDGVIQTVEINAGGIGRDASNLVNKVKAAQYVRQNPGEVCPAKWEEGGETLTPSLDLVGKI

SEQ ID NO: 50632 - protein, 540 aa, Frankia sp. CcI3
MTVSARDAAGGSAGRTAPPATVPSVTTRATTTPPATTTPPTTTPPTTTPVAARSTPAAPTTGPRSAPTDAANPATILARQRQRESAARTYARTLPIVPVRASGTMVLGADGRRYLDCLAGAGTLALGHNHPVVTEAITSMLARGAPLHTLDLATPEKDAFTDELRGCLPAGMGSDVKLHFCGPSGADAVEAAIKLAQTVTGNQTILAFTGGYHGMTAGALAVTGNVAVKDPLPPSTSVVRLPFPFPYRCPFGVGSGRAPGPDGAELSARYIERLLDDPAGGVVRPAALIVEPVQGEGGVVPAPDGWLRAIREITRRRGIPLILDEVQTGVGRTGKYWAAQHSGITPDIIVMSKAIGGGLPLAVIAYRSELDTWAPGAHTGTFRGNQLAMAAGHATLRLVREDRLDERAARLGTRLLTGLAEIARNRPQVGDVRGRGLMLGAEMVDPTAAPDLVGAHPADARLAGLVRAECLRRGLIIELGGRHGAVVRLLPPLILSDEEGDRVLAILADAIDAAVRRLSVHAALGHPPADQAHVRFGSAG

SEQ ID NO: 50633 - protein, 388 aa, Thermotoga maritima MSB8
MEELREAFEEGKPVILIDRNRENEADFVFPAQLITEDVVSFFVTYGKGLFCVTADEEDLLKRGFVKLSSNYGANYFVPVDWGTGTGISALERAETCRKLAEGRYFHEFRYPGHVTVIGGIGFQRRKGHTEASLEISELAGFSRHAVIVEILDEKGNSHNLDYVLKLSEKFSLPVLEMDDVWREFVKRKLLMKKKAEATLPTDFGVFKVVSFENHLDGKEHFAIVKEPLEDPVAVRIHSECVTGDVLSSLRCDCGSQLANFLRYMSAHGGILIYLRQEGRGIGLSNKIAAYSLQDKGLDTVEANRVLGFSEDERDYAPAAQILKALGIERVLLFTNNQRKTVGLEKYGIEVVETKRLYGRVTPHNRFYLSTKMKKLGHELEEIFREVNS

SEQ ID NO: 50634 - protein, 148 aa, Triticum aestivum
  misc_feature (86)..(86): Xaa can be any naturally occurring amino acid
  misc_feature (130)..(130): Xaa can be any naturally occurring amino acid
MKVRVGPPQVHHHRQILRSWSGGGSLWKTTRTAAFQWLARSRASVAQMFFRTVSPEWGYRIVAACVPKKVVQFSRTDEVFDSIEWXAKDLAICVKASFACLTKSYRFLARQFWREETFHRAQYQEFDYIXSKRTTALTLDAPAEKIEA

SEQ ID NO: 50635 - protein, 502 aa, Rhodococcus sp. RHA1
MITNDVHLATVPHWIAGAPSGSTNGRRSEVVDPATGHVLRLVELGDAAVVDTAVTSARSAAGAWASTPAPVRATTLHRFRALMLEHSDELASIITSEQGKTLADARGEVARSVEAVEVAISVVQHLKGEYAEQVSRGVDTYSFRQPLGVCAGITPFNFPIMVPVSMFAAAIACGNSFVLKPSERVPSASVRLAQLLAEAELPDGVFNVVHGGVDTVNALIDHPDVAAISFVGSTPVAREIYSRSAAAGKKVQALGGANNHMVVMPDADLDAAADALASAAYGAAGQRCMAVPIAVAVGEIADELVAKTAERATAFRTGPGNDEGTDMGPLISEVAIERVRGALEAAPSQGANVVVDGRVNIASEAGYFIGPSLVDNVSVDSDLYQKEVFGPILSVVRVDDLDEALRIVNASPYGNGATIFTASGVAGRRFVHSVQAGSVGINVPIPVPISWFGFGGWGDSRFGDDGLNYDAYRFYTKSKVVTQRWTEPRMGVSPHFVAARNQ

SEQ ID NO: 50636 - protein, 168 aa, Cyanidium caldarium
MSRDTSANSSGQQNYTWSERVIQITRVTKVVKGGKKLSFRAIIVIGNNQGSVGVGVGKASDVIGAVKKGVSDCKKQIIEFPLTSSSTISHAVEGRFGAASVILKPSVQGSGVIAGGAMRTVIELSGIKNIVAKQLGTKNHLNNAKATINALSKLNSKSSQLSLMSFSN

SEQ ID NO: 50637 - protein, 228 aa, Glycine max
  misc_feature (13)..(13): Xaa can be any naturally occurring amino acid
MAEREGGDRGSFXGCGFGGRGRGGDRGRGWRRTAGRRGEEEEWVPVTKLGRLVKEGKIRSLEQIYLHSLPIKEYQIIDTFVGPTLKDEVMKIMPVQKLSVIPVRRGYWGNKIGKPHNVPFKVTGKCGSVTVRMVPAPRGSGIVAIRVPKKVLQFAGIDGVFTSSRGSTKTLGNFVKATFDCLLKSYGFLTLEFWKETRFSKSPFQEYTDLLAKPTGKALILEEERVEA

SEQ ID NO: 50638 - protein, 355 aa, Pisum sativum
MADQDNSTRRPQREAKKRAVAALCEQRKRKRVALGDITNDVVSETEKLVSDSHSHTQKKKKRNIAKSPVPEKLEDPQLCEPYVSDIHDYLRNLEVDPSKRPLPDYIQKVQRDINANMRGVLVDWLVEVAEEYKLVADTLYFSVSYIDRFLSLNDLSRQKLQLLGVSSMLIASKYEEIKPPEVEDFCYITDNTYSKEEVLSMEAEILKTLKFELGGPTIKTFLRRFITKVGQEGVDASELQFEFLCCYLAELSLLDYNCVKFLPSMVAASVVFLARFMLNPKSRPWNSAICQFTSYKPADLKECVLNMHDLYLGRKGATLQAVRDKYKQHKFKCVATTPSPPEISLSFFEFRGADP

SEQ ID NO: 50639 - protein, 185 aa, Vibrio campbellii AND4
MINTQIKPFAATAYKNGEFVEVTEQDVLGKWAVFFFYPADFTFVCPTELGDLADHYEELQKRGVEVYSVSTDTHFTHKAWHDSSDTIGKIQYYMLGDQTGNITNNFGVMREGQGLADRATFLIDPEGTIQTMEITAEGIGRDAEDLLRKVKAAQYVAAHPGEVCPAKWKEGEETLAPSLDLVGKI

SEQ ID NO: 50640 - protein, 73 aa, Zea mays
MDDTEREKEKEKEKHDCGTDVEDEEEDDEGNKRVVALGPQVPLKEQLELDKDDESLRRWKEQLLGQVDTEQLG

SEQ ID NO: 50641 - protein, 72 aa, Debaryomyces hansenii CBS767
MIIPVRCFSCGKVVGDKWETYLEYLQDDTMTEGDALDKLKLQRYCCRRMVLTHVDLIEKFLRYNPLEKKDVN

SEQ ID NO: 50642 - protein, 171 aa, Nocardioides sp. JS614
MRLRLEHHLPRVHPEAWVAPTAVLAGAVTVERGASVWFGSVIRADGDTISLGERSNIQDGAIVHADPGFPVAVAPDVSVGHGAVLHGCLVEAGSLVGMRAVILNGARIGPMCLVAAGSVVLEGTEFEARSLVAGVPARRRRELTAQEVHDLAQNATDYLTLAARYRDAGPP

SEQ ID NO: 50643 - protein, 327 aa, Psychrobacter arcticus 273-4
MTTLAQYLNTNAASPALNDVITTVTDVGKTISQLLRKGALADILGEAGNQNVQGEDQKKLDVLANDLLLDALAKNTHCAGVASEELDDAIPANAEGSLLVLFDPLDGSSNIDINMAVGTIFSILPYQHQGKVSENSDFLQAGNQQLAAGYLLYGTSTVLALTITDNVVMFSLDPDTNDYVLIEENVTVDADTSEYAINASNYRYWRAPMQQYIDELIAGEIGVRGRDFNTRWVAAMVGDVHRILCRGGLFTYPFDTKYANKAGKLRLMYEANPMSLLIERAGGGATDAVNRILDIEPTDIHQRVPVVLGSKNEVDYVKNLHLNYAEK

SEQ ID NO: 50644 - protein, 351 aa, Nocardioides sp. JS614
MTQIMQALVVREPNVLEIAEVPVPEPGRNEVLARVRSVSICGTDAHLINGDYPGFWPPQFPFTPGHEWAGDVVALGEGADTFGWRVGDRVAGTSHSACGACQKCVEGQYNLCENYGRPALHAQYGHNAQGVNATYAVHNVKSIFRLPDEVSFDVGALADPASIALHVARRGNIKPGDTVAVTGAGAIGLLAADAALIDGAARVIVVGRGHRLERAAALGFETVDTRTGDPVAEVRGLTSGLGADVVLECAGVPETLIWGMAMLRRGGRCAMVGIPTEDVSLKCQPLVLDELELVGSRASAGEMRRVLPFIANGRMRAEELITHHFPLSEYDKALATFNDRASGAIKIIVNP

SEQ ID NO: 50645 - protein, 499 aa, Pseudomonas syringae pv. syringae B728a
MQMTTLTRADWEQRARNLKIEGRAFIQGEYTAASSGETFDCISPVDGRMLAKVASCDAADAQRAVDSARSAFNSGVWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVILKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAASAAASAIAFNQGEVCTAGSRLLVERSIKDRFLPMVIEALSAWKPGNPLDPATTVGALVDTQQMNTVLSYIEAGHSDGAKLVAGGKRILQETGGTYVEPTIFDGVNNAMKIAQEEIFGPVLSVLTFDTAEEAIQIANDTQYGLAAAVWTANISKAHLTAKALRAGSVWVNQYDGGDMTAPFGGFKQSGNGRDKSLHAFDKYTELKSTWIKL

SEQ ID NO: 50646 - protein, 166 aa, Leptospira interrogans serovar Lai str. 56601
MKNKILLSIIVICFGFISCLKTNGDSNQTNSKGGMMNYEVNKSDEDWKKELTPEQYRILRQKGTEMAFTGALYKNQDKGTYVCAACGAVLFSSDTKYESGSGWPSFYQPVKDGVVDKQKDSSHGMERTEILCSKCGGHLGHVFNDGPRPTGLRYCINSASLKFQKE

SEQ ID NO: 50647 - protein, 195 aa, Bacillus subtilis subsp. subtilis str. 168
MKVTKSEIVISAVKPEQYPEGGLPEIALAGRSNVGKSSFINSLINRKNLARTSSKPGKTQTLNFYIINDELHFVDVPGYGFAKVSKSEREAWGRMIETYITTREELKAVVQIVDLRHAPSNDDVQMYEFLKYYGIPVIVIATKADKIPKGKWDKHAKVVRQTLNIDPEDELILFSSETKKGKDEAWGAIKKMINR

SEQ ID NO: 50648 - protein, 280 aa, Corynebacterium glutamicum ATCC 13032
MPSKISRPYYQVDVFSSEPFMGNPLAVIADADDLSAEQMARIARWTNLSETTFLLKPTQEGADYRVRIFTPTGELPFAGHPTLGTAHVFRELHGEQGTQLVQECVAGLVAVRAIDGPASGLAFQAPPTLKDGPLDASDLDAACEALGISPDFIRAHQWVDNGPGWAVVELPSAQHVLDLEPDFSAHPTLKLGVIGAYPEGAPHAFEVRAFAQGIGEDPVTGSLNASIAQWLHRDGRAGEGYLASQGTAIGRAGEIHISIESHAIWVGGSVTTIFQGTAEF

SEQ ID NO: 50649 - protein, 110 aa, Oryza sativa
  misc_feature (77)..(77): Xaa can be any naturally occurring amino acid
MATITAVHARQIFDSRGNPTVEVDVTTEKGLFRAAVPSGASTGIYEAIELRDGDKAKYLGKGVSKAVNNVNEVIAPXIIGKDVTQQQEIDNLLLELDGTENKGKLGANAI

SEQ ID NO: 50650 - protein, 498 aa, Colwellia psychrerythraea 34H
MSETSNQNQHNQHKPRLSFWQIWNVSFGFLGVQFGFALQNANASRILSDLGADLHSLSLFWLVAPIMGLIIQPIVGSASDKTWNRLGRRNPYILAGGVAAAIGMLLMPNSATLASFITPLFFGAMMLALMDASFNLAFQPFRALVSDMVPAEQRNVGYSIQSFLINIGAVFGSILPFVLTNVIGLENTASSGQVAPSVIWAFYIGATVMLGSVLWTVLRTKEYQPGTNGLAELEEQKESQSLSEKLVEFFSLVKTMPKTMKQLALVQFFSWFALFIMWVYTMPAIAQHIWGIDAKWFDPTYLESVGTIPAHIAKAKGTAGDWVGIIFAAYSLFAAIASIFMAKVANKIGRKLTYSLSLLAGGIGYLSIMLVHNPELTLVNLGITQISVPQGAVSLFLPMIGVGIAWAAILAMPYAILAGSLPVKQTGVYMGIFNFTIAAPQIVSGIFAGWILTAVFDNQAIYIIMLAGISMLLGAISVYFVKEDTEQAIVTKQVNLTS

SEQ ID NO: 50651 - protein, 266 aa, Xanthomonas oryzae pv. oryzae KACC10331
MRSWRRQQCDTPSMSESPYTSGTTHFGFRDVAAKDKQKLVGEVFTSVARNYDLMNDLMSLGVHRAWKRYFVTTAQVKPGDRVLDLAGGTGDIAVLLKERVGNEGAVVLGDINAGMLSVGRDRLTNRGLVSGFDYVQCNAEALPFPDQSFDLVTISFGLRNVTDKDAALREMYRVLKVGGQARVLEFSEVTAEWFKPIYDFHSFKILPKLGKLFARDADSYQYLAESIRKHPPQESLKGMMGEAGFARCHFKNLTGGIVAIHSGYKI

SEQ ID NO: 50652 - protein, 365 aa, Bacillus subtilis subsp. subtilis str. 168
MKKRIALLPGDGIGPEVLESATDVLKSVAERFNHEFEFEYGLIGGAAIDEHHNPLPEETVAACKNADAILLGAVGGPKWDQNLSELRPEKGLLSIRKQLDLFANLRPVKVFESLSDRSPLKKEYIDNVDFVIVRELTGGLYFGQPSKRYVNTEGEQEAVDTLFYKRTEIERVIREGFKMAAARKGKVTSVDKANVLESSRLWREVAEDVAQEFPDVKLEHMLVDNAAMQLIYAPNQFDVVVTENMFGDILSDEASMLTGSLGMLPSASLSSSGLHLFEPVHGSAPDIAGKGMANPFAAILSAAMLLRTSFGLEEEAKAVEDAVNKVLASGKRTRDLARSEEFSSTQAITEEVKAAIMSENTISNV

SEQ ID NO: 50653 - protein, 210 aa, Idiomarina loihiensis L2TR
MSKITVIAIAGASASGKSLFASTVYQELVAELGTDGIAILAEDAYYRDQSHMTMEQRVLTNYDQPAAFEHDLLMQHLRQLKAGEAVDMPQYSHTTHTRLEKSIRVAPAKVVMVEGILLLTDEKLREQFDISVFMDTPLDICLLRRIKRDIEERGRTLQSVTEQYEQYVRPAFFDFIFPSKQFADLVVTRGGQNEIAIDIIKTKIRQLLAE

SEQ ID NO: 50654 - protein, 506 aa, Corynebacterium glutamicum ATCC 13032
MTVYANPGTEGSIVNYEKRYENYIGGKWVPPVEGQYLENISPVTGEVFCEVARGTAADVELALDAAHAAADAWGKTSVAERALILHRIADRMEEHLEEIAVAETWENGKAVRETLAADIPLAIDHFRYFAGAIRAQEDRSSQIDHNTVAYHFNEPIGVVGQIIPWNFPILMATWKLAPALAAGNAIVMKPAEQTPASILYLINIIGDLIPEGVLNIVNGLGGEAGAALSGSNRIGKIAFTGSTEVGKLINRAASDKIIPVTLELGGKSPSIFFSDVLSQDDAFAEKAVEGFAMFALNQGEVCTCPSRALVHESIADEFLELGVKRVQNIKLGNPLDTETMMGAQASQEQMDKISSYLKIGPEEGAQTLTGGKVNKVDGMENGYYIEPTVFRGTNDMRIFREEIFGPVLSVATFSDFDEAIRIANDTNYGLGAGVWSRDQNTIYRAGRAIQAGRVWVNQYHNYPAHSAFGGYKESGIGRENHLMMLNHYQQTKNLLVSYDPNPTGLF

SEQ ID NO: 50655 - protein, 415 aa, Hordeum vulgare
MASAPASASAALSTAAPADNGAAKPTEQRPVQVAKRLEKFKTTIFTQMSMLAVKHGAINLGQGFPNFDGPDFVKDAAIEAIKAGKNQYARGYGVPELNSAVAERFLKDSGLHIDPDKEVTVTSGCTEAIAATILGLINPGDEVILFAPFYDSYEATLSMAGANVKAITLRPPDFAVPLEELKAAVSKNTRAIMINTPHNPTGKMFTREELEFIADLCKENDVLLFADEVYDKLAFEADHISMASIPGMYERTVTMNSLGKTFSLTGWKIGWAIAPPHLTWGVRQAHSFLTFATSTPMQSAAAAALRAPDSYFEELKRDYGAKKALLVDGLKAAGFIVYPSSGTYFIMVDHTPFGFDNDVEFCEYLIREVGVVAIPPSVFYLNPEDGKNLVRFTFCKDDDTLRAAVDRMKAKLRKK

SEQ ID NO: 50656 - protein, 529 aa, Sulfitobacter sp. EE-36
MRLRHDPVYPSRRSPILAENVVATSQPLATQAGLSILQQGGNAVDAAIATAAVLTIVEPTGCGLGSDAFCILWDGKQLHGLNASGRAPAAWTPEYFKDGIPEHGWDAVTVPGAVSAWVELSEKFGSLGLSTVLAPAIRYAEDGFIVSPVVGTAWAKGAAVLKDQPGFAETFMPEGRAPKPGERFRNPGAARTLRAIAETKGRAFYEGEIAQEIAAFAKANGGAMTTDDLAAHHNDWCGTISQSFDDVELHEIPPNGQGIAALMALGMLQHTDIRDHGPDDLAAVHLQIEAIKLAYADLHAYVADRDHMTDVDEAALLDPDYLKSRAALIDANKAQDFGAGAPKQGGTVLLNVGDASGMMVSFIQSNYAGFGSGVVVPGTGVSMQNRGFGFTTQDGHPNQVAPGKRPFHTIIPGFAMKNGAPLMAFGMMGGPIQAQGHMQLLLRTQLWDQDPQTAADAPRWRAIEGLAVACEPSMPADLLDGLNALGHAIQIEAPDNAFGFGGAQLVQRNAAGGYAAGSDPRKDGQAAGF

SEQ ID NO: 50657 - protein, 182 aa, Arabidopsis thaliana
MASSMLSSATMVASPAQATMVAPFNGLKSSAAFPATRKANNDITSITSNGGRVNCMQMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFVAYKPPSFTG

SEQ ID NO: 50658 - protein, 341 aa, Mycobacterium smegmatis str. MC2 155
MMAQGTYVADKTSGGEFNRDTAYITTRITADGRDGYPVEPGRYRLIVARACPWANRTIIVRRLLGLEDVLPIGFCGPTHDERSWTFDLDPDGVDPVLKIPRLRDAYLKRFPDYSKGITVPAIVEVATGEVVTNDFAQMTLDFSTEWKAYHREGAPDLYPEPLRDEIDEVARRIYTEVNNGVYRCGFAGSQEAYERAYDRLFTALDWLTECLATQRYLVGDTITEADVRLFTTLARFDPVYHGHFKCNRSKLSEMDVLWAYARDLFQTPGFGDTIDFVQIKAHYYVVHSDINPTQVVPKGPDLSNWLTPHGREALGGRPFGDGTPPGPTRDGERVPAGHGAG

SEQ ID NO: 50659 - protein, 152 aa, Arabidopsis thaliana
MEDVEETYIMVKPDGIQRGLVGEIISRFEKKGFKLIGLKMFQCPKELAEEHYKDLSAKSFFPNLIEYITSGPVVCMAWEGVGVVASARKLIGKTDPLQAEPGTIRGDLAVQTGRNIVHGSDSPENGKREIGLWFKEGELCKWDSALATWLRE

SEQ ID NO: 50660 - protein, 159 aa, Bacillus subtilis subsp. subtilis str. 168
MNINIVTIGKLKEKYLKQGIEEYTKRLSAYAKIDIIELPDEKAPENLSDQDMKIIKDKEGDRILSKISPDAHVIALAIEGKMKTSEELADTIDKLATYGKSKVTFVIGGSLGLSDTVMKRADEKLSFSKMTFPHQLMRLILVEQIYRAFRINRGEPYHK

SEQ ID NO: 50661 - protein, 408 aa, Bacillus subtilis subsp. subtilis str. 168
MGGMALTGNKAVVYKGKGTVAVEDIGYPELILRDGPGVPKANVNRKCEHGVILKVITTNICGSDQHMVRGRTTAPEGLVLGHEITGEVIETGRDVEFIKKGDIVSVPFNIACGRCVMCKTQKTHVCLNVNPDRPGSAYGYVDMGGWVGGQSEYVMVPYADFQLLVFPDKEQALEKILDLTMLSDIFPTGFHGAYTAGVQTGSTVYIAGAGPVGLAAAHSAQLLGASTVIVGDLNEDRLAQARSFGCETVNVQKHDRLGEQIEQILGEPTVDAAVDCVGFEASGHGNQGEAPAAVLNSIMDVTQVGGSLGIPGLYVTEDPGAKDADAKTGSLKIRFGLGWAKAHTFVTGQTPAMTYNRNLMKAILSGRAQIAKAVNATVISLDDAPKGYSDFDKGAAKKFVIDPHGTLK

SEQ ID NO: 50662 - protein, 613 aa, Ostreococcus tauri
MSDPSEVVPDVQEPMTTNARENRREDSDSGGSRAAYVDANDDGFRDADSEFSGQNRNDDEDNCEMDYDGTTTEIREGMLSGMESDAREELTPIAAKEDIEMEKKEGEPGGMIASGIALEIPAHFQCPITMELMQDPVMIATGHTYDRPAIQRWLDQGHRTCPVTGVRLRHLELIPNHAIRTAIQSWAPAELSALRPLAPLHDKAVVDIHRQNSDIIGLRDALGAGAAVVAPAANADASDDQHPVYTIAEGHDEIVWGVDTTPTTLFSASADKTIRAWDISSRRCVQVLEEHTRPVLCLAVCVKHDKLFSGSYDCTVRVWNLSTYRRITYLPGHTDAVRALQVYNDTTLYTASYDHTIRAYDIESLELLKVLRGHNGPVRTLVTVNDYVFSGSYDRTVRVWPAYSEDIGPSAGTDLVKTLKGHKDAVRALACFPRRQATSSNRAIGPYVFSGSDDSNVRVWNAGTFECIQELKGHTDNVRVLTVDDRYLYSGSWDKTIRVWDLETFSCKHIINGHTEAVLALCVMGGHLVSGSYDTTVRLWGVQSETEFECVGVFHAHNDAVRVLTSAGRNAATVFSGSYDGSIGFWRLPISDPRDWPPSRSHALGWVGQRSPH

SEQ ID NO: 50663 - protein, 452 aa, Photobacterium sp. SKA34
MAKHFDYICIGGGSGGIASANRAAMYGAKVAIIEAKALGGTCVNVGCVPKKVMWHGAQIAEAMHLYAKDYGFNVDVKGFDWSKLVESREAYISRIHTSYDNVLGNNKVEVINGFAKFVDTKTIEVNGEHYTADHILIAVGGEPTIPAIPGAEHGIDSNGFFELNEQPKRTAIIGAGYIAVEIAGVLSALGTDTHLFVRKESPLRSFDPLIVETLVEVMATEGPTLHTHSVPKEVVKEADGSITLHFENGESHNTDVLIWAIGRHPTTDKINLETTGVATNDRGYIKVDEYQETNVKGIYCVGDIMEGGIELTPIAVKAGRQLSERLFNNKPDAKMDYSLVPTVVFSHPPIGTIGLTEPEAIAQYGEENVKVYKSGFTSMYTAVTSHRQPCKMKLVCAGDDEKVVGLHGIGFTVDEMIQGFGVAIKMGATKADFDSVVAIHPTGSEEFVTMRG

SEQ ID NO: 50664 - protein, 373 aa, Legionella pneumophila str. Lens
MNALTSWIKAWSQKFFPNQKKNENKEEVADLTQEKKVRPNADFYENYFSLVAAGTRLKLIEAMFGVNLFSLFENKVWVFEKDIIEKLQLMPIRARKWLHLLSSEHFLIQIKVNGQQAYQLPEEFIELIHSEEFPAMEMFFKTWLVSTEENLTDVLRFGKVKTSVSWPPKTQQEAEWLEDWMTRTSDQPTYCLLQSINFKKVNKLLDVGGGDGTMACTFVKKHPHLKATVYNLPMSAEMARKNIESRKLNHKVHVIEGDFIEKDAFPVGFDLILFTRVLFDWDDQVCRKLLRMAYQALPKNGLVGICEFYKEDNNDICLASEYRYIFHDDFGVNVMKRASEYQSMLEKIGFTIVQPHKVKGSHFYYCSLILAQK

SEQ ID NO: 50665 - protein, 541 aa, Bacillus thuringiensis serovar konkukian str. 97-27
MITVSNVSLRFADRKLFEDVNIKFTPGNCYGLIGANGAGKSTFLKILSGEIEPSTGDIHITPGERLAVLKQNHFEYEEFPVLETVIMGHTQLYKVMQEKNAIYMKEDFSDEDGMRAAELEGEFAELNGWEAESEAAILLKGLGIGEDLHDKKLSELTGAEKVKVLLAQALFGKPDILLLDEPTNHLDLKAIQWLENFLMNFENTVIVVSHDRHFLNKVCTHMADLDFGKIQLYVGNYDFWYESSQLALKLTQDANKKKEEKVKELQNFIARFSSNASKAKQATSRKKLLDKITLDDIRPSSRRYPFVGFTPEREVGNDLLTVEGLSKTIDGEKVLDNVYFTLNKGDKVAFIGRNDIAMTTLFKILMGEMEPDSGSFKWGVTTSQSYFPRDNSKYFENSDLNLVEWLRQFSPQDESESFLRGFLGRMLFSGEEVKKNVSVLSGGEKVRCMLSKMMLSGANVITLDDPTNHLDLESITALNNGLIAFKGTILFTSHDHQFVQTIANRIIEVTPNGVIDKEATYDEFLENEELQKQVDAMYKGQ

SEQ ID NO: 50666 - protein, 424 aa, Psychrobacter arcticus 273-4
MDPTSSLTILEISAIFLSITALLTYVNHRFIGLPTTIGVMVISILLSIGAIFLGLLGFDQLIDYEISLLGQLDFTEVLLDGMLSMLLFAAALHVNIGDLKRYKLPIGILAFIGTLVSALLIAVALYLMLPLFGFELSFLWCLLFGALISPTDPIAVMGILASAGAPKSIETVIAGESLFNDGIGVVIFVLLLGILSSGDIPTANYVAHTLAVEAGGGIVFGLVLGAILYYMLKSIDSYQEEVLLTLAGVIGGYELASHWHLSGPLAMVMMGLMLGNRGRALAMSDKTRHYVDLFWELIDEILNAILFVLIGLEVVMIAYSANLFIAGALTIVIALLARFIVVGMTTKTFHRQLDLPAGAWKVLTWGGLRGGISVALVLQLPTGSERDILLALTYAVVIFSILVQGLSVGKVAKSIGTDKKTVEI

SEQ ID NO: 50667 - protein, 580 aa, Thermotoga maritima MSB8
MKKSLTLVLVVVSILIFSQTFKLEKVLGFSDISSLAFKDGYLLLGTGNGEIIVYKDGSYYRAFKVHDNRVNEVTFENGFIVSASDDKTVGVTNLETGEIKLLKGHMKGVSSVAVAGSKILSASFDGTVRVWSFPDGGEISSQKLGPSVVQIAAHENRYVVGLANGLALIRDLSNQSFSIPLKAHPEGIKKIVFSENGQLIATCGGNTVKVWNASNGNLVLQYDHVITVNDVAFLENDSLIFVADDYKAVVLNIQKNEVVKSIDAHNNFVLFVSSDDGSIATYGMDKTVKVWNANLELQYSLYGHQLSVNTVALSSDRKFIVSGSDDREILIWNTEKGIAEHRIKALSGVRKLLTVENNIISCLDSNQLKIYNLENGKLVKRIKVGTTSTMDIALQNDRMAVGFYDGSVALFRYPSFEEIWRKDTEHEMIQTIDMNNKFIAFGVSYSDPKDKIGYVEVLSADTGERVFLLEGHRGNVNAVKFAGDFLVSGGEDGKVILWNLDTGSKVKEIYLNEPVSSLFVDEKELFVGTWNGSIKIFAFPDLTLKTSLKASDQKIGHLIKVGNHLVVPCGDGKIRILVEK

SEQ ID NO: 50668 - protein, 488 aa, Frankia sp. EAN1pec
MAAVALDRTPPKVHLRVAGERLETGSGGAFDHIDPRTGQVDATIPLAGPRDVDRAVESAHEAFLRWRDTRPAERRRLLLRLADAIEANEAEFVRRAVLDNGTPVGTAPGLVVGSVEWTRYYAGFADKISGRVASSFGPDGEFSYTLAQPYGVIGVVITWNGPLPSLTMKIPAALAAGNTVVVKPSELTPFAAELFADLVEEAGFPAGVVNILPGSAAAGARLVDHPLVQKVSFTGGPATAKAILKACAEQMKPAVLELGGKSANLIFDDADLDVAARWGTLRVLGTMSGQGCGFPTRMVVQDTVYDEVLGRVAEIVKTIRVGDPYDTDTDIGPVVNAAAVERILGLIERAGRDGSRLVHGGRRVTEPGLADGYYLEPTVFADVDPHSELAQTEVFGPVLAVMPFTTEDEAVSIANATRYGLSSYIQTKDLRRAHRVAERLTAGATMINGAPNLMVNRPFGGFGLSGYGKEGGPEGLEEFLRVKTVGIA

SEQ ID NO: 50669 - protein, 274 aa, Oryza sativa Japonica Group
MDLSTTSVVAAKAYKYRAESLVKDYLLADCYVSYTAVLGGILMCKMVYDITHLISSLYYKGYGSLTKIQKLEWNNRGMSTVHAMFITLMSVYLVFFSNLFSDELDGPVTVRSSNLSNFTLGVSLGYFIADLAMLSWAYPSLGGMEYVLHHLLSIISLVYAIYSEEGQLYTYMVLISETTTPGINLRWFLDTVGMKRSKAYLVNGVTMFVAWLVARIILFIYLFYHIYFHIDQVKQMRTFSCILIFAVPTILLVMNTVWFVKILRGLKKTLAKRQ

SEQ ID NO: 50670 - protein, 386 aa, Aspergillus flavus
MTGLDMETIFAKIKEEYSRTDDVGKRKIQGHIRELQVGFYSDWDVVMRLSSGPLQVALAKVGIDLGIFRSLKESDTPITLAEFVKKTGASPRLLGRILRTQAAFGLIKETGPQEYTSSAFTDVFANPAAAGAVVQLLDISGPCTQILPDFLAERHYQDITSNKDCVFQKAFDSDLTMFEWMPQHPKHMESLGHLMALERPVSWVDHFPVLEELGDFPAPDKVLMVDIGGGFGQQSKALRAKFPNIPGRVIVQDIPQTLANAQPAAGVEFMEHNFFEPQPIRNAKFYYLRHVFHDWPDEQCVLILKQIIPVMGPESEILIDEMVIPSTGVPWQAAFTDLLMMNSLGGVERTRAEWDDLMKQAGLEIIQSKVYDSKEQTILVAVPRRT

SEQ ID NO: 50671 - protein, 345 aa, Oryza sativa Japonica Group
MTQTPTPAAAAPAPAVAVSEAGLPDAIAAALPPDPYEQLEVARKITAVAVAARASRLELEAARLRQKLADKDRLAAELADRAASLEQALRDSDARLRAALDDNAKLAKERDSLAHTSKKLARDLAKLETFKRHLMQSLGDDNPPETVDIRTCEQSVAKASSWKDGVAHSRHHHPVSSLADGSTEIESVNQEVARPFEQKLSVTHISPRLTSDPAAKTRTAATSPRRYSTAVSPKLAASATSPRLEGHMAMQPWLPSSKMSSAANSPPRAHSISGRTTRVDGKEFFRQARNRLSYEQFAAFLANIKELNAHRQSREETLQKADEIFGSENKDLFMSFQSLLSRSLS

SEQ ID NO: 50672 - protein, 581 aa, Oryza sativa Japonica Group
MDLPKLLFTVLILSLLNYESSSATAWDDEDFFKTCSSHRCSKHGPEIRFPFRLSTQPPSCGAPGMHLSCSGQDTILNHPVLGPCKVTEISYSYATMNVIPPVDSSPHCPLQKLMSKNQSTSVYKPQGPQSQGATLVVCSRDPIPANQYDIVGPISCLGHNNQFWYLADPYTYMSVLPLDCTVISKGIPMPYSYDKKGRINWDTSNFKETANRVINDGPRVTLVAATSSVATFVILSLVVATAFYISLKSRYNKEIHLKVEMFLKTYGTSKPMRYTFSDVKKITRRFKNKLGHGGFGSVYKGELPNGVPVAVKMLENSLGEGEEFINEVATIGRIHHANIVRLLGFCSEGTRRALIYEFMPNESLEKYIFSNGSNISREFLVPKKMLDIALGIARGMEYLHQGCNQRILHFDIKPHNILLDYSFSPKISDFGLAKLCARDQSIVTLTAARGTMGYIAPELYSRSFGAISYKSDVYSFGMLVLEMVSGRRNTDPTVENQNEFYFPEWIYERVINGQELVLNMETTQGEKETVRQLAIVALWCIQWNPTNRPSMTKVVNMLTGRLQKLQVPPKPFISSENHLAT

SEQ ID NO: 50673 - protein, 373 aa, Nocardioides sp. JS614
MTTTATCAVVRETGGPFRLEQVELSGPRPDEVLVEVVASGLCHTDLLVRDSRPDSLPAVLGHEGAGIVRETGSAVREVGAGDKVVLSFPSCGRCRRCRTGWSAYCDSIAQLKFGCCRADGSVATTDLDHRPVGDHFFGQSSFGTFCVANARSVVRVPDDTDLRIAGPLACGVQTGVGAVLDVLRVTPGSSVAVYGTGSVGLCAVMAARLCGATTIVAVNRRASRLELAAELGATHLVSPEAVDPVEAIREATGGRGVDFALETTGVPTVLTQAVRSLDSLGTCAFVGTAPPGATGGIVMLEAMTRGLTVRGVLQGDSTPSQMIPRMLTLHQRGLLPFDRLITHYSFDEINRAASDCVSGDVVKPVLLMSGGPA

SEQ ID NO: 50674 - protein, 268 aa, Nocardioides sp. JS614
MATAQVSTTELQRFRLDDRVAIVAGGSGGVGVRTCAALAGVGAKVAVIGRSEAGLAAARSAVEDAGGEALVITGDMTQKEAADDAIAQTLGAFGRVDVLVNGIGGGAGTALHAAEDYPQADWNRILDLNLTTALLVSQAAARAMVAGGRGGAILNISSVRGQLGIDAGFSAYVAAKGALDALTRQHATEWAKHDIRVNTISPTFVRTEQAAELLAAPGFYDNLVSRIPLHRIAETDDLVGAVLFFCTDASSFVTGQLLTLDGGLTATQ

SEQ ID NO: 50675 - protein, 174 aa, Bacillus subtilis subsp. subtilis str. 168
MKRIITLTVVNRSGVLNRITGLFTKRHYNIESITVGHTETAGVSRITFVVHVEGENDVEQLTKQLNKQIDVLKVTDITNQSIVQRELALIKVVSAPSTRTEINGIIEPFRASVVDVSRDSIVVQVTGESNKIEALIELLKPYGIKEIARTGTTAFARGTSKRRHPIKQYLLYKT

SEQ ID NO: 50676 - protein, 338 aa, Escherichia coli K12
MIIERCRELALRAPARVVFPDALDQRVLKAAQYLHQQGLATPILVANPFELRQFALSHGVAMDGLQVIDPHGNLAMREEFAHRWLARAGEKTPPDALEKLTDPLMFAAAMVSAGKADVCIAGNLSSTANVLRAGLRIIGLQPGCKTLSSIFLMLPQYSGPALGFADCSVVPQPTAAQLADIALASAETWRAITGEEPRVAMLSFSSNGSARHPCVANVQQATEIVRERAPKLVVDGELQFDAAFVPEVAAQKAPASPLQGKANVMVFPSLEAGNIGYKIAQRLGGYRAVGPLIQGLAAPMHDLSRGCSVQEIIELALVAAVPRQTEVNRESSLQTLVE

SEQ ID NO: 50677 - protein, 439 aa, Corynebacterium glutamicum ATCC 13032
MRMTVIGTGYLGATHAACMAELSHEVLGVDVDEAKIASLKDSKVPFFEPGLPEVLERNLENGRLNFTTDYAEAAAFAQVHFLGVGTPQQKGTYAADLTYVRQVVEDLVPLLEGEHIIFGKSTVPVGTAEQLQELADSLVKPGSHVEIAWNPEFLREGYAVKDTITPDRIVVGVREGATAEAIAREVYATAIAADTPFLVTDLATAELVKVSANAFLATKISFINAVAEICEQTGADVVALADAIGHDDRIGRKFLGAGLGFGGGCLPKDIRAFMARAGELGADQALTFLREVDSINMRRRDRVVQLAKEMCGGSLLGKRVTVLGAAFKPNSDDVRDSPALSVAGSLSLQGAAVSVYDPEAMDNARRVFPTLSYASSTKEALIDAHLVVLATEWQEFRDLDPEVAGGVVEKRAIIDGRNVLDVAKWKAAGWEMEALGRNL

SEQ ID NO: 50678 - protein, 461 aa, Sulfitobacter sp. EE-36
MNTQNMPAPDGATPAHPIPVEADLAKADVGLIDFAKKAGKNIFSVIPDATRTQSYLKGPAKIHYVCDPDMVTELLAGVGRRFPKAEFTHNVIGPVVGNGMILSEGEKWRAQRHRYAPLFAARNLPVLTRHFAQTGDELADFFARTAGEVDVSDAAQEATLTNISRVMFSGNEAVSKQDVRQGMRRFTDYISYMSLFDLMGLPKWVPRLKWLRSKKAIRDLRQLTHDVIANRRAQRHAEAVDFLDLLIEALETDKEDVETTVDNLLTFVAAGYETSANTIAWGLYLLAMHPEVQTDLRAEVMEACGDGPIGFHDLPKMPKLHAHVRETLRMYPAGALFARDATDEVTIKDVTFKKGDVIMFPVYALHRNELLWDNAALYQHDRFLDCKYPRGQYIPFGDGPRICIGAQYAETEIMVLLASALRRASFELTDHPVAPPNLTFTMRPDGPLMLRAVPVDQAAVE

SEQ ID NO: 50679 - protein, 465 aa, Yersinia enterocolitica
MNLFDSCAHPSRIHGCLLEAPLHGVFIGEICLIERDLCQPEVIAKAQVVGFKEGQTILSLIGRAQGLTREVVIRPTGQPFVFEMGEHLAGKIYNAAGEEVGVLSNATASSEPLFTTLCRVDNPPVSVNLRRPVTTPLVTGVRAIDGLLTCGQGQRMGIFAAAGSGKTSLMSMIMNHAVADICVIALIGERGREVTEFIHELQTSPRAAQTILVYATSDSPAVERCNAALLATAMAEYFRDQGKDVLLFVDSMTRYARALRDVALAAGELPARRGYPASVFEQLPLLLERPGALQHGSITAFYTVLLESEEESDPIGDEIRSIIDGHIYLSAQLAGRGHYPAIDILHSISRVFSKVTTPQHRQDAAKTRDMLGRLAQIQLYLDLGEYQRGENTDNDHALDNRDVIEGFLQQAMEEPGEFSTSSISSVSWQTDGKESAEPHTTATGANQTRPADIAAFATDATTAAA

SEQ ID NO: 50680 - protein, 342 aa, Arabidopsis thaliana
MLQKISQSISLCNGDQFKPLIYLAGAPTNFISSPLSGKKKSSSLRIKRIQQLQSTLEDRINPPLVCGTVSPRLSVPDHILKPLYVESSKVPEISSELQIPDSIGIVKMKKACELAARVLDYAGTLVRPFVTTDEIDKAVHQMVIEFGAYPSPLGYGGFPKSVCTSVNECMFHGIPDSRPLQNGDIINIDVAVYLDGYHGDTSKTFLCGDVNGSLKQLVKVTEECLEKGISVCKDGASFKQIGKIISEHAAKYGYNMERFIGHGVGTVLHSEPLIYLHNDYELEYMIEGQTFTLEPILTIGTTEFVTWPDKWTIVTADGGPAAQFEHTILITTTGAEILTISS

SEQ ID NO: 50681 - protein, 759 aa, Escherichia coli K12
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKAGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSSLKGSANILVMPNMEAARISYNLLRVSSSEGVTVGPVLMGVAKPVHVLTPIASVRRIVNMVALAVVEAQTQPL

SEQ ID NO: 50682 - protein, 432 aa, Lactobacillus johnsonii NCC 533
MSVITDIHAREVLDSRGNPTVEAEVYTELGGFGRAIVPSGASTGEHEAVELRDGDKSRFLGQGVLTAVENVNGEIAKAVIGLDVTDQRLIDQTMIDLDGTPNKGRLGANAMLAVSLASARAAADELGLPLYEYLGGPNAHVLPTPMMNVINGGKHADNNVDIQEFMIMPVGAKSLHEAVRMGAETFHTLKSLLQERGESTAVGDEGGFAPNLKNNEEPFEILVEAIQRAGYKPGQDISIAFDCAASEFYNKDTKKYVTVADGREYTAEEWTSLMEDIVDKYPVISIEDPLDENDWEGWKVFTERLGDKVQIVGDDLFVTNTNYLEKGIKMGVANSILIKLNQIGTLTETFEAIEMAKEAGYTAVVSHRSGETEDTTIADLVVATNAGQIKTGSMSRTDRIAKYNQLMRIEEALGSTAQYKGIHSFYNLHKQF

SEQ ID NO: 50683 - protein, 261 aa, Chromobacterium violaceum ATCC 12472
MLEQVMQLVRDVAAREVMPRFLRVGKSRKDDGTLFTEADLACQEELQRRLPAILPHPVLGEEMEREEQDALWAANKDGLWVVDPIDGTTNFVNGLPYFAISVGLMVDGKSELGVIYNPVSDEMFYARRGQGAWLNGHRLPLKTINNCMGDAIASVEVKYLRSGKLAARIGSVAPCGSQRNMGSSTLDWCFLAAGRYDLYLHGGQRLWDYAAGAVIAEEAGACLASLNTDDYWSDVVWKRSVIGAITPELFAQWHRWVRANQ

SEQ ID NO: 50684 - protein, 327 aa, Pediococcus pentosaceus ATCC 25745
MNEKHGFARAHTNIALLKYWGKINSDLILPANDSISLTLDKFYTDTEVTFSDEYTSNLFYLNHQLIDVKKMQRINRVLEAVKSEFGYQGFAKIESENHVPTAAGLASSASGMAALAGAAVSALGSHTDLTNLSRLARLGSGSASRSVFGGIVHWHRGYDHQSSFAEQIVSEDQIDLNMVTIVIDRRQKKVKSTLGMQHTASTSPFYPAWVEATNQAIPEMISAVQNNDFTKIGELAEHSAAMMHATTLSSKPAFTYFAPETIQAIKLVEQLRESGIECYYTIDAGPNVKVLCQSKNITRVKRFFASYFDQDQLVVAKPGSGIKFTKN

SEQ ID NO: 50685 - protein, 256 aa, Arabidopsis thaliana
MSQEQPRRPREPVKYGDVFEVSGELADKPIAPEDAKMMQSAETHVFGHTQKGGPAAVMQSAATTNIRGGFVHPDDKTELVAERGATVEQTVPAATVTTEFVGGQVVGQHVEPRRVVAAARTDEEALQSTITIGEALEATVKTAGNKPVDQSDAAAIQAAEMRASGTNVIALAGVAASAQSAADHNATVDRNERKIKLRDVLTGAAGKLSADRAVTREDAEGVVSAEMRNNPKLCTHPGGVAASLTVAARLNERFDI

SEQ ID NO: 50686 - protein, 406 aa, Xanthomonas oryzae pv. oryzae KACC10331
MCPRSWWFIIETMDSRLPYAGGYSRRSQDIAPFHVMSLLARANALEQAGHDVIHLEIGEPDFTTAAPIVAAGQAALAAGHTRYTAARGLPALREAIAGFYAQRYACNVDPERILITPGGSGALLLASSLLVDPGKHWLLADPGYPCNRHFLRLVEGAAQLVPVGADTDYQLTPALVETCWNSDSVGALVASPANPTGSVLSRSQLAALSQTLHARGGHLVVDEIYHGLTYGLDAHSVLEVDDSAFLLSSFSKYFGMTGWRLGWLIAPPDAVPELEKLAQNLYISASTIAQHAALACFTPESIAIFEARRAEFQQRRDYLLPALRALGFDIAVEPQGAFYLYANISGFSNDAQAFCAHFLETEHVAFTPGIDFGHSRANQHVRIAYTQSLPRLQQAVTRIARGLSRL

SEQ ID NO: 50687 - protein, 402 aa, Pfiesteria piscicida
MAAAVAMEVEGARAGIQSYYDTNIQELEARIRERKLNNRRLEAQRNELNARVRLLREELHMLLEPASNCGEIIKAMGKDKILVKCGQEGKYVVDKDKDITIEECKPNARVALRSDSYVLHKILPSKVDPLVQLMRVEKTPDSTYEMVGGVDKQIKEIKEVIELPIKHPEIFESLGIAQPKGVLLYGPPGTGKTLLARAVAHHTQCCFIRVSGGELVQKYIGEGSRMVRELFVMAREHAPSIIFMDEVDSIGSSRVEGSEGGDSEVQRTMLELLNQLDGFEAATNIKVIMATNRIDILDEALLRPGRIDRKVEFPNPNEEARLEILKIHSRKMNLKRGINLRKIATQMTGASGAESKAVCTEAGMFALRERRQHVTEDDFQMAVSKVMKKDSDKNMSVMQLMR

SEQ ID NO: 50688 - protein, 586 aa, Triticum aestivum
MGGDERHLGRTMSFGIPDVALGLVMGCVEDPWDRDAISLVCRHWCKVDALSRKHVTVAMAYSTTPDRLFRRFPCLESLKLKAKPRASMFNLIPEDWGGSASPWIRELSASFHFLKVLHLRRMIVSDDDVAVLVRAKAHMLVSLKLDRCSGFSTSSLALLARCCKKLETLFLEESSVAEKEMVEWLRELATSNTVLETLNFFLTDLRASPAYLFLLVRNCRRLKTLKISDCFMSDLVDLFRTAETLQDFAGGSFDDQDQGGNYANYYFPPSVQRLSLLYMGTNEMQILFPYGATLKKLDLQFTFLTTEDHCQLVQRCPNLEVLEVRDVIGDRGLEVVARTCKKLQRLRVERGDDDQGGLEDEQGRVTQVGLMAVAEGCPDLEYWAVHVSDITNAALEAIGAFSKNLNDFRLVLLDREVHITELPLDNGVRALLRGCTKLRRFAFYVRPGALSDIGLSYVGEFSKTVRYMLLGNAGGSDDGLLAFARGCPSLQKLELRSCCFSERALAVAALQLKSLRYLWVQGYKASPTGTDLMAMVRPFWNIEFIAPNQDEPCPEGQAQILAYYSLAGARTDCPQSVIPLHPSVGS

SEQ ID NO: 50689 - protein, 171 aa, Pfiesteria piscicida
MANPKVFFDMTIGGSPAGRITMELRADVAPKTAENFRALCTGEKGVGKSGKPLHFKGSSFHRVIPDFMCQGGDFTNHNSTGGESIYGAKFADENFTLKHTGPGILSMANAGPGTNGSQFFLCTVKTAWLDGKHVVFGSVVDGMDVVKKIEAVGSQSGKTAQPVVIADCGQL

SEQ ID NO: 50690 - protein, 99 aa, Cyanidium caldarium
MTSYKVKLTNEKEGIDVEINCPNDQYILDAAEEQGIDLPYSCRAGACSTCAGKLISGTVDQSDQSFLDDEQIKEGFVLTCVAYPTSNCTILTHQEEALY

SEQ ID NO: 50691 - protein, 221 aa, Brassica napus
  misc_feature (160)..(160): Xaa can be any naturally occurring amino acid
MESSPINRLPPDSLHQIFSSLPLRQIIICRSVCKFFNHLLTSQPFTEIISTRPPLNLLALRPPHHHRHRHAANPQPCINVYDPDENRWLRFNLDFLPFRSPQPVASSNGLIYLWGDSVNSVDSSKSLVACNPLTRQFKVLPQLGSAWSRHGTVLVDSVNXVMVLTELAALVYYSGAGVANQWLRFSSNLPSKPRSPVLMSTSVYALCDVGSPWRSQWKLFS

SEQ ID NO: 50692 - protein, 325 aa, Lactobacillus johnsonii NCC 533
MKVFDSLKKKAEESKKVIVFPEGNDDRIIKAAVRLEKEGIVKPLLLGKPDEVIKTAQSLNVDLGSIEIINPAVYPDFEKMCQDFVELRKGKNTLAEAKEILQDVSYFGTMLVYEGKADGMVSGATHSTANTVRPALQIIKTKKGMSRVSGAMIMERGDEKYIFADCAINIDPDSETLAEIAYQSSKTAEMIGLEPKIAMLSFSTKGSAKGPMVTKVQEATELVHQKYPDLICDGELQFDAAIVPRVGEAKAPGSAVAGHANVFIFPELQSGNISYKVAERLGGFSAIGPVLQGLAAPINDLSRGCKTEDVYLLAILTAAQANMEK

SEQ ID NO: 50693 - protein, 397 aa, Bartonella henselae
MSIAAVILAAGRGKRAGSLPKKPKQYRLLGQEPVICHTVRCFCQNPAITTIILVIHPEDRQICEQAIADFKEQLIIVEGGNTRQKSTLRGLQALRKFKPKYVHIHDGARPFVENKLLEQIHTTVTPQEGVLPVLAVCDTLKRINSTHHVLETIPRTHLYSAQTPQCFPFERILAAHEKAIKTCKKEFTDDSAIAEWFGISMRTIPGSPHNIKITWHEDLNTAHLYLQKKMQMFPDIRTGNGYDVHSFEEGNSLILCGIKIPFHKKLNGHSDADVALHALTDALLATRGAGDIGTHFPPSDPQWQNVSSEIFLRHALDIVKQAGGRIANVDITLIAEEPKIGPYRHAMVGNLMNMLTILPDRISIKATTNEKLGFIGRGEGIAAFATANVLYPGEIPK

SEQ ID NO: 50694 - protein, 467 aa, Bacillus subtilis subsp. subtilis str. 168
MNTNQDNGNQLQRTMKSRHLFMISLGGVIGTGFFLGTGFTINQAGPLGAVLSYLVGGFIMFLTMLCLGELAVAFPVSGSFQTYATKFISPAFGFAFGWLYWLGWAVTCAIEFLSAGQLMQRWFPHIDVWIWCLVFAALMFILNAITTKAFAESEFWFSGIKILIILLFIILGGAAMFGLIDLKGGEQAPFLTHFYEDGLFPNGIKAMLITMITVNFAFQGTELIGVAAGESEDPEKTIPRSIKQTVWRTLVFFVLSIIVIAGMIPWKQAGVVESPFVAVFEQIGIPYAADIMNFVILIALLSVANSGLYASTRILYAMANEGQAFKALGKTNQRGVPMYSLIVTMAVACLSLLTKFAQAETVYMVLLSLAGMSAQVGWITISLSQIMFRRKYIREGGKIEDLKFKTPLYPVLPLIGLTLNTVVLISLAFDPEQRIALYCGVPFMIICYIIYHVVIKKRQQANRQLEL

SEQ ID NO: 50695 - protein, 592 aa, Rhodopseudomonas palustris CGA009
MSVENDVGVYREALVFLGTAGVLIPVMTRFRVSPVLGFLVAGLVLGPHSLGRIGADLPWLSYVTITSQDAVDRLAELGVAFLLFTIGLELSFDRLWTMRRLVFGLGMSQVVLTTAAISGIALIFGNTVESSLVIGACLALSSTAIVLQLLAEQKRLATVAGRSIFAVLLAQDLAVVPILFLIVVFGKAAGDAAGGGAASTGAVWLGLAMALVQAAAAILLIIGFGRLVLRRLFRLVASTHNRELFMATILFVVVGTSLVTHVAGLSMALGAFLAGLVLAETEFRRQVEVDIEPFKGMLLGLFFISVGMRIDLAEVARYPAMVATSVIGMTALKALVIAGLTWLFRLSRPVIAEASLLLAGGGEFAFLVLGLASSSGLVTREVEQFMLLVSSGTMMLTPYLARLSRKASARARKAVAVAAGHTDPTPSDSPRIILVGYGRVGRIVGDILNKQGKPFIGIDVDPEAVARARKAGVNVVYGDATQRAFLRKCGLGDAPAVVVTMHDAAAAEHVVAAARAERADLPVIVRARDADHAARLFTLGATEVIREVLEASFEIASTVLQALGMPVGKVIAVIHDERDTRKKRVRAGVPAD

SEQ ID NO: 50696 - protein, 386 aa, Desulfotalea psychrophila
MKNGAVIIPAAGSGTRMKLDYPKQYHAVAGTPIIVHTIRAFNKHPCIAKIILVVPQDHLEESKALLQKYQLENISIVTGGARRQDSVLRGLQEVPESIDIVLVHDGARPMVSAELISRCYKGAQQYGAVIAAVPVKDTLKRGAGRIVTGTVDREGLWQAQTPQAARKALLVKAFKENGMRNVTDESTLLEGVGIPVTLIEGSETNIKITRPEDLILAENFLREKKEPMQKIRIGHGFDAHQLVEKRRLILGGVEIPYHLGLAGHSDADVLVHALCDALLGAIGAGDIGRHFPDSSDAFKDIYSIRLLESVMQKVGELNYKIGNADISVICQAPKLAPYLKQMQEIIATSCACQISDINIKATTTEKMGYTGRGEGISCHAVVLLQQ

SEQ ID NO: 50697 - protein, 401 aa, Bacillus subtilis subsp. subtilis str. 168
MTALSKSKEIIDQTSHYGANNYHPLPIVISEALGAWVKDPEGNEYMDMLSAYSAVNQGHRHPKIIQALKDQADKITLTSRAFHNDQLGPFYEKTAKLTGKEMILPMNTGAEAVESAVKAARRWAYEVKGVADNQAEIIACVGNFHGRTMLAVSLSSEEEYKRGFGPMLPGIKLIPYGDVEALRQAITPNTAAFLFEPIQGEAGIVIPPEGFLQEAAAICKEENVLFIADEIQTGLGRTGKTFACDWDGIVPDMYILGKALGGGVFPISCIAADREILGVFNPGSHGSTFGGNPLACAVSIASLEVLEDEKLADRSLELGEYFKSELESIDSPVIKEVRGRGLFIGVELTEAARPYCERLKEEGLLCKETHDTVIRFAPPLIISKEDLDWAIEKIKHVLRNA

SEQ ID NO: 50698 - protein, 242 aa, Wolbachia endosymbiont of Drosophila melanogaster
MSFLIVANWKMNGMRSSFVDFIGKLNNKSNEITSKLVICPPFTSFPSSIELNNNIDIGAQNCHHKKFGSYTGEISAEMLKELGCTYVMLGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLSISNLSGVLIGSASLDFDHFYKIIQQVEKKFSLINSKISN

SEQ ID NO: 50699 - protein, 241 aa, Triticum aestivum
  misc_feature (189)..(189): Xaa can be any naturally occurring amino acid
  misc_feature (196)..(196): Xaa can be any naturally occurring amino acid
  misc_feature (215)..(215): Xaa can be any naturally occurring amino acid
  misc_feature (227)..(227): Xaa can be any naturally occurring amino acid
  misc_feature (230)..(230): Xaa can be any naturally occurring amino acid
  misc_feature (236)..(236): Xaa can be any naturally occurring amino acid
  misc_feature (238)..(238): Xaa can be any naturally occurring amino acid
MYRVAGSHLRALKQHGSSRFASTSVVKQSSGGLFGWLLGSKPTQFPTLDVPLPGVTIPPPLPDFVEPAKAKVTTLPNGLKIASETSTSPAATVGLYIDCGSMYETPGSSGASHLLERMSFKSTTNRSHLRLVREVESIGGNVSAIATREQMCYTYDAFRAYVPDMVEVLIDSVRNPAFLDWEVKEQVFXFKGLLLXALHSAGYTGALAKPLVAPXPAIHKLDSGVLXEFXAENYTXPXMVL

SEQ ID NO: 50700 - protein, 341 aa, Glycine max
MASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGPEVEKLVASLPDGGVLLLENVRFYKEEEKNDPEHAKKLASLADLFVNDAFGTAHRAHASTEGVTKYLKPSVAGFLLQKVVPASAIPDGWMGLDIGPDSVKSFSEALDTTQTIIWNGPMGVFEFDKFAVGTEAIAKKLADLSGKGVTTIIGGGDSVAAVEKVG

SEQ ID NO: 50701 - protein, 154 aa, Zea mays
YSSCKRSARKKKQRAMASGGPKPKLAYIILYVRDVGKAASFYDAAFGYTVRRLDQSRKWAELESGATTIAFTPLHQRETDELSGAVQLPDSSAAGRGSVEVCFAYADVDAAYKRAVENGAVAVSAPEDKPWGQKSGFVRDMDGNIVRIASYVRE

SEQ ID NO: 50702 - protein, 647 aa, Bacteroides fragilis NCTC 9343
MHPKIKIYRDLMKTFEELGVSPEIRKAIEEMGYENPMPVQEEVIPYLLGENNDVVALAQTGTGKTAAFGLPLIQKINVKNRIPQSLVLCPTRELCLQIAGDLNDYSKYIDGLKVLPVYGGSSIDSQIRSLKRGVHIIVATPGRLLDLMERKTVSLATVTNVVMDEADEMLNMGFTDSINAILADVPQERNTLLFSATMSPEIARISKNYLHNAKEITIGRKNESTSNVKHVVYTVHAKDKYAALKRIVDYYPQIYGIIFCRTRKETQEIADKLMQEGYNADSLHGELSQAQRDTVMQKFRIRNIQILVATDVAARGLDVDDLTHVINYGLPDDTESYTHRSGRTGRAGKTGTSIAIINLREKGKMREIERIIGKKFIAGEMPTGKQICEKQLLKVIDDLEKVKVNEEDINDFMPEIYRKLEWLSKEDLIKRMVSHEFNRFVDYYRNREEIEVPTDSRSERAGKSREGKSSRQAEPGYTRLFINLGKMDNFFPHELITLLNNNTRGRVELGRIDLMKNFSFFEVEEKQAQNVVKALNRTNWNGRKVTVEVAGEEASTEHKGRGKRNEGNDQGGRGRSSAPSADRKERGKGSKDSKQADSRKGKKPSREERGYSAARGPKGKDEWKQFFKDAEPDFSEEGWARRKPKKS

SEQ ID NO: 50703 - protein, 329 aa, Arabidopsis thaliana
MSPLHSYIIFFSLLMTILLQSSTTSSQSNLCRSSCGNIPINYPFSIDDGCGSPYYRHMLICSDNDTKLELRTPSGKYPVKSISYSDPHLLVSDPFMWNCQDRDNFRPTRSFSIDSSTHFTVSPQNDYLFFNCNTDKVIVEPKPLFCERFPDRCDSSCDSSSYLCRHLPECGSALGSRVSCCSYYPKATQSLRLMLQDCATYTSVYWRSTGVENAPYDQFPEYGIRVDYEFPVTMKCLLCQETTKGGGVCGFNTRTRDFLCLCKQGNVTTYCKDPSLVNHKRVGAIAGTVTAVSAAGAIGVAGGVYWYLRKVRANAPVTCGVQSNENRIF

SEQ ID NO: 50704 - protein, 306 aa, Bacteroides fragilis NCTC 9343
MRKVIGIGETILDIIFRNDQPSAAVPGGSVFNGIVSLGRMGVNVCFISETGNDHVGNIILQFMRDNHIPTDHVNVFPDGKSPVSLAFLNEHSDAEYIFYKDYPKQRLDVLFPSINEDDIIVIGSYYALNPVLRDKILELLDIAKEKRAIVYYDPNFRSSHKNEAMKLAPTIIENLEYADIVRGSLEDFYYMYGIKDVEKIYKDKIKFYCPLFLCTAGAERISLRTNAISKEYPVAPLEAVSTIGAGDNFNAGLIYGMLKYDVRYRDLQHLSEETWDKVIQCGQDFAAEVCKSFNNSISGEFAANYR

SEQ ID NO: 50705 - protein, 406 aa, Bacteroides fragilis NCTC 9343
MQYNIHTLSNGLRIIHEPSSSKVAYCGFAVDAGTRDEAENEQGMAHFVEHLIFKGTRKRKAWHILNRMENVGGDLNAYTNKEETVIYSAFLTEHFGRALELLADIVFHSTFPQNEIEKETEVIIDEIQSYEDTPSELIFDDFEDMIFRNHPLGRNILGRPDLLKKFRSEDAMAFTSRFYQPSNMVFFVLGDFNFQKIVRQVEKLLVDLPLVTVENQRTIPPLYVPEQLVVHKETHQAHVMIGSRGYNAYDDKRTALYLLNNILGGPGMNSRLNVSLRERRGLVYTVESNLTSYTDTGAFCIYFGTDPEDVDTCLKLTYKELKRMRDVKMTSSQLMAAKKQLIGQIGVASDNNENNALGMAKTFLHYNKYESSESVFRRIEALTAEGLLEVANEMFAEEYLSTLIYR

SEQ ID NO: 50706 - protein, 644 aa, Arabidopsis thaliana
MVERGKRTHNRFRDNNNDNNRNQRRRLSYESEEKKIDNKDDLVVVYRILCPSGVMGSVIGKSGKVINLIRQETRARIKVVDPFPGCSERVITIFCSVSEKKDIVDIEYSELDYSVPLCSAQAALLKVHDAIVASLATAAENTKIDRDDFRECRLLVPSSQCSIVIGKSGSIIKNIRGRTRANVKVVSKDASDPSHTCAMDFDNIVMISGETESVKKALFAVSAIMYKVSPREQIPLDTTVQEVPASIIIPSDLSIYPQAGLYPSQDSIFQHGANVSSFIGTLPQGYGENAANPLPVFSASALPVVHGFGGSSRSEKLAIKVICASSKIGRVIGKGGLTIKGIRQASGSHIEVNDSRTNHDDDCVITVTATESPDDLKSMAVEAVLLLQEKINDEDEDKVKMQLLVSSKVIGCIIGKSGSIISEIRKRTKADIHISKGNNTPKSADPNDELVEISGEVSNVRDALIQIVLRLRDDVLRDRETGSRNQPPARSENNNFFSSSSSNTGLALPQSFMSSVPQVASVDFDRRPETGSSMSMLPSSGGIYGYGSFPVGNTSYGSNSSYSSNLYGGLPQSTTMEVRIPANAVGKVMGRGGGNLDNIRRISGAMIEISDSKNSHGGRVALISGTSEQKRTAENLFQAFIMST

SEQ ID NO: 50707 - protein, 474 aa, Escherichia coli O157:H7 EDL933 [sequence omitted]

SEQ ID NO: 50708 - protein, 496 aa, Colwellia psychrerythraea 34H
MSIVGHLINGENRTDATRHQDIFNPSTGQVSNQLAIAGKATVEEAIEAANAAFPAWRATPPAKRARVMFRFKELLEQHADKIITLIGEEHGKISHDAQGELQRGIESVEYACGAPELLKGEHSRNVGPSIDSWSEFQPLGVVAGITPFNFPAMVPLWMYPMAIVCGNTFILKPSERDPSSTLFIAQLLEEAGLPPGVLNVVNGDKEAVDTLLHSPKIQAVSFVGSTPIAEYIYATASANGKRCQALGGAKNHAIVLPDADMDNAVNQLLGAAFGSSGERCMALSVAVTVGNAAGDALVAKMKQAMTGLKVGAHNDSSNDFGPVITKQHQEKVVGYINSAEEDGAKIVVDGRNPKIAGFSEGFFVGGTLIDNVTPEMISYKEEIFGPVLQVVRVESMQEAMNLIDAHEYGNGTCVFTRDGEAARYFSDHIQVGMVGINVPLPVPVAYHSFGGWKRSLFGDLHAYGPDSVRFYTKRKTITQRWPSTGVREGAEFAFPS

SEQ ID NO: 50709 - protein, 169 aa, Colwellia psychrerythraea 34H
MANHNQENSQQSDMAEKLIAVNRVSKVVKGGRIFSFTALTVVGDGNGRVGFGYGKAREVPAAIQKAMEKAHRNIVTIDLKGTTLQHVITGKHSGSKVFMKPASEGTGIIAGGAMRAVLEVAGVQNVLSKAYGSTNPINVVRATVSALVNMHSPEGMAAKRGKRVDEILG

SEQ ID NO: 50710 - protein, 455 aa, Physcomitrella patens subsp. patens
KRRRAAVVVLGDLGRSPRMQYHALSLARQAGLHVDVVALAGTEPHAGLLQHPYIHLHLMRAPFPQGLPRILYLLLLPVKLMIQFLTLVWFLCFQIPAPDFYLVQNPPSIPTLSVVRIACWLRQAAFIIDWHNFGYTILALSFSPRHLLVRLHTWYEKLNGKTADGYLCVTKAMQHELEQNWGIRYVKSVEKLSFYATLILSLCCDDEGEGPSVRVERSLFTVHTTAGDIDGEISGGDHCSYEEGRPALIVSSTSWTKDEDFGILLEAAVMYDRRVAALLGESDSASFNQTSDTYSYSRKPSPFPRLLIVVTGKGPMRAIYEERISKLRLQRVAIRTMWLSAEEYPLLLGAADLGVCLHTSSSGLDLPMKVVDMFGCGLPVCAVSYSCIDELVVNRHNGLLFSSSSELADHLLDLFKGFPDACNLLDTLRRGASESGSSSRWDDEWGEHVLPLLTQ

SEQ ID NO: 50711 - protein, 659 aa, Escherichia coli K12
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAAGKVKATAHKCDLCAGRENGPACVENCPADALQLVTDVALSGMAKSRRLRTARQEHQPWHASTAAQEMPVMSKVEQMQATPARGEPDKLAIEARKTGFDEIYLPFRADQAQREASRCLKCGEHSVCEWTCPLHNHIPQWIELVKAGNIDAAVELSHQTNTLPEITGRVCPQDRLCEGACTIRDEHGAVTIGNIERYISDQALAKGWRPDLSHVTKVDKRVAIIGAGPAGLACADVLTRNGVGVTVYDRHPEIGGLLTFGIPSFKLDKSLLARRREIFSAMGIHFELNCEVGKDVSLDSLLEQYDAVFVGVGTYRSMKAGLPNEDAPGVYDALPFLIANTKQVMGLEELPEEPFINTAGLNVVVLGGGDTAMDCVRTALRHGASNVTCAYRRDEANMPGSKKEVKNAREEGANFEFNVQPVALELNEQGHVCGIRFLRTRLGEPDAQGRRRPVPVEGSEFVMPADAVIMAFGFNPHGMPWLESHGVTVDKWGRIIADVESQYRYQTTNPKIFAGGDAVRGADLVVTAMAEGRHAAQGIIDWLGVKSVKSH

SEQ ID NO: 50712 - protein, 596 aa, Oryza sativa
  misc_feature (374)..(374): Xaa can be any naturally occurring amino acid
MKEEVKKEMRGKGGDKGREKEGRKRGRRRDKQEEEEKKEGVMGAVGAVLGALWVPGGVGWAGRGVWFGGGGVWLLRLQRSRVCSAAGGRCRAVVGGRGRVVGGCGGGGGAGGCGGGGLWVVVGGRWGVVVRAAVGWRGVGCVLGGCSRGVGRVRAVGVGLCALGLQGGREAALSRHPPLAVAVRRMMETLPAPRPTQIPRSTAIRPPCATPFSRAHWQTTCAAILATTTTTNAKAYGAPRVNGDSIKPALSDHAAPPLDLDLLPVSNLPRPLTITDLSPAPMHGSQLRVAYQGVPGAYSEAAAAKAYPSCDAIPCDQFEVAFQAVELWIADRAVLPVENSLGGSIHRNYDLLLRHRLHIVGEVQLPVHHCLLAXLPGVRRDLLTRVISHPQALAQCELTLNAMGLNVAREAFDDTAAAAEHVAAAGLRDTAAIASSRAAELYGLQVLADGIQDDAGNVTRFVMLAREPIIPRTDRPFKTSIVFAHDREGTSVLFKVLSAFAFRDISLTKIESRPHRHRPIRLVDDANVGTAKHFEYMFYIDFQASMAEVRAQNALSEIQEFTSFLRVLGSYPMDMTPWEYSSSSSPSPAPGGDTSR

SEQ ID NO: 50713 - protein, 285 aa, Nocardioides sp. JS614
MTCFDTADGTVLPVIGTKELIASMPVHLGLGPGDLVVYPELAYPTYEVGAALAGARALARDSLTSLGPERPALLWLNSPSNPTGRVLPPEHLKKVVDWCRERGTILVSDECYLECAWEDRPVSVLHPKVSGGSAEGILAVHSLSKRSNLAGYRCGFVAGDTALIGELLAVRKNLGLMLPGPQQVAMKAALDDDAHALEQHARYAARRAKLRDALLGAGFTIEHSEASLYLWATRDEDCWETVSWLAERGVLVAPGAFYGRAGGRHVRVAFTATDERVDAAVARLA

SEQ ID NO: 50714 - protein, 408 aa, Bacillus subtilis subsp. subtilis str. 168
MGLIVQKFGGTSVGSVEKIQNAANRAIAEKQKGHQVVVVVSAMGKSTDELVSLAKAISDQPSKREMDMLLATGEQVTISLLSMALQEKGYDAVSYTGWQAGIRTEAIHGNARITDIDTSVLADQLEKGKIVIVAGFQGMTEDCEITTLGRGGSDTTAVALAAALKADKCDIYTDVPGVFTTDPRYVKSARKLEGISYDEMLELANLGAGVLHPRAVEFAKNYQVPLEVRSSTETEAGTLIEEESSMEQNLIVRGIAFEDQITRVTIYGLTSGLTTLSTIFTTLAKRNINVDIIIQTQAEDKTGISFSVKTEDADQTVAVLEEYKDALEFEKIETESKLAKVSIVGSGMVSNPGVAAEMFAVLAQKNILIKMVSTSEIKVSTVVSENDMVKAVESLHDAFELSKHPSAV

SEQ ID NO: 50715 - protein, 215 aa, Zea mays
ASLECLASRGFLVSFGQSSGKPDPIPTSDLASKSLFLTRPSLMHYTATRDELLESAGEVFANVANGVLHVRVNHTYPLSEAAQAHAVKAFFVGGAVVGDVSLLSKILAALTTDNAGGVQESRRRCIGAAAGECTGQMTALIALFKNVCEHLKEKNVGADDTLWTGGPGNYTNPNAPAVLSKVRSLVENGKYPEATSAAYDLSGDQTQVFQPSWGY

SEQ ID NO: 50716 - protein, 395 aa, Vitis vinifera
MASYQPLKEKVAGESQTRGKPIRCRAAVSRKAGEPLVMEEVMVAPPMAGEVRIRIICTSLCHSDLTFWKLKEPPACFPRILGHEAVGVVESVGENVTEVAEGDTVLPIFIPDCGECMDCRSEKSNLCSKFPFEISPWLPRHKSSRFTDLKGEVLYHFLNVSSFSEYTVVDIDNITKISPAIPPNKACLFSCGVSTGVGAAWRTAKVEKGSTVVIFGLGAIGLAVAEGARLCGASRIIGVDTNLEKFDVAKKFGVTEFVNPRNCGDKPVSQAIVEMTDGGADYCFECVGFASLVQDAFASCRKGWGKAIMVGVDKPGAMLNFSSVEMLHCGKSVMGSIYGGLKPKSHIPVLLQRLVDKELNVDNFITHEMKFEDINKAFDLLAKGKSIRCVMWMDK

SEQ ID NO: 50717 - protein, 354 aa, Vitis vinifera
MVAPPLAGEVRIRIICTSLCYSDITFWKLKDPPGCFPRILGHEAVGVVESVGENVSEVTEGDIVLPIFLPDCGECTDCRSEKSNLCSKFPFKVSPWMPRYESSRFTDLKGEVLYHFLFVSSFSEYTVVDIANITKIDPNIPPNRACLFSCGVSTGVGAAWKTANVEKGSTVAIFGLGAIGLAVAEGARLCGASRIIGVDLNPDKFEIGKKFGVTDFVNSGNCGNKPVKQVIMEMTDGGADYCFECVGAASLVHEAFACCRKGWGKTIVLGVDRPGSMLNFLSFDILHSGKSLMGSLYGGVKPKSDIPILLKRYMDKELDVDKFVTHEMRFEDINKAFDLLIQGKSLRCVLWMDK

SEQ ID NO: 50718 - protein, 288 aa, Sulfitobacter sp. EE-36
MDVLISVVLPLGLAFIMFTLGVGLTPADFARVGQRPLAFFIGALNQSILLPLVTFICVLGFGIRAEMAVGFMILAACPGGVTSNVISKLAKGDVALSVSLTAVISLASVVTVPLILGLSMGYFMGDAAPEIDITKTAVTMFALTVVPVTLGLGARAMAPAAMTRAEPKLSAVATILFAVIVLAALAANWALFVENIVVIGPALLVLLAALTTIGFVVPRLLGRSVTEAKTISVETGVQNSTLGIAVAAIIVGGEGGFTAYALPSAVYGILMYLIILPVVLKYRRIGTA

SEQ ID NO: 50719 - protein, 106 aa, Castanea sativa
IRHYGRGNGVGFKPDILDMDVMEKVLEVSSEDAVNMARELALKEGLLVGISSGANTIAALRLANMPQNKGKLIVTIHPSFGERYLSSVLFEELRKEAENMQPVSVD

SEQ ID NO: 50720 - protein, 472 aa, Chromobacterium violaceum ATCC 12472
MSDLTFADLGLADPLLRAVADTGYTTPTPIQAQAIPQVLQGGDLLAAAQTGTGKTAGFTLPLLQLLMCSPSHHAGRPRALVLTPTRELAAQVEESVRTYSKYLPLKSLVMFGGVNINPQIKALRAPVDILVATPGRLLDHVGQKTVDLSGVEILVLDEADRMLDMGFIHDIKKVLAKLPAQRQNLLFSATFSDEIKALADKLLDNPKLVEVARRNTTNELVSQKVHLVDRDKKTELLIHLIREQNWFQVLVFTRTKHGANRLAEKLDKIGIPAAAIHGNKSQNARTRALADFKSGELQVLVATDIAARGLDIDQLPHVVNFELPNVPEDYVHRIGRTGRAGSPGEALSLVCVDEFSFLRDIEKLIKMSIERFTVPGFEADLNVKPEPIPMGGGARGRGQGQGRGGQGQGQRHGQGQGQPRNAPAKPRHQTESKPAGHGRNGGPRQGQGAGQGGRAAKPAAAKSALFSPPKNR

SEQ ID NO: 50721 - protein, 147 aa, Zea mays
MHTVALRTEATIPGGETPADLGQAFKNHMSEMFAYHATMMSNTLRTSIVVFTRTGFMAILLSHYRPSGTIFAFTDEERVRQRLALYQGVCPVQMEFSDDAEKTFGNALSYLLKHGMVKDGEEVALVQSGKHPIWRSQSTHNIQVRKI

SEQ ID NO: 50722 - protein, 339 aa, Oryza sativa Japonica Group
MDHEADAYRTDLMTITRYVLNEQSRNPEARGDLTILLSHIVLGCKFVASAVNKAGLAKLIGLAGETNVQAKEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 50723 - protein, 251 aa, Sinapis arvensis
ENQLCFDLIESWLAKNPDAASLKRNGQSIFRELALFQDYHGMPEFKKAMAEFMEEIRGNRVTFDPKKIVLAAGSTSANETLMFCLAEPGDAFLLPTPYYPGFDRDLKWRTGAEIVPIHCSSSNGFQITESALQQAYQQAHKLDLKVKGVLVTNPSNPLGTALTRRELNLLVDFIASKNIHLISDEIYSGTMFGFEQFISVMDVLKDKKLENTEVSKRVHVVYSLSKDLGLPGFRVGAIYSNDEMIVSAATK

SEQ ID NO: 50724 - protein, 212 aa, Oryza sativa Japonica Group
MSEADGGEGAKPKRPAPRLNERILSSLSRRSVAAHPWHDLDTGADAPAVFNVVVEISKGSKVKYELDKKTGFIMVDRVLYSSVVYPHNYGFIPRTLCEDNDPMDVLVLMQEPVIPGCFLRARAIGLMPMIDQGEKDDKIIAVCVDDPEYRHYNDLSELSPHRVQEIRRFFEDYKKNENKEVAVNEVLPVTAARDAIQYSMDLYAQYIEHLGQ

SEQ ID NO: 50725 - protein, 605 aa, Legionella pneumophila str. Lens
MFGFISDLLTAAVSSLDELLQDTPAHQIILGTAALYFLYNQYHNPSISRWYLSRNNASMKQRIIDSAYALAKNLPGVNQIIEKELNKELSSTREKLRIQRSGMTLREEIPEEGLSPQDILSAFDVDVEKCHFDFLSVNNDSPEREFLVGGGDGKDSGALYAIHPKELTELLKEVYGATALTNPLHDKWPRINAMQAEVIRWCQNLFHGSKEGYGLLTHGGTTSIIEAMAAYVIRARAKGIDYPEIVVPETAHAAFKKAAELTGAILITVPVDKKTGAVNPRVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIIKLRNAIQKELTALVEEGNGLTSEDIYVYGNPQWSILGFRSNTCNAHFIADELEKRGWKLNLLQNPDGFHLCLTHVHTLVRGFETQFIKDLREAVIDVKNYPPGKKASGNVKVYGAVGMMPIELQKEICKQYQKARLDFTAASHGSLGIFTTSPTEEDDGLRNRKVGEQKVQTSL

SEQ ID NO: 50726 - protein, 212 aa, Physcomitrella patens subsp. patens
MSPLPPPATQKPKKDNSTCWAIFCCCFTGCISMLITAAIVLGITALIIWLVLRPVHMPRYNIQDVNVVRFAYNSVPRTLDSEVRYVVNANNPNGKIGIRYETITIDTVYMTQNLNQHSIPGFYHGHRNVTLKPASFSTTGLPLDPGTGAILEGHIATGDVPLVMRVRVKFNLKIGAITTPTFTVKVNCNVHIKPPIGTTPASVLGSPTCKRV

SEQ ID NO: 50727 - protein, 133 aa, Zea mays
MAGRGKTLGSGVAKKATSRSSKAGLQFPVGRIARFLKNGKYAERVGAGAPVYLAAVLEYLAAEVLELAGNAARDNKKTRIVPRHIQLAVRNDEELSKLLGDVTIANGGVMPNIHNLLLPKKAGGASKPSGDDE

SEQ ID NO: 50728 - protein, 302 aa, Pseudomonas stutzeri A15
MTKPALTPAILALADGSIFRGESIGADGQTIGEVVFNTAMTGYQEILTDPSYAKQIVTLTYPHVGNTGTTPEDAESWKLWAAGLVIRDLPLISSNWRDKQSLPDYLKANGTVAIAGIDTRRLTRILREKGAQNGCILAGADATEEKALELARSFPGLKGMDLAKEVSVKERYEWRSTVWCLKDDAHAEIPASELPYHVVAFDYGVKYNILRMLVARGCRVTVLPAQTPASEALALNPDGIFLANGPGDPEPCDYAIKAIQQVLETDIPVFGICLGHQLLALASGAKTVKMPNGHHGANHPVQ

SEQ ID NO: 50729 - protein, 194 aa, Brassica napus
  misc_feature (160)..(160): Xaa can be any naturally occurring amino acid
MGMWWIVVVALLAHTASAAVREYHWEVEYKFGFPDCKEGMVMAVNGQFPGPTIHALAGDTIVVHLTNKLATEGLVIHWHGIRQLGSPWADGAAGVTQCAISPGETFTYNFTVDKPGTHFYHGHYGMQRSAGLYGSLIIDVAKGKKEPLRYDGEFNLLLSXDWWHESVLSQELGPSAKPMRWIGEAQVTLFLHYY

SEQ ID NO: 50730 - protein, 332 aa, Mesorhizobium loti MAFF303099
MLKYQDHRLAIAPMMDWTDRHCRFFHRQLTSRALLYTEMVVADAVIHGARERLLGFDDAEHPVALQLGGSDPAKLAEAARIGEAFGYDEVNLNVGCPSDRVQSGTFGACLMKVPDLVAGCVTAMKAAVAIPVTVKCRIGVDEQNPEPALDALADGVFNAGADALWVHARKAWLEGLSPKENRDIPPLDYNRVYRLKAKKPNEFIGINGGIQSLEEARAHLDHVDGAMLGRAAYHTPGILAGVDAGFYGAKPEAFDFAALIDAMADYAARHIEQGGRLGHVTRHMVGLFHGLPGARRYRQILSTDANRPGAGPDVLKTAFAAVEFSGAAAEAA

SEQ ID NO: 50731 - protein, 480 aa, Salmonella enterica subsp. enterica serovar Paratyphi B str.
MIMRQTKLYPVVMAGGSGSRLWPLSRVLYPKQFLCLKGDLTMLQTTICRLNGVECESPVVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRI

SEQ ID NO: 50732 - protein, 396 aa, Escherichia coli
MFENITTAPADPILGLADLLRADERPGKIDLGMGVYNDETGKTPVLTSVKKAEQYLLENETTKNYLGIDGIPEFGRCTQELLFGKGSALINDKRARTAQTPGGTGALRVAADFLAKNTSVRRVWVSNPGWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGTCTLVAADSETVDRAFSQMKAAIRVNYSSPPAHGASVVATILGNDALRAIWEQELTDMRQRIQRMRQLFVNTLQEKGANRDFSFTIKQNGMFFFGGLTKEQVLRLREEFGVYAVASGRLNVAGMTPDNLAPLCEAIVAVL

SEQ ID NO: 50733 - protein, 204 aa, Arabidopsis thaliana
MGLIVDDDNDGEVLIPPPNFSMVEDGIYRSGFPELENFGFLSTLNLRSIIYLCPEPYPEDNLKSLASNNIKLFQFGIEGKTDPPTPMPKDTVLSALRVLVDVRNHPILIHCKRGKHRTGCLVGCLRKVQNWCLSSVLEEYQKCAGLKWRQRDLRFIEDFDVLRLKQCLYSIIYQYNGYGLKRRKLLYQEENVVQEQQKPQATKG

SEQ ID NO: 50734 - protein, 511 aa, Bifidobacterium longum NCC2705
MGDPRGFLKVRTRRELAERPVEERIKDWFDVHAETGLQPWTQAQAARCMDCGTPFCMTGCPLGNLIPEWNDLVRQGKWEDAYNRLSMTNNFPEVTGRICPALCEQACVLGIHQPPTMIKLDEQTIIDQAWDLDYVKPLPPQRLTDQTVAVVGSGPAGLAAAQQLTRAGHTVVVYEKDDAIGGLMRYGIPNFKLEKGLLDRRVKQMEAEGTRFRTNVEIGKDITWDDLRDRYDAVVVAIGSRVPRDMKIPGRELDGIHFALDFLPDATRRIFGVKPVHDITAKDKHVIVIGGGDTGSDCLGTSIRQGAKDVTVLQIMPKEPSSRPDNSPWPTFARTYQKTSSMEEGGEYIYSTDSVNFEGTEEEKAKVTIDNSTTAEGFVADERGHVTGLKVVSVAPGENGPFTRQPGTERVLPADLVLISVGFLHPDTETILDQLPVELDKRGNIARNDKFATSQDGVFVCGDAGRGQSLVVWAIAEGRSCAAAVDEYLSKEKSELPAPIKASQRPMMLPR

SEQ ID NO: 50735 - protein, 181 aa, Physcomitrella patens subsp. patens
MASTVAASAVVAPTAFAAASPAASTSGSTTVKAFSGLKSATVFSGKAQNSSSVQNGSRVQCMQVWNPIGMTKFETFSYLPPLSDDAIAKQVEYMIQQKLIPCLEFDNANGVSRTNNSSPGYYDGRYWTMWKLPMFGCQDSAQVLREIEECKKTFPGCFVRVLGFDNVKQVQICGFLVARPN

SEQ ID NO: 50736 - protein, 252 aa, Streptococcus pyogenes M1 GAS
MSRKPIIAGNWKMNKNPQEAKAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEADSFLALLDFLN

SEQ ID NO: 50737 - protein, 287 aa, Arabidopsis thaliana
MERIQKDVTQSMRGIRVTEQQEHGSGVMELLQVVDIDSNVEDPQCCSLYAADIYDNIHVAELQQRPLANYMELVQRDIDPDMRKILIDWLVEVSDDYKLVPDTLYLTVNLIDRFLSNSYIERQRLQLLGVSCMLIASKYEELSAPGVEEFCFITANTYTRPEVLSMEIQILNFVHFRLSVPTTTTFLRRFIQPAQASYKVPFIELEYLANYLAELTLVEYSFLRFLPSLIAASAVFLARWTLDQTDHPWNPTLQHYTRYEVAELKNTVLAMEDLQLKHQWLYSRCHP

SEQ ID NO: 50738 - protein, 68 aa, Physcomitrella patens subsp. patens
MTTSKRLAEKKSAKFQKNVHRRGNVPETTLKKKNQYPVGPMVLGLFVFVVVGSSIIQIFRTATSGGMA

SEQ ID NO: 50739 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 50740 - protein, 382 aa, Physcomitrella patens subsp. patens
MVTLGFVQAVEEPWKMARQHFPCKIGGTPAWLDPINIPEGDNTQCGICDNPLGFLMQVYAPIGIDDVGYREEVFHRSLFLFVCPNMACLQQDQHHQLKKSPERPCRSVKVFRSQLPRTNRFYDYDPPSRDSSPATEAVPVCTWCGAWKATSVCGGCKQARYCSRVHQLAHWRGGHDSFCHAVRTMVQGVITRVTDTLLKSGIANAISDKIWPEVELIVGEEEDSMPSDAINTSRNPQQLLQDYEIRRENNGEEFTATDMEDVEESSREQQNWAAFQARLAGAPDQVLRYCRAQGAKPLWPSLEGQPKQSDITPCFNCGGPRIFEFQLLPQLLYFLQVQNETDNDSLDWATIAVYSCAASCNKSDSTCEGYVEEFAWVQLAVS

SEQ ID NO: 50741 - protein, 693 aa, Oryza sativa Japonica Group
MCTQKPPHDYSQQLYDKYRESFEEYITSMVLPSLRDKHDEFMLRELVKRWSNHKIMVRWLSRFFFYLDRYFISRRSLIPLEQVGLTCFRDLIYQEIKGQVKGAVIALIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKEEDLSRMYRLFSKINRGLEPIANMFKTHVTNEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLEREKDNANVYRYLA

SEQ ID NO: 50742 - protein, 265 aa, Thermosynechococcus elongatus BP-1
MIRDNPCGTLDQVKFRRGKSRGVRPKVLAGNWKMHKTQQEAVAFLQEFLGELVDTPSDREVVLCVPYTCLSVLSKSLHGTRVKLGAQNVHWADQGAFTGEISPPMLVELGVRYVIIGHSERRQYFGETDATVNQRLRAAQSHGLTPILCVGETKAQRAAGETENHIFQQLALDLVDVDQTNLVIAYEPIWAIGTGDTCEETEANRVIGLIRSQLHNPDVPIQYGGSVNANNIDAIMAQPEIDGVLVGGASLQPQSFGRIVNYKPL

SEQ ID NO: 50743 - protein, 507 aa, Cryptococcus neoformans var. neoformans JEC21
MSGLPPPSSSLPPPPRFDYGREDGYQGRPYDGPKDRAYDRDRDNWERDSRRDHQHRGPGGPRSRTPEGRGVRRLYDRENRSIEERIQQERPCRTLFVRNVQYDADPESLRLQFESFGQIKNFYEMVSKRGMIFISYFDSRAAQRARDAMHGTLVNRRPIDVHYSLPRSEEVTGACTAEKNQGTILVLLHPPRTLDINEIGRIAAQYGDIKDVVPGRVPSEIIVEYFDSRGAALFQQQMDRQPLLGGELELRFIWDKLDNNVPPPPAAVAKASRPSTDYDDRARGPPPRRDDAYNDSRGGRFGPRGGARERSPDYRDRRGSYETGYGGRPSGPSPGRYHDAPPAPASVSEDRLEQALRVQQLLNKIGNVNVPPVAATPPTAPPAPSYYRSPPVMPPSTTPYPPHGASYASYPPYPTPTPNAYGSKPPYVAPPFPPYPPPAAGGSVPPEGMGPLPGRQHPAGYGAPPPLPPFPPAGPTAQAIQPAATAPQGQQPVKDVGSLLAMLQGKQ

SEQ ID NO: 50744 - protein, 516 aa, Gentiana scabra
MPIKMSPIYATLTLHLAAALFLFFHVQKLVHYLHGKATGHRLPPGPTGWPILGALPLLGNMPHVTFANMAKKYGPVMYLKVGSHGLAIASTPDAAKAFLKTLDLNFANRPPNAGATHLAYNAQDMVFAHYGPKWKLLRKLSNLHMLGGKALENWADVRKTELGYMLKAMFESSQNNEPVMISEMLTYAMANMLSQVILSRRVFNKKGAKSNEFKDMVVELMTSAGYFNIGDFIPSIGWMDLQGIEGGMKRLHKKFDVLLTRLLDDHERTSHERKQKPDFLDFVIANGDNSDGERLNTDNIKALLLNLFTAGTDTSSSIIEWALAELLKNRTLLTRAQDEMDWVIGRDRRLLESDIPNLPYLQAICKETFRKHPSTPLNLPRIASEPCEVNGYYIPKGTRLNVNIWAIGRDPSVWGDNPNEFDPERFLYGKNAKIDPRGNDFELIPFGAGRRICAGTRMGILLVEYILGTLVHSFDLKLGLPEEELNMDETFGLALQKAVPLAAMLIPRLPLHVYAP

SEQ ID NO: 50745 - protein, 376 aa, Buchnera aphidicola (Cinara tujafilina)
MNKEYTISVLPGDGIGPEIMLQAYKILDIINKNCMIKINIHQYDIGGIALDKYGTALPQKTLDGCKKSDAILFGSVGGPKWSSLPANIQPERGGLLPLRKFFNFFINIRPAKLYKILGYLSPLKNEIVKNGIDIICVRELIGGIYFGSPKGRKKINSKNFYAFDTETYSTYEIERIATIAFQLASKRKNIVCSIDKANVLESSILWREVVTHVSKKFPNIKLTHLYIDNAIMQIIKKPNTFDVLLCSNLFGDILSDECAILTGSIGMLPSASLNDTLFGLYEPSGGSAPELTGKNIANPIAQILSLAMLFRYSLKLNDISNLIELAVLKTLKDGYRTFDITDNENYITTDMMGTKISKKLLQMIRKNEKNIISKNF

SEQ ID NO: 50746 - protein, 172 aa, Cyanidium caldarium
MKYTLSVLVEDEAGVLTRIAGLFARRGFNIESLAVGPAEQKGISRITMVVPGDDRTVEQLTKQLYKLVNILKVDNITEIPCVERELILVKINASTSSRPEILSILQVFRAKVVDLSENLLVLELTGDPGKVAAIQQLLQKFGIIEIARTGKIALTRTSKVNTEFLKSISMEI

SEQ ID NO: 50747 - protein, 501 aa, Chromobacterium violaceum ATCC 12472
MQSLKPGFELKSRYANYIGGRWVPPVNGRYFENVTPITGKPLCEIPRSDEQDVELALDAAHAARYAWGHTPVTERAIALNRIADRMEANLALLAEVETWDNGKPIRETRAADIPLAIDHFRYFASCVRAQEGSLGEIDANTVSYHFHEPLGVVGQIIPWNFPILMAAWKLAPALAAGNCVVLKPAEQTPLSILVLMELIGDLLPPGVLNVVNGFGVEAGKPLASSKRIAKIAFTGETGTGRLIMQYASQNLIPVTLELGGKSPNIFFGDVAAKDDAFLDKAIEGFVMFALNQGEVCTCPSRALIHESIYDRFMEKALARVAAIKQGNPLDPATMIGAQASQEQMDKIQSYLAIGRDEGAKVLAGGARAQLDGDLAGGFYIQPTVFHGHNKMRIFQEEIFGPVVSVTTFQDRDEALAIANDTLYGLGAGVWTRDMNTAFFMGRHIEAGRVWTNCYHAYPAHAAFGGYKQSGIGRETHKMMLEHYQQTKNLLVSYAEDKLGFF

SEQ ID NO: 50748 - protein, 296 aa, Mycoplasma genitalium G37
MLSAGIVGLPNVGKSTLFSAITNLQVEIANYPFATIEPNTGIVNVSDERLDKLASLINPEKIVYTTFRFVDIAGLVKGASQGQGLGNQFLANIREVDLICHVVRCFQDKKIVHVNNTIDPVFDFEIIVNELIQADFELITNRIGKLKRKAESGDKIAKEEFVLLEIVLNGLKQGQMPIQTLSESELKTIKSLNLLTAKPILIVANVSENDLLNLDNNEALKKLNAFLDQKKIPKAITVCSLIEKELSGLKLEQRQYFLDELGLKNYSGLNRVIQAAYQTLNLWSFFTFGKKEVRAW

SEQ ID NO: 50749 - protein, 380 aa, Arabidopsis thaliana
MMMSDLPLDLVEEILSRVSATSLKRLRSTCKQWNTLFKKRSFSQKHFHIAPKESMVLMLKEYRVCSMNINLNVSPPSVEFQGTLGIKDDSHSNLGQVEIVEVYHCDGLLLCATRDNRLVVWNPCLGETRWIQLKDECRRYSTFALGYENNKFCRRNYKILRYWGWFHDHIPDDGGRFRFEIYDFRSDSWKVLDDVPDDRFPPVSVVSLKGNTYWFGSNKKDFLRSFDFTTERFNHIGLPPSRDHGFMALSVVGEEQLSVLQEIETSKMEIFVTNKVGTEEAALLWSKSFIVDLPIGGHCSEVFASLLINEEKKVALCCNLDFETDGNLIFTIGEDNKYYSEIPYATNKPWWLCRFSEKFTKKWWWFPFIYNYVPSLVQIL

SEQ ID NO: 50750 - protein, 405 aa, Thermoplasma acidophilum
MAYIQVKDDGTLQVPDRVTIGYIEGDGIGPDISKTTINVLNAALEIAYGGKRSIEWKKILAGDEAYDKTGDRLPQSSLDELKKCVVALKGPLTTPIGEGFRSLNVTLRQYLDLYANIRPVRYFPGVPSPVVHPEYMNMVVFRENTEDLYAGIEWRYDSDGPKKVREFLASTFNINLTADTGIGIKPISKFKSTRLVRKAIQYAIANKRKSVTLVHKGNIMKYTEGAFKEWGYEVAKTEFGNYTVTETEYLQDPEKYSNKIVIKDRITDNMFQQVLTRTQEYDVIATPNLNGDYLSDALAAQVGGIGLAPGANIGDHYAVFEAVHGTAPKYAGMDVANPTSLILSGEMMLQHIGWNEAANILDEAIMQTYKDQKLTQDIARLLNVKALKCSEFGEEIINRMKKPVH

SEQ ID NO: 50751 - protein, 251 aa, Pseudomonas syringae pv. tomato str. DC3000
MRRPMVAGNWKMHGTRASVAELIEGLVKQALPGSVDIAVMPASLFTSRVIEGLQGTSIIVGAQDAAIQAEQGALTGEIASSQLADAGCKLVLVGHSERRQLIGEQDEVLNKKFAAIQASGLTPVLCIGETLEERKAGQTLEVVGRQLDSVIAEFGIGALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 50752 - protein, 483 aa, Arabidopsis thaliana
MSIPCLTEETAKTVLRQVEFYFSDSNLPIDDFLKKTVTESEDGLVSLALICSFSKMRGYLKLGDSKGDDIPEDTIKAVADTLRTSSALKISDDGKKVGRSTELLKLEDLIEQLNARTVAASPFSYDVKREDVESFFSQYGKIGYTSFWYMYVSSLQVNSVRMPRHVAESRIFSGVALVEFPTEEDAQNVMKQNLVFAGQELELKPKKEFDNEREKDEVKFANYQPQKGSANQKNGSDHKNNSAYEPDYPKGLIISFTLKRSAEEGTTEQKSSEEPTDKTMEESETKPADTPDADKENTGEVQAEGAEDEDDEKEEKGALATHKDNKDVVLREDLKAVFGKFGDVKFVDFKMGSETGYLRFDEPEASQKARAAAVLANEGGLAVKNFIAVLEPVIVKWSLVYIALCQAKLKRSIGLSYEAKIGLTRVAVEEGEFIFCLVLQIIIYLVYAGEEEEEGDSGERGDQIHRVVAGTNLRRWKHERFRS

SEQ ID NO: 50753 - protein, 151 aa, Nectria haematococca
MSTAARRRLMRDFKRMQTDPPAGVSASPVPDNVMTWNAVIIGPADTPFEDGTFRLVMQFEEQYPNKPPQVKFISEMFHPNVYATGELCLDILQNRWSPTYDVAAVLTSIQSLLNDPNTGSPANVEASNLYKDNRKEYTKRVRETVEKSWED

SEQ ID NO: 50754 - protein, 303 aa, Psychrobacter arcticus 273-4
MTLNLDDAKITAEVLTTALPYIQRFVDKLIVVKYGGNAMTDPALESSFARDIVLLKTVGMHPVVVHGGGPQVDNLLKELGRHSDRIDGMRVTDKSTMDIVEMVLGGSVNKSIVSLINKHGGCAIGLTGKDANLILAKKLMMEKIGTDGVAVPVDLGFVGDVVSVNKDVINMLIASDFIPVIAPLGVDEEGNTYNINADLVAGKVAEFLQAEKLMLLTNIKGVLGRDGEVVTGLTPKTVDSLIEDGTISGGMIPKIQCALDAVRSGVKSAVIVDGRVPHATLLEIFTNEGVGTLISRDLDLRSN

SEQ ID NO: 50755 - protein, 455 aa, Mycobacterium tuberculosis
MSAVALPRVSGGHDEHGHLEEFRTDPIGLMQRVRDELGDVGTFQLAGKQVVLLSGSHANEFFFRAGDDDLDQAKAYPFMTPIFGEGVVFDASPERRKEMLHNAALRGEQMKGHAATIEDQVRRMIADWGEAGEIDLLDFFAELTIYTSSACLIGKKFRDQLDGRFAKLYHELERGTDPLAYVDPYLPIESFRRRDEARNGLVALVADIMNGRIANPPTDKSDRDMLDVLIAVKAETGTPRFSADEITGMFISMMFAGHHTSSGTASWTLIELMRHRDAYAAVIDELDELYGDGRSVSFHALRQIPQLENVLKETLRLHPPLIILMRVAKGEFEVQGHRIHEGDLVAASPAISNRIPEDFPDPHDFVPARYEQPRQEDLLNRWTWIPFGAGRHRCVGAAFAIMQIKAIFSVLLREYEFEMAQPPESYRNDHSKMVVQLAQPAAVRYRRRTGVHHHH

SEQ ID NO: 50756 - protein, 535 aa, Burkholderia thailandensis E264
MPIIESKLNPRSDEFRANAAALEALVADLREKIDRLALGGGQAARDKHLSRGKLLPRERIAQLLDPGTPFLELSQLAAYGMYNDDAPGAGIVTGIGRIAGRECVIVCNDATVKGGTYYPITVKKHVRAQEIAAENRLPCVYLVDSGGANLPNQDDVFPDRDHFGRIFFNQANLSAAGIAQIAVVMGSCTAGGAYVPAMSDESIIVRNQGTIFLGGPPLVKAATGEEVSAEDLGGGDVHTRLSGVADHLAQNDAHALAIARTIVGNLGARSGASLAMREPLPPRYDAKSLYGVIPFDTRKPFDVREVIARIVDDSAFDEFKARYGTTLVTGFAHIWGHPVGIVANNGILFSESATKGAHFIELCCQRKIPLVFLQNITGFMVGRKYENEGIARHGAKMVTAVSTAKVPKFTVIIGGSFGAGNYGMCGRAFGPRFLWMWPNARISVMGGEQAASVLATVRRDGIEAKGGEWSAQDEEAFKQPIRDQYERQGHPYYASARLWDDGVIDPAQTRDVLGLALAAAMNAPIEDTRFGVFRM

SEQ ID NO: 50757 - protein, 477 aa, Bordetella pertussis Tohama I
MPVADRWQTQLQIGSIRAASTEPWLVSGRITRAAGLVLHTTGLRLPVGAACRIELARGHDHWADAEVVGFDGHTLYLMPQSDISGLPPGARVVPAEPAVQRPVPLPRKAELNGNAKPQVGRHLPVGNAMLGRVVDGAGRPLDGLGPLAGAEQAPLTALPINPLSRAPIDSVLDVGVRAINGLLTVGRGQRMGLFAGSGVGKSVLLGMMARYTRADIIVVGLIGERGREVKEFIEHNLGPEGLARSVVVAAPADVSPLLRLQGASYATRLAEHFRDQGLDVLLIMDSLTRFAMAQREIALAIGEPPATKGYPPSVFAKLPALVERTGMGAPGPNGKAGSITAFYTVLAEGDDQQDPIADSARAILDGHVVLSRHLAEAGHYPAIDIEASISRAMTSLITTEQFQQVRRFKQILSRYQRNRDLISVGAYVAGADPQLDDAIARYPRLEAYLQQNIGDSVDYGTAIDQLQRSLETREAYA

SEQ ID NO: 50758 - protein, 509 aa, Oryza sativa Japonica Group
MATCSWAATTAAAAPPRPPARCRSRVAALRRTAAASAAAASCVLAEAPKGLKVEQADAVEPAAAAAARRDVGPDTVASIILGGGAGTRLFPLTRTRAKPAVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 50759 - protein, 168 aa, Zea mays
MDSILSSSPLPGGEEEEGFTLNPSDPGVSGVMQFLRGSGGGGGGGGFPGVAWEVLRRHFSKKRSVDVRRINPKVPKEEAVAISGRLLQILSDHGPLTVGNTWNHAKDAGIAGLNSKTHMKILLKWMTGRNVVKLTCVHVGNAKKFLYSPSTESSSSAGASPSSTSASQ

SEQ ID NO: 50760 - protein, 373 aa, Thermosynechococcus elongatus BP-1
MGSWPSWDCSASSCNGWPNPWGSAMKAAVLYGKEDVRIETVPDPTPGPGEVVIRVRAATTCGTDLKVWRRGGHARMLTPPILFGHEAAGEIVALGAGVTGWQVGDRVVANNSAPCGQCFYCQRQAFSLCPHLEFNNGTFAEYLKLPASIVRQNLLPIPESLPFALAALTEPLACVLHGVARSGFDPAMVATWPSPPQIVVLGDGAIGLMFVGVLAQQGARVLAFGGSNQRLAIATTFGAEQTINHHQCGDIPAVVKDWTEGRGADIVIEATGVPEVWETAIACGRPGATINLFGGCPRETTIRVDTERLHYEELTLKGVFHNTPSFVRQALQLIASGTLPFEKLISGQAPLMEIETVLQAMKARQVIKVALQP

SEQ ID NO: 50761 - protein, 496 aa, Leptospira interrogans serovar Lai str. 56601
MNYTRGALSMPTLQESPVKLPNSNQPPSVNKAEIERVFNLQKKHFHKVMKLTTAGQRIQRLKKLKEAIFKYSPEIEKAVHSDFRKSEREVDITEIMPSISEINDAIKHVRRWMKPVDVKTPMTLFGSKSQIIYEPRGVVLIIGPWNYPFYLTFAPLAAAIAAGNTVLIKPSEFTPVTSNLIQKIISEVFPKEEVAVFEGDYQVSGALMELPLDHIFFTGSTHVGKIVMTAAAKHLTTVTLELGGKSPAIIDKSADIKKAAKKLIWGKVLNAGQTCVAPDYLLIPNELIKPFVEEAKTVIKEFYGNSLKENSDFCRIVNDRNFNRVSGYIHEAVEKGAKIEMGGDTDASQNYIEPTLLSNVPENSNIMEDEIFGPVLPMIPYTNLDEAIEKINSKPKPLALYIFGKKDRSIKKILKETSSGGVAVNDVILHLANPNLPFGGINHSGHGSYHGYFGFKAFSHERSVLRQAALSSIDLMYPPYTNFVKRLVSFTKKFLV

SEQ ID NO: 50762 - protein, 316 aa, Physcomitrella patens subsp. patens
MGSAVSYCSPQQIQTVDLCGSEGKAPESTNLPCPVKYEEINHEAYMSLKPGLFEGLRFDVYRSMNRKFGLSNSLFMGSVDLPDCAPDPLKQSTAHFELGANLIDQKMDVVLMMGRVLSKGCMSARVKCDITNRFSIKANAELTNEPHFSVGMFNFDYKGNDYQAQLTMGNSAFYSVNYTQQRVTPKLSLGGEWMWFGHQRKSCMGLAARYQTDSVITTALVKSEGDICCTYIQKLSDKVLVASDFVYNWNSTEAVTSIAYDHLLNQYRIRGRIDTNLCTAAYLEEKISAGLTLVLSAELDHRKKDYKFGFGLTVGD

SEQ ID NO: 50763 - protein, 378 aa, Cryptococcus neoformans var. neoformans JEC21
MLANSIRSSVAGSLRNASAKRVPVARTMATLVDEKRLPSKFGGKYTVTLIPGDGIGQEVADSVKEVFDALKVPVQWEQYNVSGETTGGEALFQEAMDSLKRNKVGLKGILYTPVDQSGHNSWNVAMRQQLDIYASVVVCKSLPGLATRHSNVDFAIIRENTEGEYSGLEHQSFPGVVESLKVSTRAKAERIARFAFDFALKNNRKKVTCVHKANIMKLGDGLFLNTCKRVAEQEYGHTGIKFESMIVDNTAMQLVSKPQQFDVMVMPNLYGAISTNIGSALVGGPGITPGCNFGREYALFEPGCRHVGKDIMGTNKANPIALMLSATMMLRHLGLESQANLIAGATYDLVKEGKIRTADIGGNATTTDVTKALINRLL

SEQ ID NO: 50764 - protein, 526 aa, Physcomitrella patens subsp. patens
MQATQLLLEEPIRLASILEPSSPTAFSALTKIIGTLGPQSRDVETIEALLKAGMSVARFDFSWGNDAYHQETLENLKKAVRNTRLLCAVMLDTIGPELCVLNKEEHVIELQEGATVVLTADETRGASAEVLPLNYDGLASAVTKGDTIFLGQYLFTGSETTSVWLEVVETQGKDVVCTVKNTATLTGSLFTAHVSQVRIELPTLSEADLKTMATWGVKNQIDFVSLSYTRHPDDVRACREYLDKLGDLRQTQIFAKIENYEGLAHFDEILEEADGIILSRGNLGIDLPPEKVFLFQKVALQKCNAAGKASIVTRVVDSMVDSPRPTRAEATDVANAVLDGTDGIMLGAETLRGLYPVETITTIRKICAEAEKVFNQAVYFKRTIKAVREPMQHLESIASSAVRAASKVRASVIVVFTSSGRCARLIAKYRPTMPVLCVVIPRLTTNHLKWSFTGAFQARQCLAVRGLFPMLADPRHSSDSASTTNESILKVALDHGKAAGIVKAHDRIVVCQKVGDSSVVKIIELD

SEQ ID NO: 50765 - protein, 512 aa, Vitis vinifera
MRLLSASVTITGTHPFFLYKLNFLRTFYSTYNLIKIMYWSVWLCVVSLFIASIIHWVYKWRNPKCNGKLPPGSMGFPLIGETIQFFIPSKSLDVSSFIRKRMKKYGPLFCTNLVGRPVVVSSDPDFNYYIFQQEGRLVEIWYLDSFARLVGQDASQSTAASGYVHKYLRNLVLAHFGTEVLKDKLLSKAEDMIRTRLHDWSKLPALEFKTCVSSMIFDFTANELFSYDIKKMGENFSERFTNIIQAVASFPLNIPGTTFHKCLKNQKEVIKLIRDILKERKVSPESRKGDFLDQIVDDIKKEKFLSDDFIVLVMFGILLASFETISATLTLAVKLLIENPSVMQELIEEHEAILKNRENSNSGISWKEYKSMTFTHQVINEALRLASVAPGILRRAIKDIQVNGYTIPAGWTIMVVPAALQLSPDAFVDPLAFNPSRWKDMGVGVVAKNFIPFGGGSRLCAGAEFTKVLMTTFFHVLVTNYRLTKIKGGQIARSPALTFGNGLHINISKKHG

SEQ ID NO: 50766 - protein, 393 aa, Triticum aestivum
  misc_feature (121)..(121): Xaa can be any naturally occurring amino acid
  misc_feature (356)..(356): Xaa can be any naturally occurring amino acid
MVHRGPRLRAEPAPISATNLSCIKPRGLRLPPPPTSSRTTSDSRHFVQLRPREDRFAAKSLVDGGMGEASTPAIAKDVTELIGNTPLVYLNKVTDGCVGRVAAKLESMEPCSSVKDRIGYXSMITDAEEKGFIVPSKSVLIEPTSGNTGIGLAFMAAAKGYKTCTQQWPASMSMERRIILKAFGAELILTDPLLGMKGAVQKAEELAAKTPNSYILQQFENPANPKIHYETTGPEIWKGTGGKIDGLVSGIGTGGTITGTGKYLKEQNSNIKLYGVEPTESAVLNGGKPGPHKIQGIGAGFIPGVLDVDIIDETIQVSSDESIEMAKSLALKEGLLVGISSGAAAAAAIKVAQRPXENAGKLFVVVFPSFGERYLSSVLFHSIKKEAESMVVE

SEQ ID NO: 50767 - protein, 48 aa, Castanea sativa
SFGQAAVYFGAGYVDLPDVFKVGFIMAVINTIIWGVVGAFWWKFLGLY

SEQ ID NO: 50768 - protein, 185 aa, Bacillus thuringiensis serovar konkukian str. 97-27
MNKQKFYTNLSKEVSYALRHAQWKYELELDENGWVSVEQLLHALHQSIEWRDVKIEDLKIMIEKSEKKRHELKENKIRALYGHSIPMKIVKEEGVPPEFLYHGTSPRFLNSIESNGLSPMSRQYVHLSEDIITAELVGKRKDKHPIILEVNTGKAREEGVKFYLGNEKVWLADEIPSEFIAINKN

SEQ ID NO: 50769 - protein, 125 aa, Castanea sativa
AHVLVPGISLMGGYDSLKPVLLTGDLADSFFASFALGWLITNGAGLASYPIDTVRRRMMMTSGEAVKYKSSLDAFSQILKKEGPKSLFKGAGANILRAVAGAGVLAGYDKLQLIVFGKKYGSGGA

SEQ ID NO: 50770 - protein, 378 aa, Pseudomonas syringae pv. tomato str. DC3000
MTKPAILALADGSIFRGEAIGADGQTVGEVVFNTAMTGYQEILTDPSYAQQIVTLTYPHIGNTGTTPEDAESDRVWSAGLVIRDLPLVASNWRNKMSLGDYLKANNVVAIAGIDTRRLTRILREKGAQNGCIMAGDNISEEAAIAAARGFPGLKGMDLAKEVSTKDTYEWRHSVWNLQTDSHPEIAASELPYHVVAYDYGVKVNILRMLVERGCRVTVVPAQTPASEVLAYKPDGVFLSNGPGDPEPCDYAIKAIKQVLETEVPVFGICLGHQLLALAAGAKTVKMGHGHHGANHPVQDLDTGVVMITSQNHGFAVDESTLPGNVRAIHKSLFDGTLQGIELTDKSAFSFQGHPEASPGPNDVAPLFDRFIDAMAKRR

SEQ ID NO: 50771 - protein, 435 aa, Heliobacillus mobilis
MFIFVVGLNHKSAPVEIREQLSFPEHILESSLHRLKSEPGIEGCAILSTCNRTEIYAATTDLEKGQAAVKRSFPTRAPCRKTTLPIAFTLTPFMMRYVIFSGCLLVWISMVLGETQILGQVRRAYQAACDYGTSNGIINTWFQQAITVGKRVRTETGIDQHAVSISYTAVELARQVFDSLEGRTALILGAGKMSELTLTHLIANGVTTVLVANRTRERADELARKCGGKAVSFAELEQHMGVADIVISCTAATHYVIRRNLVETVMAKRPERPLFLIDIAVPRDIEPAVGTVQSVHLFDIDDLNSVVDRNLAERQKAASQAEVIIEEEIHEFIKWLNSLFVVPTIVALRNKGDAIKEKELERVLGKLKSLSEKDKKTLGAMASSIVKQLLHDPVIQIRHYAASPEGHLYSEILQNLFSLDIAGQRPKGCDDNNLR

SEQ ID NO: 50772 - protein, 380 aa, Pseudomonas syringae pv. tomato str. DC3000
MAKRDYYEVLGVERGSSEADLKKAYRRLAMKHHPDRNPDDKASEEMFKEANEAYEVLSDASKRAAYDQYGHAGVDPSMGGGGGFGGGAGGANFSDIFGDVFSDFFGGGRGGGGGGRGGAQRGSDLRYTLELNLEEAVRGTTVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGAQGGPTGDLYVVINVREHAIFQRDGKHLFCEVPISFTDAALGGELEVPTLDGRVKLKIPEGTQTGKQFRLRGKGVAPVRGGGAGDLMCRVAVETPVNLSKRQRELLEEFRTSLENDESHSPKASGWFEGVKRFFGDL

SEQ ID NO: 50773 - protein, 504 aa, Oryza sativa
MVSAAAAASSLRCFPPSLGNRGPGAATARGGLVRLSSRRARSTAGVAAPSREAESAASLGDLTRVDFPILDQEFDGSKLVYFDNGATSQKPSCVMKTLDEYYRFYNSNVHRGIHVLSAKATDAYESARTKVANFVNAANSREIVFTRNATEAINLVAYSWGMSNLKQGDEIVLTIAEHHSAIVPWQFVSQKTGATLKYVGLTKEGVPDIEQLKGLLSNKTKIVVVHHVSNVLVSKFLDRCDRGTWYASCERFLQGGDENVPCSWNMEDVPGLRNASFDPVFCDFGFLLGLVEWGSLSLLLPLALLVLLCSSSMLPIEDIVTWSNRIGAKVLVDACQSVPHMPVDVQRLGADFLVASSHKMCGPTGVGFLHGKFDLLSSMEPFLGGGEMIADVFQDKSTYAEPPSRFEAGTPAIGEAIGLGTAIDYLSQIGMQKIHEYENELATYLYESLIAVPNVRIYGPAPCQTVHRAPLCSFNVENVHPTDIAEILDLQVCILSTTNLRCKC

SEQ ID NO: 50774 - protein, 394 aa, Bacillus cereus E33L
MNKKSIRDVDLKGKRVFCRVDFNVPMKEGKITDETRIRAALPTIQYLVEQGAKVILASHLGRPKGQVVEEMRLTPVAARLGELLGKDVKKADEAFGPAVQEMVAAMNEGDVLVLENVRFYAGEEKNDAELAKEFAALADIFVNDAFGAAHRAHASTAGIADYLPAVSGLLMEKELEVLGKALSNPERPFTAIIGGAKVKDKIGVIRHLLDKVDNLIIGGGLAYTFVKALGHEIGLSLCEDDKIELAKEFMQLAKEKGVNFYMPVDVVITEEFSETATTKIVGIDSIPSNWEGVDIGPKTREIYADVIKNSKLVVWNGPMGVFEMTPFAEGTKAVGQALADAEGTYSVIGGGDSAAAVEKFGMADKMSHISTGGGASLEFMEGKELPGVVCLNDK

SEQ ID NO: 50775 - protein, 479 aa, Salmonella enterica subsp. enterica serovar Paratyphi B str.
MSFLPVIMAGGTGSRLWPLSREYHPKQFLSVEGKLSMLQNTIKRLASLSTEEPVVICNDRHRFLVAEQLREIDKLANNIILEPVGRNTAPAIALAAFCALQNADNADPLLLVLAADHVIQDEIAFTKAVRHAEEYAANGKLVTFGIVPTHAETGYGYIRRGELIGNDAYAVAEFVEKPDIDTAGDYFKSGKYYWNSGMFLFRASSYLNELKYLSPEIYKACEKAVGHINPDLDFIRIDKEEFMSCPSDSIDYAVMEHTQHAVVIPMSAGWSDVGSWSSLWDISNKDHQRNVLKGDIFAHACNDNYIYSEDMFISAIGVSNLVIVQTTDALLVANKDTVQDVKKIVDYLKRNDRNEYKQHQEVFHPWGKYNVIDSGKNYLVRCITVKPGEKFVAQMHHHRAEHWIVLSGTARVTKGEQIYMVSENESTFIPPNTIHALENPGMTPLKLIEIQSGTYLGEDDIIRLEQRSGFSKEWTNERS

SEQ ID NO: 50776 - protein, 462 aa, Solanum tuberosum
MASTMFSLASVTPSASISLQDNLKPKLKLGTSSQRAFPRKDFMKAKSNGQTTMAVAVNVSRFEGITMAPPDPILGVSEAFKADTNELKLNLGVGAYRTEDLQPYVLNVVKKAENLILERGENKEYLPIEGLAAFNKVTAELLFGKDNPVLQQQRVATIQGLSGTGSLRIAAALIERYFPGSKILISSPTWGNHKNIFNDARVPWSEYRYYDPKTVGLDFAGMIEDIKAAPEGSFILLHGCAHNPTGIDPTPEQWEKIADVIQEKNHIPFFDVAYQGFASGSLDEDASSVRMFAARGMELLVAQSYSKNLGLYGERIGAINVLCSSAYAATRVKSQLKRLARPMYSNPPIHGAKIVANVVGTPELFSEWKEEMEMMAGRIKSVRQKLYDSLSAKDKSGKDWSFILKQIGMFSFTGLNKAQSENMADKWHVYMTKDGRISLAGLSAAKCEYLADAIIDSYYNVS

SEQ ID NO: 50777 - protein, 431 aa, Bacillus cereus E33L
MSTIIDVYAREVLDSRGNPTVEVEVYTESGAFGRAIVPSGASTGEHEAVELRDGDKSRYLGKGVMNAVNNVNEAIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERLGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 50778 - protein, 316 aa, Bacillus cereus E33L
MPKKVLIFCDPGIDDTMALLLAFFIDEIEIIGIVADYGNVPKEMAVQNAHFLTNETRNRNIKIFGGSERPLTGAPPAFFTDVHGKQGLGPIIPKGNLANSEMENFFEVIPLIEQYKDELIIVSLGRLTSLAILFIMCKQLMKQIKSYYVMGGAFLHPGNVTPISEANFYGDPTAANIVLQSAANMYIYPLNVTQYSIITPEMAEYIEAKGKAPLVKPLFDHYYYGYYKNALPDLKGSPFHDTMPILALLDNSMFTYHKSPIVVMAESYAQGASIGEFRSLGKPKPFMDWPSHQIAIDFDYNRFFKHFMSLMTDEEF

SEQ ID NO: 50779 - protein, 355 aa, Dianthus caryophyllus
NSTKIAPSRVETLASSGIECIPKEYVRPEEELTSIGDVFEEEKKDDGPQVPTIDLKDIASEDPEVRAKAIHELKKAAMEWGVMHIVNHGISEELINRVKVAGETFFEFPIEEKEKYANDQDSGNVQGYGSKLANNASGQLEWEDYFFHLAYPEEKRDMSIWPKSPEDYIPAVSEYSKELRSLATRIFSALSVALGLEEGRLEKEVGGLEELHLQMKINYYPKCPQPELALGVAAHTDVSALTFILHNMVPGLQLFYEGKWVTAKCVPNSIIMHIGDTIEILSNGKYKSILHRGLVNKEKVRISWAVFCEPPKEKIILKPLLDLVNESDPAQYPPRTFAQHIQHKSSERLRMSNPQ

SEQ ID NO: 50780 - protein, 432 aa, Thermosynechococcus elongatus BP-1
MTATLTSTTETAYFTHLKCKECGAEYEPQAIHVCEYCFGPLEVKYDLERLAAAVTRSTIEAGPKSIWRYRPFLPVTSAEPIDVGTGMTPLIKAQRLARRLGLKHLYIKNDAVNMPTLSFKDRVVSVALTRARELGFTTVSCASTGNLANSTAAIAAHAGLDCCVFIPADLEAGKVLGTLIYGPTVMAVEGNYDQVNRLCSEVANTHGWGFVNINLRPYYSEGSKTLGYEVIEQLGWQLPDHIVAPLASGSLFTKIYKGFREFVAVGLVADKPVRCSGAQAVGCSPIAQAYAEGRDFVAPVKPNTIAKSIAIGNPADGVYALEIARKTNGAIAAATDEEIVAGIKLLAETEGIFTETAGGTTIAVLKKLVESGKIDPEEVTVVYITGNGLKTQEAVQNDIGQPLRIEPKLASFERALERSRTLERLDWQPVLV

SEQ ID NO: 50781 - protein, 141 aa, Xanthomonas campestris pv. campestris str. ATCC 33913
MALERTLSIIKPDAVAKNVIGEIYSRFEKAGLKVVAAKYKQLSRREAEGFYAVHRERPFFNALVEFMISGPVMIQALEGENAVAAHRDLLGATNPKDAAPGTIRADFADSIDANAAHGSDSVENAANEVAYFFAATEVVSR

SEQ ID NO: 50782 - protein, 728 aa, Oryza sativa Japonica Group
MEPWTRCSCCLTESGSLPSACFTNSRKSRPLPKSHQRVHPKSIHESLPHSNCLPPPSKSNLSSHLRRFRHAPSTPRSILSPPIRSNPQLGSTNCKGLGADWSMGLRSPNSMLWLVLLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIDFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIADPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGHCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRRYMDSEIRAIMAQYMPLDNQGDVPNHSHHIEL

SEQ ID NO: 50783 - protein, 499 aa, Bradyrhizobium japonicum USDA 110
MADYDLAIIGGGLNGVSLARDAAGRGLRVILFEQGDLGGAASSATPRLIHGDLSVLERRGFWRVRRALAERRIWLRIAPHLVRPMRFVIPAHSEERPPWLLRAGLYVYDGLTNRGGLPPSATLDITHHPVGNALKRPFGTAFEYSDCVVDDSRLVVLTALDAAERGAAIHTGARCVRADRTDTWRLAVVDRGHRRTITARALANATGGWTSMVADTVLREPQPAMAAMQMSQIIVPRLFDSENVYVFQNNDGRLIFARPLERDFTLIGTVTHAFTGDPAIVAMPGADVSYLCEAASRYFRERVAPTDVVRTVSGVNLTLASARGRDGTALFHARRRKAPLITMFGGDVTTSRLRAERAVTRLTPFYPMSPPWTDGAVLPGGDFAWDRFDTEVDLARDRWRFLSEPEAQRLVAAYGSRLPAVLGEARTRDELGPTFGPELTGAEVRYLMSHEWARFPEDVLWRRSKLGLTMPKADRDGLAAFMADVNDRPEPVEQRPIGR

SEQ ID NO: 50784 - protein, 264 aa, Zea mays
KKLQFPLQKQELPADYTHLGARMADLRPPEPGTNGSSAVVVAALPAVEAAKAAAAAAAAACGAQPPAPPYSKRRRRPSVRLGDIDAPPPRRNHKPSSSSHSRPPRRPHPDDPDTHGGRGPKPPAQRRPRTAWIPAGPAEGCYDDEERYYDDEDQSDSAAAAAAAAAMARVSGSRDAGGDESDGVADWGLPNGRLSSAMRHGRVKAWLDGLGLSRYAPVFEIHEVDGEVLPLLTLEDLKDMGIGAVGSRRKMYAAILKLRSDNAS

SEQ ID NO: 50785 - protein, 119 aa, Rhodopseudomonas palustris CGA009
MSDVKVLTGGCHCGLVRFECTTDLTMVTACNCSICTKKGLHFTFLPPKSFQLRAGQDSLKEYLFNKRAISHQLCSECGVEVFARGTKPDGTQVVALNVACIDGIELSQLKMTPIDGRHR

SEQ ID NO: 50786 - protein, 542 aa, Sorangium cellulosum
MRDAHCEPRGASGKLPPRFRANEEPLMAQAFPASPTTTPSTRTLVVQSPIDGSRLGEVPLMGDAEVHAAVERARLAQRAWAQLPIETRAGRVARVIDAFVERLDDLVDAVVLETGKPRNDALAEWITVVDACHYFTRHAGRILADTSITLHHMKWRGSYVTYVPMGVVAVISPWNLPLAIPMGSVIEALIAGNAVVVKPSEVTPLTLLKAKEVVDAIGIPTDLFQVVTGDARTGAALIDAGVQKVVFTGGVSSGRRVGAACAERLIPCVLELGGKAPLIACDDCEIERTARSIVAGGFINSGQLCISVERVLATEAVHDRLVDRVVALTRELRQGDPRADDVDVGAIIFAKQMDIAEAHIKDAVARGALVATGGRRRPGPGMFFEPTVLTRCTPEMTVMREEIFGPVVPIMKVRDEDEAVRIANDSPLGLHAYVFSRDKTRARAVAERIEAGTVMINDVLVSYCAPEAPFGGIKNSGYGRVHSDDSLRAMCYARHVNHERFAMPLNSPLLFPYTTAKYRGMRAAIRATFKRTPLLGRLADLL

SEQ ID NO: 50787 - protein, 468 aa, Klebsiella pneumoniae
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPHAQPAGDKAEFIEKVRRALYLGKIVSYAQGFSQLRAASDEYNWDLNYGEIAKIFRAGCIIRAQFLQKITDAYAKNAGIANLLLAPYFKQIADDYQQALRDVVAYAVQNGIPVPTFSAAIAYYDSYRSAVLPANLIQAQRDYFGAHTYKRTDKEGIFHTEWLE

SEQ ID NO: 50788 - protein, 296 aa, Klebsiella pneumoniae
MANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMVARFNETGRSQVLAKRMPGDLSEYSVIQTKEPMVAEGQVARIVEFIEKPDEPQTLDSDLMAVGRYVLSADIWAELERTEPGAWGRIQLTDAIAELAKKQSVDAMLMTGESYDCGKKMGYMQAFVTYGMRNLKEGAKFRESIKKLLA

SEQ ID NO: 50789 - protein, 178 aa, Glycine max
  misc_feature (91)..(91): Xaa can be any naturally occurring amino acid
  misc_feature (100)..(100): Xaa can be any naturally occurring amino acid
  misc_feature (122)..(122): Xaa can be any naturally occurring amino acid
  misc_feature (149)..(149): Xaa can be any naturally occurring amino acid
MASSMISSPAVTTVNRAGPGMVAPFTGLKSMAGFPTRKTNNDITSIASDGGRVQCMQVWPPVGKKKFETLSYLPDLDDAQLAKEVEYLLKXGWIPYLEFXLKHNFVYHKHNKSPIYYNKRYXTICKRAIFICTNTSHILNKRARTNTTXGNNCIRMITCGRHRQLQYISCISYERPSY

SEQ ID NO: 50790 - protein, 283 aa, Glycine max
  misc_feature (107)..(107): Xaa can be any naturally occurring amino acid
KHHDVTVKDEKTLLFGDKAVTVFGHRNPEEIPWGSTGADIIVESTGVFTDKDKAAAHLKGGAKKVIISAPSKDAPMFVVGVNEHEYKPELDIISNASCTTNCLAPLXAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDNRSSIFDAKAGIALNKNFVKLVSWYDNEWGYSSRVIDLLVIVAKKSF

SEQ ID NO: 50791 - protein, 388 aa, Salmonella enterica subsp. enterica serovar Paratyphi B str.
MKITISGTGYVGLSNGLLIAQHHDVVALDIVPSRVELLNDRISPIVDKEIQQFLKEDNIRFRATLDKFDAYQNADYVIIATPTDYDPKTNYFNTSSVESVIQDVISINPAAVMIIKSTVPVGFTAAMRQKFATENIIFSPEFLREGKALYDNLYPSRIVIGEQSERAREFAALLQEGAIKQEIPTLFTDSTEAEAIKLFANTYLAMRVAYFNELDSYAETLGLNTRQIIEGVCLDPRIGNHYNNPSFGYGGYCLPKDTKQLLANYQSVPNNIISAIVEANRTRKDFIADAILARKPKVVGIYRLIMKSGSDNFRASSIQGIMKRIKAKGVEVIIYEPVMEEDTFFNSRLERDLHCFKQQADVIISNRMAAELLDVAEKVYTRDLFGSD

SEQ ID NO: 50792 - protein, 319 aa, Debaryomyces hansenii CBS767
MSESGWNTIDSDAGVFTELVDKLQIKNVQFDDLYSIDSDSLKSSSPLYGVIFLFKYGQVDRDYAADNNKPIDGTYDEDYQQKGIFFANQTIQNACATQAVLNVLLNKSEIEIGEELTNFKGFVEGFDSEICGETISNSELIRSVHNSFSSPSLMVDEDKQKPKPKYDDKNDGLFHFVGYLNINDQIYELDGLKTYPIKHGECKSNEEFCQKLPEILMRRISKYGDELRFSLLAISNDKLRQYQEIGDVAMMHSEMMKRETWKRENELRRHDFVGLMVELLKNIGKDLSDDEYEDIIKQARHKGQLKLLQNFTQNHVANN

SEQ ID NO: 50793 - protein, 493 aa, Psychrobacter arcticus 273-4
MQAKELLELERREIKALHYTWIAFFLTFYVWFNMAPLATSMLQTESYLTPDHIKLFLIANVALTIPGRVVVGMALDRFGPRRVFSILMVVMAIPTWFFAFGTSAMQLFVARLFMSIVGAGFVVGIHMTALWFKPKDIGFAEGFYAGWGNFGSAAAAITIPTVALQFFGGDDGWRWAIALSGLIMAAYGVVYWFLITDGPTADTHKKARSAGALEVSTWKDLLLYCLFIVPLYGVLSLLVYRTQGMGFLSATGAWVCYGVIGLMVLYQIYKAISVNVPIIKAGIPEDDKYPFTSVAALNVTYFANFGAELAVVSMLPMFFAATWTLDPTVAGLVASTFAFVNLWARPLGGYISDRVGNRRLVMLVYMFGIGIGFGLMGLLNAEWPLFIAVVFTILCSVFVQGAEGATFGVIPSIKRRLTGQISGLAGAYGNVGAVFYLFVFTLVEPNQFFFIIAIGAFIAWVLCFFWLKEPEDAFGDDYKMSSVDIQIAKEHNG

SEQ ID NO: 50794 - protein, 272 aa, Pseudomonas aeruginosa UCBPP-PA14
MSSTIHPLPSFGLGTFRLTGQVVVDSVRSALELGYRAIDTAQIYGNEADIGRAIAESGVPRSELFLTTKVWVDNYACEKLLASLRESLEKLRTDRLDLVLIHWPAPGNGVELAEYMAALAEAKSLGLTRRIGVSNFNIELTRQAIAAVGAGEISTNQIELSPYLQNRALTAYLEEQGIAVTSYMTLAYGKVLKDPALAGIAARHRATVAQVALAWAMQLGYAVIPSSTRRENLASNLLARDLRLDAEDMARIAGLERNGREVSPQGLAPAWD

SEQ ID NO: 50795 - protein, 965 aa, Oryza sativa Japonica Group
MAARSSLFLLCLATATAGVLQARAQPDSKGFISVDCGLPGKTSYIDDKTKISYASDDGFTDGGKHYNVSPEYIKPAVTARYYNVRSFPDGARNCYTLRSLVAGLKYLIRATFMYGNYDGLNKLPVSFDLHIGVNFWTVVNITDPIQPVNREAIVVVPDDSVQVCLVNTGAGTPFISGLDLRPLMNKLYPQVNATQGLLQLARLNFGPSDETSIRYPDDPHDRVWFPWFDAAKWNEISTTNRVQNIDNDLFEAPTAVMQTAVTPINASNNIDFFWNSQPQPNDPAPGYIAIFHFSELENLPNNATRQFYININGILFDDGFTPSFLYAEASYSSKPFVRHPQYNITINATANSTMPPLINAVEVYSVISTANIGTDSQDVSAIMTIKAKYQVKKNWMGDPCLPRNLAWDNLTCSYAISNPARITSLNLSKIGLSGEISSSFGNLKALQYLDLSNNNLTGSIPNALSQLSSLTIFTGGEDDDGWLMVDNNDGAAGGRQRQRWRTVEGAARAVEGRRRREQRDLTGNQLNGTIPPGLLKRIQDGFLNLRYGNNPNLCTNGNSCQPPKNKSKLAIYIVVPIVLVLAIVSVTTLLYCLLRRKKQGSMNNSVKRQNETMRYGPTNNGSGHNSSLRLENRWFTYNELEKITNKFQRVLGQGGFGKVYDGFLEDGTEVAVKVRTESSNQGDKEFLVEAQILTRIHHKNLVSMIGYCKDEKYMALVYEYMSEGTLQEHIAGKGNDGRYLTWKERLRIALESAQGLEYLHKGCNPPLIHRDVKGTNILLNTRLEAKIADFGLSKVFNPENGTHVSTNKLVGTPGYVDPEEILIVRLIGTDQMRRYQSTMQPTTKSDVYSFGVVLLELVTGKPAILRDPEPISIIHWAQQRLARGNIEGVVNASMHGDYDVNGLWKVADIALKCTALSSAHRPTMTDVVAQLQECLELEDKHQVSDINNGFYNGNSGDLNSNFYTT

SEQ ID NO: 50796 - protein, 942 aa, Oryza sativa Japonica Group
MAAWSWLILLCLVAAATAGVLQARAQPDSKGFISVDCGLPGKTSYVDDKTKISYAADDGFTDGGSFHNISAEYITPALSARYHNVRSFPDGARNCYTLRSLVAGLKYLIRATFMYGNYDGLSKLPIFDVYIGVNFWMMVNISDPSGATLLEAIVVVPDDFVQVCLVNTGTGTPFISGLDLRPLEKKLYPQANDKRGLSLFGRWNFGPISTTEFIRYPDDPHDRIWMPWVSPSYWVEVSTTRPVQHTDEDVFDAPTKVMQTAIAPLNASSNIEFAWVPYTQPKDPAPGYITVMHFSELQLRSSNATRQFYINLNGNMVFSQGYTPAYLYADAIFNSNPFLRYPQYNISINATANSTLPPIINAIEVFSVFSTATVGTDGQDASAMMVIKEKYQVKKNWMGDPCVPKTLAWDKLTCSYDSSKPARITDINLSSGGLSGEISSAFANLKALQNLDLSNNNLTGSIPDALSQLPSLAVLDLTGNQLNGSIPSGLLKRIQDGTLNIKYGNNPNLCTNDNSCQPAKHKSKLAIYVAVPVVLVLVIVSVTILLFCLLGRKKKQGSMNTSVKPQNETASYVPTNGSHGHGSSMQLENRRFTYNDLEKITNNFQRVLGEGGFGKVYDGFLEDGTQVAVKLRSESSNQGDKEFLAEAQILTRIHHKSLVSMIGYCKDGKYMALVYEYMSEGTLREHISGKRNNGRYLTWRERLRIALESAQGLEYLHKWCNPPLIHRDVKATNILLNAKLEAKIADFGLSKTFNLENGTHVSTNTLVGTPGYVDPEYQATMQPTTKSDVYSFGVVLLELVTGKPAVLRDPEPISIIHWAQQRLAQGNIEGVVDARMHGDHDVNGVWKATDIALKCTTQVSAQRPTMTDVVAQLQECLELEEGRCAISNANNNFYTDNNSNSNSSYDMYATDHSIDVSQNSAAFETERNFGRMPSTATGPAAR

SEQ ID NO: 50797 - protein, 927 aa, Oryza sativa Japonica Group
MHVRTTHVAEWIDQQWRLGGGCCCCSASPSPASFAARAARLTRPVSFKLRSPTRRHFGLVYMLFMHREYRAGFISIDCGLPEKTSYVDDATKLKFTSDDAFTDAGTIHNVSSEFATPTTTTDRSLYNVRSFPAGARNCYTVPSVVPGSKYLVRAKFLYGNYDGLNKPPVFDLHLGVNFWQTVTVPSADWLGNAEVIAVVPDDFLQVCLVNTGAGTPFISGLDLRPLPSSLYAPANATQGLVLLDRRNFGASGSTVIRYPDDTYDRVWWPWSNPPAEWSDISTADKVQNTIAPVFDVPSVVMQTAITTRNSSIPIQFSWDTKPNHVYPDPGSIFTLYVTELELLAGNAVRQFNVTINGVIWTKAPYKPVYLSTDAMYNGDRPYRGITRYNFSLNAAGSSTLPPILNAAEAFSVISTADLATDAQDVSAITAIKAKYQVNKNWTGDPCAPKTLAWDGLTCSYAISTPPRITGVNMSYAGLSGDISSYFANLKEIKNLDLSHNNLTGSIPNVISQLQFLAVLYGNNPNLCSNSSSCQLPQKKSNSMLAVYVAVPVVVIGAVAVFLIFFIRKKKNKSKGAVKPQILGNGVQSHSQNGSGGSLLELHNRQFTYKDLAVITNNFQRVLGKGGFGPVYDGFLKDGTHVAVKLRDESSSQGYSEFLTEAQTLTKIHHKNLVALIGYCKDEIHLALVYEHMSEGTLEDKLRGKDRKGRSLTWRERLRIVLESAQGLEYLHKACSPRFVHRDVKSSNILLNANLEAKVADFGLTTAFKCDGDTHVSTVRVVGTYGYLAPEYATALQVSEKIDVYSFGVVLLEVITGQPPIIKLPEPTTIIQWTRQRLARGNIEGVVDVNMPDDRYDINCIWKVADVALKCTAHAPGQRPTMTDVVTQLKECLELEETSFKGDTSSSYMSGSSIDPNSSYNTYTTEMS

SEQ ID NO: 50798 - protein, 186 aa, Brassica napus
  misc_feature (64)..(64): Xaa can be any naturally occurring amino acid
  misc_feature (110)..(110): Xaa can be any naturally occurring amino acid
MGAEKKWLFTLFSVVFLSVFLLLLLYSLSAFTSKPFPSPIRHGPHHPPAFAYYITGGCGDGDRXIFRLLLAVYHPRNRYLLHLGAEATEAERLSLLSRLKTVPAVSAFGXNVDVLGRVDRLSDNGASKTASTLHAVSILLKLGRSWNWVIELSALDYPLITQDDLSHVFASVNRSINFIDHTSDLS

SEQ ID NO: 50799 - protein, 98 aa, Physcomitrella patens subsp. patens
MSKSLGILVKLLHEAEGHIVTVELKSGEAYRGSLIECEDNWNSQLESVTYTAMDGKVSQLEHVSIRGSKVRFMIIPDILKNAPMFKRLDTKIKVHSFP

SEQ ID NO: 50800 - protein, 341 aa, Zea mays
MAEEPAIVVAASSSCEVDLGNLMAYDPCHHVAAAASASRMRGLAGAKKLREELRQECLRKGTELAQAVADALFALPPTEDRDGPIVHLPPHTVRLPREKHLPKPKPPTKWELFAKAKGITKRKKNKREWDEQTQSWKRTYGYDRVNDDKDVPILEAKLTDEPGVDPFAQRRDEKKKRVEKQEKSRLENLKKAAKVGALPSHIQLAAKALPITGTKADLPKKSRKEDLESVVGMASSATASGGKFDEKLPGEKPPKHPGKHRKFLPVAEGKGMGSLEKQQNDKILSSLLARNSDEPLDVSKAITMYKVKKEKQRRKEKNMPSKSDKLKPQKKPHKKSSKKRA

SEQ ID NO: 50801 - protein, 340 aa, Mycobacterium smegmatis str. MC2 155
MSSNLKLAVIAGDGIGPEVIAEAVTVLDAVLPGVEKTEYDLGARRYHATGELLSDETIEELRGYDAILLGAIGDPSVPSGVLERGMLLKLRFALDHHVNLRPGRLYPGVTGPLVGNPPIDFVVVREGTEGPYTGNGGALRVGTPHEVATEVSVNTAFGVERVVRDAFARAQDRRKHLTLVHKTNVLAFAGSLWSRTVDRVAQEYPDVEVAYQHIDAATIHMVTDPGRFDVIVTDNLFGDIITDLAAAVCGGIGLAASGNIDATRTNPSMFEPVHGSAPDIAGQGIADPTAAVMSVGLLLSHVGQTEAAARVDKAVSEHLATRGDEKLSTSAVGERIRSLL

SEQ ID NO: 50802 - protein, 286 aa, Oryza sativa
  misc_feature (177)..(177): Xaa can be any naturally occurring amino acid
  misc_feature (230)..(230): Xaa can be any naturally occurring amino acid
  misc_feature (236)..(236): Xaa can be any naturally occurring amino acid
  misc_feature (267)..(267): Xaa can be any naturally occurring amino acid
MPSYLTPEKEQELSKIAQSIVAPGKGILAADESTGSMTKKLGPIGLENIEENRRLYRQILFSADPAVAQAISGVILFDETFWQKTDDGTPFPKLLKSRGIIPGIKVDKGLVPLAGTDGETTTQGLDDLDARCAKYKKEGADFAKWRCALKINVAKNQPSPLAILENANVLARYASIXQNGIGPIVEPEILPDGEHDLETCQRITEKVLAGVYRALNDPHIFLEGTLLRPXMVTAGXSMPQKVTSQGIANATGQALNPTGPPAVPRCXPFLSGGQSEGGRLLSTLSL

SEQ ID NO: 50803 - protein, 470 aa, Arabidopsis thaliana
MTMSENSRNLEAGLLLRKNQNDINECRITAVVLFSTFVSVCGSFCFGCAAGYSSVAQTGIINDLGLSVAQYSMFGSIMTFGGMIGAIFSGKVADLMGRKGTMWFAQIFCIFGWVAVALAKDSMWLDIGRLSTGFAVGLLSYVIPVYIAEITPKHVRGAFVFANQLMQSCGLSLFYVIGNFVHWRNLALIGLIPCALQVVTLFFIPESPRLLGKWGHEKECRASLQSLRGDDADISEEANTIKETMILFDEGPKSRVMDLFQRRYAPSVVIGVGLMLLQQLSGSSGLMYYVGSVFDKGGFPSSIGSMILAVIMIPKALLGLILVEKMGRRPLLLASTGGMCFFSLLLSFSFCFRSYGMLDELTPIFTCIGVVGFISSFAVGMGGLPWIIMSEIFPMNVKVSAGTLVTLANWSFGWIVAFAYNFMLEWNASGTFLIFFTICGAGIVFIYAMVPETKGRTLEDIQASLTDFLQ

SEQ ID NO: 50804 - protein, 267 aa, Salmonella enterica subsp. enterica serovar Paratyphi A str.
MTIPAFGLGTFRLKDDVVIASVKTALELGYCAVDTAQIYDNEAAVGQAIAESGVPRNELYITTKIWIENLSKDKLIPSLKESLKKLRTDYVDLTLIHWPSPGDAVPVEEFMQALLEAKKQGLTREIGISNFTIPLMEKAIAAVGADHIATNQIELSPYLQSRKVVDWAKAHGIHITSYMTLAYGKALKDEVIARIAAKHNATPAQVILAWAMGEGYSVIPSSTRRENLASNLLALELHLDAEDRAAIAALDCNDRLVSPEGLAPEWD

SEQ ID NO: 50805 - protein, 266 aa, Gossypium hirsutum
LSIEEVEVAPPQKDEVRIKILFTSLCHIDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQANKFGVTDFVNPKDYNKPVQEVIVEMTGGGVDRSVECTGSIQAMISAFECVHD

SEQ ID NO: 50806 - protein, 363 aa, Oryza sativa Japonica Group
MGNGKVYATVVLIRLIYAGMHILTKASFNEGASTTVFVFYRHAVAAIFLLPFAYFLEIRKKQAPPLTFRLSAKIFVHGFYGMAGTINLYSIGLNYASATSSSAIFNIVPVVAFILAVMFRMETLNLKSTHGMAKASGILLCIGGVIVLALYQGPEFKSLNHHQLLHHASAAAAAAAHSKKNWALGIFLMTTSVVIWSFWTVKQGPLLLEYPSKLMNTTLQCVFASVQSLVIALVLERDFSRWILPGVVSLVGVLFTGIVVAAISYYLQIWVIEKKGPVFLSMSMPLSLVFTMAIASFLLGEDVSLGSIIGSLLLVAGLYNVLWGKSREEHGGGGVVVAGAGTAGGEKDGAVAPAAADVVMAKV

SEQ ID NO: 50807 - protein, 431 aa, Arabidopsis thaliana
MEMESCKLFIGGISWETSEDRLRDYFHSFGEVLEAVIMKDRATGRARGFGFVVFADPNVAERVVLLKHIIDGKIVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTAARARSSYHGERGGVGLEAMRGVHVGGYSSGSSILEADSLYSDSMWLSLPAKAEEGLGMGPLDFMSRGPAGYINRQPNGGIAA

SEQ ID NO: 50808 - protein, 530 aa, Burkholderia mallei ATCC 23344
MTDLATKPTPAASHGTLPRILPVILAGGSGTRLWPLSREHHPKQLIDLIADESPLSATARRLTGIANAELADTLLLVCGEQHRFTSAAQVSARGLDVRILLEPAARNTAPALTLAALEALAHHGDPVLAAMPADHAVSDTRAFQETIALAARYAQDGAIVTLGVLPRRAETGYGYIKVGAPLAGANGDTGGYAIDSFVEKPHQELAQQYLQSGDYWWNSGIFVVRASTWLAAIRALQPDMHAACETAWRGGTSEGAFFKADAAAFAACPSDSIDYAVMERLTGARALGIPGVIVPLTAGWSDVGSWDAIWELLPKDEAGNVARGEVLFEGTEDSFARSEGRLVACVGLKDVVVVETPDAVLVANKHRVQDVKTVVARLKSGRHEQVRDHRKVQRPWGYYDSIDRGERFQVKRIVVDPGKQLSLQMHYHRAEHWIVVRGTAKVTRGDETFLLSENESTYIAVGAVHRLENPGRIPLEIIEVQSGDYLGEDDIVRFDDRYGRASAQHAPDAAKPADAERAPAAGPARALGAQ

SEQ ID NO: 50809 - protein, 264 aa, Escherichia coli O157:H7 EDL933
MAISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGRGFHEEPQVLHYDSRETNVVLKPGMTFTIEPMVNAGKKEIRTMKDGWTVKTKDRSLSAQYEHTIVVTDNGCEILTLRKDDTIPAIISHDE

SEQ ID NO: 50810 - protein, 452 aa, Salmonella enterica subsp. enterica serovar Paratyphi B str.
MSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWVFVVALVAFMTAFNLRSLKSVANFNTVIVVLQVVLIAVILGMVVYGVFEGEGAGTLASTRPFWSGDAHVIPMITGATILCFSFTGFDGISNLSEETKDAERVIPRAIFLTALIGGLIFIFATYFLQLYFPDISRFKDPDASQPEIMLYVAGKTFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAGIGLIYLACVTKSFRNPVPQYEDVA

SEQ ID NO: 50811 - protein, 292 aa, Xanthomonas campestris pv. campestris str. ATCC 33913
MAKHRPLHQQVIVITGASSGIGLCTALAAAEAGASVVLVARSAGVLQEVADLLTTQGHQAIAVVADVTEPAQLQHAADTAIARFGRIDTWVNNAGVAIFGLLQDVDDHDSRRMFDINFWGVVYGSRIALPHLAASGGALINIGSEASEAVVPWQGMYSASKHAVKGFTDSLRIEIEGLAKQPVSVVLIQPTAVDTPYPQHARNYMQAEPQLPPPLIEPMRVANAILHAAEHGGRDVKVGAMANANITVTRLMPRVADALSAMRSKTQQQDRAAVDPAGTLYRAGESGRINGE

SEQ ID NO: 50812 - protein, 297 aa, Aeromonas hydrophila
MIRDKMKAVIPVAGLGTRMLPATKAIPKEMLPIVDKPLIQYVVNECIAAGLKEIILVTHSSKNAIENHFDKSFELEATLESRVKRQLLEEIQSICPKDVTIMHVRQGEAKGLGHAVLSAYPLVGNNPFVVVLPDVIIDDAASDLKKDNLAKMVRNYKESGHSQIMVEPVAIQDVSKYGIVDCHSVDISAGESATIFNVVEKPEKDEAPSNLAIVGRYVLTPEIWPYLRTTKPGAGDEIQLTDAISELLKDGQVDAFCMQGKSHDCGDKLGYMKAFVEYGLRHKDHQHNFRNFIVSLV

SEQ ID NO: 50813 - protein, 417 aa, Yersinia pestis CO92
MESKVVVPAEGKKITVDAQGKLVVPHNPIIPFIEGDGIGVDVTPAMINVVDAAVKKAYNGERKISWMEIYTGEKSTHVYGKDVWLPEETLDLIRDYRVAIKGPLTTPVGGGIRSLNVALRQQLDLYVCLRPVRYYEGTPSPVKHPELTNMVIFRENAEDIYAGIEWKAGSPEAEKVIKFLREEMGVKKIRFPEQCGIGVKPCSEEGTKRLVRAAIEYAITNDRESVTLVHKGNIMKFTEGAFKDWGYQLAREEFGGELIDGGPWVKIKNPNNGKEIIVKDVIADAFLQQILLRPAEYDVIACMNLNGDYISDALAAQVGGIGIAPGANIGDDCALFEATHGTAPKYAGQDKVNPGSIILSAEMMLRHMGWFEAADLIIKGTEGAIQAKTVTYDFERLMEGAKLLKCSEFGDAIIKHM

SEQ ID NO: 50814 - protein, 389 aa, Xanthomonas campestris pv. campestris str. ATCC 33913
MRALCWNGVNDLRVETVPDPVLVNPRDVILKVGLSTTCGSDLHFIDGYLPTMREGDVIGHEFMGTVVEVGPAVKNVRVGQRVVVPSFISCGGCWHCERKEYSLCDNTNPHWEMQESLLGHPTAGIYGYTHAFGGYAGSHATYIRVPHADVGCFEVPDEVSDEDALFLSDAGPTGFMGADFCNIQPGDTVAVWGCGGVGLMAQQSARILGAERVIAIDRLPERLAMARDVLGVEVIDYSTVDSVVDVLREMTGGRGPDACIDAVGMEAHGTGMGHAYDRVKQALHLHTDRGQALREAILACRKGGILSVLGVYGLMDKFPLGAVMNKGLTMRTAQQHGQLYVPRLLDLARAGRLKSSFLMTHKMPLEEAARGYEMFKHKHEGCVRAAFVP

SEQ ID NO: 50815 - protein, 349 aa, Leifsonia xyli subsp. xyli str. CTCB07
MLATIIHGERDVRLEEVPDPVLSTGGDAIVRVVATCVCGSDLWPYRGVTPTSQPRRIGHEFVGVVEAVGPEVATIEPGDFVIAPFYDCDMTCVNCENGVSASCLHGGWWGADDRSGAFADGGQGQKVRVPHADGSLVATPEYPREELIPSLLALSDVMGTGHHAAVSAGVRPGSTVVVVGDGAVGLCAVLASARLGASRIVAMSRHESRQALAREFGATDIVAERGDAGVAAVKGLLDGIGADCVLEAVGTKESMDQAIRSCRPGGMVGYVGVPNGGPELPVRPLFASNVGVNGGFAPVRNYVEELLRDVWSGAIEPGRVFDLQVPLSDIAEAYAAMDERRAIKALVRP

SEQ ID NO: 50816 - protein, 483 aa, Burkholderia vietnamiensis G4
MSFASLGLIDPLLRTLQDLNYQTPTPVQANAIPAVLGGKDVMAAAQTGTGKTAGFALPLLQRLVQHGPAVSSNRARVLVLVPTRELAEQVLQSFVEYGKGLDLRFLAAYGGVSINPQMMKLRKGVDVLVATPGRLLDLNRQNAVQFDQVETLVLDEADRMLDLGFARELNAVFAALPARRQTLLFSATFTDDIRAMAATILRNPVNISVSPPNTTASRIKQWVVPVDKRNKPELFMHLVAENKWEHALVFVKTRAGVDYLAAMLDEAGYAVDTIHGDKPQPARLRALERFKARDVQMLVATDVAARGLDIDDLPMVINVDLPIVAQDYVHRIGRTGRAGASGVAVSLVCADEAPQLAAIEALIGKTLRREEEPGFEAEHRVPETSATGQLIKKPKKPKKPKVLQAAPAAKPMPGKQARPRSGEGSGKPGAKRAGGAGAASGKGAKSVISGSPFSVQKPRGKSGGKPGGGSASAGKATGGRGKG

SEQ ID NO: 50817 - protein, 265 aa, Bradyrhizobium japonicum USDA 110
MTIVKWIAILLAAVYCAGLVVLYVRQREMLFPIPPVGRTAPDAAGLPEAEEHVLNTSDAEKVIVWHVPARPGRPVILYFPGNGDFLAGGVSRFKAMTADGTGLVALSYRGYAGSSGAPSEEGLLRDAAAAYAFTTARYAAERIVAWGFSLGTGVAVAIAAEHPVRKLVLEAPYTSTVDVAAAAFRFAPVRLLMRDQFRSDERIARVTVPLLVMHGTNDLAISIMFGERLFALAHEPKQFVRFAGGGHDNLDAFGAIETAKRFIAS

SEQ ID NO: 50818 - protein, 283 aa, Zea mays
MDTCHQSIETADGKKDYSDPVPAPFVNAGELGKWSLYRAVIAEFVATLLFVYVTLATVIGHKREAESQPCGSVGVLGIAWSFGGMIFVLVYCIAGISGGHINPAVTFGLLLARKLSLVRAALYVVAQCLGAMCGAGLVKAFHGAHWYLRYGGGANELAAGYSKGAGLGAEIVGTFVLVYTVFSATDPKRKVRDSHVPVLAPLPIGFAVFMVHLATIPVTGTGINPARSLGPAVVYNQRKAWEDHWIFWVGPLIGAAAAMLYHQLVLRAGAAKAFASFRNNQHF

SEQ ID NO: 50819 - protein, 92 aa, Triticum aestivum
MADRGGERGGDRGGQRGGFGRGFGRGGRGDRGGRHRTRLGPRQEEEKRVLLTKLGRLDKESLYNTREELYLHSLPINEYLIGDHLYLGLKAE

SEQ ID NO: 50820 - protein, 329 aa, Rhodococcus sp. RHA1
MSVAPGLQAESWHLLTLIERAPGFHILADTLADLVDEGHPIVAGTADLKYSNGLVAFQERHPDRYVQFGISEQHMVSTAAGLATTGLQPYVATFASFMAYLACEQIRTDIAYTKQPVRLIGHHAGITLGFYGTSHHATEDLAITRSIPGLTVIAPADTAQLGAALRAAVDHPAPIYFRIGRGQDPDVYADGAHPFTIGTAIEHGAGTDLTIIATGSMLHPSLEAAQALNAGGISTGVVDMHTVKPLDADAVARAAQRSRIVLTVEEHNVIGGLGGAVAEVVAEHGYGTRVIRHGVKDEYALIGPPTHLYRHYKLDAAGIEEVARAAVGS

SEQ ID NO: 50821 - protein, 386 aa, Salmonella enterica subsp. enterica serovar Paratyphi A str.
MTSENPLLALRDKISALDEELLALMAKRRALAIEVGQAKLLSHRPVRDIDRERALLDRLIHLGKAHHLDAHYITRLFQLIIEDSVLTQQALLQQHLNNTHPHSARIAFLGPKGSYSHLAARQYAARHFEQFIESGCAKFTDIFHQVETGQADYAVVPIENTSSGAINDVYDLLQHTSLSIVGEMTVTIDHCVLVSGATDLNTIETVYSHPQPFQQCSKFLSRYPHWKIDYTESTSAAMEKVAQANSPRVAALGSEAGGMLHGLQVLERIAANQTQNITRFLVLARKAINVSDQVPAKTTLLIATGQQAGALVEALLVLRNHNLIMTKLESRPIHGNPWEEMFYLDIQANLESQVMQSALKELGEITRSMKVLGCYPSENVVPVEPA

SEQ ID NO: 50822 - protein, 480 aa, Lactobacillus johnsonii NCC 533
MSKGEIVQVIGPVVDVEFPLDKDLPDINNALRVTNNNGDTLVLEVTLELGDGVLRTISMESTDGLRRGMEVEDTGAPISVPVGKDTLGRVFNVLGDPIDGGPALGKDVKREGIHKEAPKYDELSTSEEILETGIKVIDLLEPYVRGGKVGLFGGAGVGKTTIIQELIHNIAQEHGGISVFTGVGERTREGNDLYFEMKASGVLSKTAMVFGQMNEPPGARMRVALTGLTIAEYFRDVEGLDVLLFIDNIFRFTQAGSEVSALLGRMPSAVGYQPTLATEMGQLQERITSTKKGSITSIQAVYVPADDYTDPAPATTFAHLDATTNLERRLVEQGIYPAVDPLESTSSALDPEIVGEEHYEVAVKVQHILQRYQELQDIISVLGMDELSDDEKLIVERARKIQFFLSQNFFVAEQFTGIPGSYVPIKETIKGFKMIIDGKLDDLPEDAFRNVGPIEDVIKQAEKMGVTPKNPEAKAILEAK

SEQ ID NO: 50823 - protein, 184 aa, Zea mays
FITSLYKKAGSCRTMQRHVASGRPSGTDGSDFSYRMVVESRYQRVAEGRSRLARLILVQALHLVAGGLLLLLSLSKGAAVNKFAVLSMAAGFLAIVVGELGRMRTMSVLLRLYTSLSSIAVAFSVTCIIRSELFLKVMKQNTEAITSYEMLDAVRVALGILLQMVVIATTTRLLQNMSPPKRAS

SEQ ID NO: 50824 - protein, 468 aa, Klebsiella pneumoniae
MSKQQIGVVGMAVMGGNLALNIESRGYTVSVFNRSREKTEEVIAENPGKKLVPYYTVKEFVESLGTPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLTLSNEELAQTFTEWNEGELSSYLIDITKDIFTKKDEEGKYLVDVILDEAANKGTGKWTSQSSLDLGEPLSLITESVFARYISSLKDQRVAASKVLSGPQALPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGVFHTEWLE

SEQ ID NO: 50825 - protein, 3679 aa, Sorangium cellulosum
MDRSDKLRAYLEKTTASLVEAKGRIRELEARSREPIAIVAMACRFPGGVDSPEKLWALLDEERDAITEVPPSRWDLERFYDPDPDAAGKTYSRWGGFVGDLDRFDAAFFGISPREARSIDPQERWLLETTWEALERAGVRADTLEGTLGGVYIGLSGSEYQTEAFHDAERIDAYSLTGASPSTTVGRLAYWLGLRGPAVAVDTACSSSLVAVHLACQALRNGECDFALAGGVNALLAPESYVAFCRLRALSPTGRCQTFSADADGYVRAEGCGVLLLKRLSHAQRDGDRVLAVIRGNAINQDGRSQGLTAPNGLAQEDVIRRALSQAAVEPTTVDVVECHGTGTALGDPIEVQALGAVYGDGRPGDRPLVIGSVKTNIGHTEAAAGMAGLIKAVLSLQHAQVPRSLHFAAPSPYIPWDTLPVRVAAQRVAWERREHPRRAGISSFGISGTNAHVILEEAPEAPATAPEAAAVTSTLPLLVSGRDEAALRAQAERWAAWLAAHPEARWADVVHTAAVRRTHLEARAAVAAGNAADAAAALGALAAGQPHKAVSLGEARARGDVVFVVPGQGSQWPAMGRALLAESEVFAAAVAACDAALRPFTGWSVLSVLRGEQGEAVPPADRVDVVQPALFAMAVGLSAVWRAWGIEPSAVVGHSQGEVAAAYVAGALTLEDAARVVALRSQLVRRIAGGGAMAVIERPVGEVEQRLSRFGGQLSVAAVNTPGSTVVSGDAAAVDRLLAELETARVFARRIKVDYASHSAHVDAILPELEACLASVEPRTCAIPLYSTVTGEVLAGPELGATYWCRNLREPVRLDRALSRLLADGHGVFVEVSAHPVLAMPLSAASAERGGVVVGSLQRDDGGLGRLTSMLGALHVHGHAVSWQRVLAPYGGALVGLPTYAFQRQRHWLEAPRYAAEDTDGAARRDPLYRVTWIEAALEEAPWAPERHVVLGGGGALAAGLGALALAGLPELLEALENRAAAPERLVLDLTEGRPGAVAESVHATTRDALALVQAWLAAPRLSGTELVVVTREAVAAGPDEGVAALGPAAVWGLLRTARVEHPERAVRAVDLGREPLDVAVLRRALGAVAEPELALRAGGARAARLRAVDAGAGAREPAAALDPQGTVWITGGTGELGRQIARHLVAAHGVRHLLLTSRRGAAAPDAEALVEQLRADGAETVEVVACDVTDGAALSAAVQAAAARHPLTAVVHTAGELADGVLTGLTAEQLARVLAPKVDGACHVYAAAQDQPLAAFVLFSSIVGTLGNAGQANYGAANAFLDAFAAQLRARGVPATSLAWGFWEQAGLGMTSHLGAADLARLRRQGLAPLSVAQGLRLLDRALARAEATLVPAALDLPALQRAASDAGRVPPLLRGLVRTSPGRPTATATPEAGPAASALRARLSALPEAERPGALLDLVRTEVAVVLQLAGPAQVPADKPLKELGLDSLTAVELRNRLGARAETVLPTTLAFDHPTPRAIADLLLQRAFSELAAAKATRARGAHDEPIAIVSMACRLPGSVDTPAALWKLLAEGRDAIGPFPEGRGWDVAGLYDPDPDVPGKSITTQGGFLYDADRFDPTFFGISPREAERMDPQQRLLLECAWEALERAGLAPHALEASATGVFVGLAHGDYGGRLLQQLESFDGHVLTGNFLSVGSGRIAYTLGLRGPAMTVDTACSSSLVAVHLACMSLRAGECDMALAGGATVMATPMIFVEFSRQRGTALDGRCKAFGAGADGAGWSEGCGILALKRLSDAQRDGDRVLAVIRGSAVNQDGRSQGLTAPNGPAQQDVIRQALAAAGLTPADVDAVEAHGTGTRLGDPIEAQALLATYGAAHTAERPLWLGSLKSNLGHTQVAAGVSGLMKLVLALQHAELPRTLHADPPSPHVDWSQGHVKLLNEPVPWPRTDRPRRAAVSSFGISGTNAHVIVEEAPAEAPATAADAKSVEALPILPLLVSGSDEPALRAQVRRLVEHLRSHPDERLLDVAASLATTRAHLAMRLALPVSAGAPRDAWVDELEAFARGGAAPTQASQTPAESSAGKVAVLFTGQGSQRAAMGRALYATHPVFRAALDAACAELDRHLDRPLHSVLFADAGTEAAALLDQTGWAQPALFALEVALYRQWEAWGLRPELLLGHSIGELAAAHVAGVLDLPDASALVAARGRLMQALPHGGAMASIEATEHELLPLLDQHTGRLSLAALNAPRQSVVSGDLHAVDQVCAHFIALGRRAKRLDVSHAFHSAHMQPMLDAFASVARGLTFHPPRLPIVSSVTGARATTDQLTSPDYWVQQVREPVRFLDAMRSLHAAGAATFVECGPHGVLTAAGAECLAPEGARDAGFVTSLRKDRDEALALVHAACAVHVRGHALDWLRFFDATGARRVELPTYAFQRQRYWLEAPRPRPSLEGVGLTAANHPWLGAAVRLADRDGYVLSGRLSTIDHPWVLDHVVLGTALLPGTGFVELAWAAAEAVGLPGVSELAIEAPLALPARGAVALQIAIEAPDPAGRRGVAIYSRPDGAADAPWTAHARGVLGAAAPDRDAAWAQGAWPPPGAVPVDVTQRIEIVDAWVGPAFRGVTALWRVGRTIYADVALPDGVASTAQDFGLHPALLDVALRAFLRAELGADPSPREGTVVPFAWSDVVLEARGTAALRVRVEVAADGDGDAITASIQLADGQGRPVARVGALQMRWTTAERVRAAAGAAERDLYRVAWTDVALDDAAFAPEEHVVVGGDGALAAALGARVVAGLPELLASLPDGAAAPRRLVVDLTADAAGAVVDAVHAAARDALSLVQGWLAAPQLAATELVVVTRGAVAVAPDEGVAALGPAAVWGLLRATRVEHADRTVRVLDLGSAAPDMTLLRRALTAAEEPELALRAGGARAPRLDAASETEGELAPPGGARSLRLSIRTKGSFDALHLADAPDALRPLGPGQVRLAVRATGLNFRDVLNVLGTYRGEAGPLGLEGAGVVLDVGEGVTALRPGDRVMGMLHAGMATHAVVDARLLTHIPRGLSFVEAATIPAAFLTALYGLRDLGALKAGQRVLVHAAAGGVGMAAVQLARLWGAEVFATASEGKWPALRRMGIDQAHIASSRTLHFRKAFLDATQGQGVDVVLDALAGEFVDASLDLLPRGGAFVEMGKSDVRDPERVAKDHPRVRYTAFDLLDAGPDHIQAMLRELVPLFEEGVLAPLPSVAYDLRRAPHAFRSMANARHIGKLVLVPPATLDPDGTALITGGTGELGRQIARHLVAAHGVRHLVLTSRRGMDAPDAAALVESLRAAGAATVEVAACDVTDRDALAAIVQAIPAARPLTAVVHTAAVLDDGTVAGLSAEQLARVLRPKVDGAWQLYEATRDAPLAAFMLFSSVAGTLGSSGQANYAAANAFLDGLAAELRARGVPAMSLAWGFWEQGGIGMTAHLGAADLARLKRQGIVPMTVAHGLRLLDRALERPDAALVPASLDMAVIQRTASDHRQVPPMLRGLVRVAPRQAAGAASGRSHEASTLRQQLAALPEPERQRALLDLVRTEAAAVLVLRGPDAVPADKPLRELGLDSLTAVELRNRLRTRAQTDLPSTLAFDYPTPKAVAVYLAQELDLHDVMTEMRGPSLRSDDELKSAIASIRISTLRQAGLLDSLLRLAASEAVSTSSDTTPETDELTLQHVGDDELARLVFDLAGGAQ

SEQ ID NO: 50826 - protein, 268 aa, Brassica napus
MAASIGIMDSAYFVGRNEILTWINDRLHLNLSRVEEAASGAVQCQMLDMTFPGVVPMHKVNFDAKNEYDMIQNYKVLQDVFNKLQITKPLEINRLVKGRPLDNLEFLQWLKRFCDSTNGGIMNENYNPVERRSKGGREKSVKGSNKMPKSLQTNNTPPNSSSVGLTKASGPKPANTAQVQALSKELTDLKLSYDHLGKERDFYFSKLRDVELLCQTPELEDLPIVVAVKKILYATDANESALEDAQEYLNQSLGVKAEDEENGEQEDY

SEQ ID NO: 50827 - protein, 473 aa, Legionella pneumophila str. Lens
MSSQHTDKTLIKWIDNLIDEQSFLPIGSEYIPDNKPHSLPGAEVITGLAKVNQRPVAIYAHDSSVNRGYVTRQGARKIIHLMDKAEKLRIPIVAFLASPGVSLEENLLSGDEYTQIIARNIRLSGIIPQFAVILAPTLGAPAYSAVLMDLLFFNKHRSYLMVTSPTVVQQAIGEKVTMGELGSATLHATTTGIADFVDDSVTAQINHVKAILGFFPLHTNERPPVHPIMEPNHPIPDIPANPRMPFNMLNLIQAVVDNSNVIQYKRTYGQAMICAFVHIHGFAVGVVANQSIRYSGAIDSDAAQKAAKFIRICDAYSIPILTFIDVPGFMPGKREEQKGLLQHGARFCVAMQTRVPRLSVIVRKCYGAAAFLMMQTKSQNGDLVLALETANLGVMGKETTNKVQAMDGQPVKESSQSQLTEKSQIDDSLMEAYSLGLIDEIIQAAQIRSRLASHLEFLYRRMETMPPAKHSIV

SEQ ID NO: 50828 - protein, 1078 aa, Aspergillus oryzae
MVVIPRNYIGGLTTQFRSSNSFLEYDAVTIMLDAALVKREEQASASKSQRIPLVYSATSPQTGLDAANAHHIVQLLKDLAGEGRTVIVAIHTPRPEIWELFDHILLLSQGHVLYNGSTSSIRGYFERCGHAISASENPAEHLIDLVSIEAEAEGSPMGSVARINNLKEQWKAAQRTVADNYAPYSNNGSVVRYGSAISRHPAVPLSRQLAVLTRRTIWTTLRGPMSLFGSLSITIILGIVTGAAFYQVDSSAQGIWSRQGALFALLNIYGYPMLIYEIYRLSYEIQMFDREREEAVDIPGPAISSIVFYFLVGLRRSVAEPFLFLLVMILATYISLAAAILAIALSRDFAIAGLIGNLIYTLQSLSGGYLIHVDQISTWLRWSKWTAHNFYLYSAVCAIEFVGPKQTPRGHLYNCTSVANPPTGECTGSYGKDIISSLGIPREWIWQPVVASLGFLVSYTLVAALILHRPRMGAVMTSDPQSSHSSVVIQNMELLPLSSTPHTPGVDIQLTRYALILTRRNIKAFLGPSYERPILKPVNTTFRHGELSIIMGPSGSGKTTLLHAITARLPQRYRRQGQVFYNSHRLRPSTIRAMCSYVSQSDNLQPFLTVRETLLFAAGLRLPRWITKEQRYSKVDSIIRTMGLTSCAETIVGDGKQTGISGGEKRRVSIGIQLLTDPRILILDEPTSAGRILKKLKNLSEEGRTVICSIHQPRSDIFPFFSNIHLLASDGSPVFAGRGEDILHYFHTHGFECPDSMNSCDFIIDLVTVDHRDNRETSSRARVQQLIDGHAVTQSTIQDTPPLSMTLLEQRAFAKNINPFRTLFPLALRRSALGLTRRPFLLLSRLVQAPGMTITFVMFTAPLSSDSNSVQTRIGLLQPPANIIVYPGERDTFKDERKDGCMTATCFLVQYTCLELPTEIFTALVSGAIFTFGPPIKRTFTMLLVSSFNIFAILNCGESLGIILLSFFDNIGISATLAPIVLSINWLFAGLLSTSLPRVFQIVSYILPSKFAMANVVPYAMDGLEFTCSDEQQHGTQCTIRNGKDVLDFYTFANNPGLNIMGLAVCVVVISGCCVFSD

SEQ ID NO: 50829 - protein, 715 aa, Pseudoalteromonas tunicata D2
MSHRIMLIPVSTGVGLTSVSVGIVRALEQKAVRVNFFKPIAQPRAGESGPEKSTEIVKLGSNIKPPMPIELKYAEQMIGDGKGDILLEEVIARFEESVHDGEVAIIEGMVPTRKQPYAGRLNREIAQALGAEIVFVLTPGNDPLDQIEHRLEIAASFYGGVENERVLGCIFNKVNAPLDEEGRARADLAEQFDPENLVAEQNRLAAMPLFRKHPFKLLGSVPWDFELVAPRVSDLARYLKAEILNEGDFAHRRLRSVTFCARTVSNILCHFTPGVLLVTPGDRSDVLVAACLSAMNGTKIGAILLTGGFIPEDRIMKLCEQAMATGLPILSTQADTWRTSLLLHNFNMEVPIDDEQRIERVKDHNAAHLDADWLQSLTKGVEKTRKMSPPAFRHLLTTKARLANKTIVLPEGTEPRTIKAAAICGERGIAKTVLLGEREEILRIAEQQGVQLNDAVTIIDPVDVRENYVAPLVELRKNKGMTEVIAQEQLLDNTVLATMMLAQGQVDGLVSGAVNTTANTIRPPLQLVKTAPGSSLVSSIFFMLLPDQVLVYGDCAINPDPTAEQLADIAIQSADSAIAFGIDAKVAMISYSTGTSGVGADVEKVRLATELAQAKRPDLIIDGPLQYDAAIMESVARKKAPNSLVAGKATVFIFPDLNTGNTTYKAVQRSAKLISIGPMLQGMRKPVNDLSRGALVDDIVYTIALTAIQATQVTH

SEQ ID NO: 50830 - protein, 471 aa, Chromobacterium violaceum ATCC 12472
MSDVFQFMKLSRNPGEKVEASVRKVEFKEIYQPLHAVDAADQAGRCLSCGNPYCEWECPVHNYIPNWLKLVEEGRLFEAAELSHQTNSLPEICGRVCPQDRLCEGACTLNQGGFGAVSIGSIEKYITDEAFKAGWRPDMSKVVWTDKTVGIIGAGPAGLACADVLVRNGVKAVVYDRYEEIGGLLTFGIPEFKLEKSIVHRRREILEGMGVEFVLNTEVGKDISFDKLMIKHDAVFMGMGAYKAMRGGFPGEDSKGVLQALPYLINNVRQSMGTLPVDEAAISMKGKRVLVLGGGDTAMDCNRTAIRQGAKRVICAYRRDEANMPGSRREVSNAREEGVEFLWNRQPLAIEPMIGGTLAVKLGETRLSEAGAKGRSAVELVPGGGEVLECDHVIIAFGFQAEAAAWFDACGVRTENGSGRTKVSRGGKYPYQTSNPKVFAGGDQVRGADLVVRAVFEGRQAAESLCAYLFD

SEQ ID NO: 50831 - protein, 452 aa, Leifsonia xyli subsp. xyli str. CTCB07
MALGSAIGTGLFYGLSSAIQKAGPAVLIAYIVGGAAVFMVMRALGEMAVRHPVSGSFGQYASKYLGPRAGFVTGWTYAFEMIVVALADVTAFGIYMSFWFPDVPRWIWVLAIVFFIGALNLLSVKVFGELEFWFSVIKVGAIVAMIVGGVVIIAFGFAGANAAGPGNLADPATGGFAPNGIGGVIASFAVVMFAFGGIEVIGITAGEAAEPKKVLPRAINSVPARILLFYVLTLAVIMMLVPWNAIDGSQSPFVMIFEGARPPGCPVHPERRRHHRSALGDQLGHLRCGPDDVRPRHAGPRSARVRPCHPQRRPVADGRGDGLRAAPGRGAERGHPRNVFLVIASVATFATVWVWLMILLAHLRMKQRIRREGMLPSEFPVPLWPGASVATLVFLVFVIGVLGWFEDTRIALVVGVVWIALLLAAYQLCVRGPGRLPADLVDETGPIRVVRR

SEQ ID NO: 50832 - protein, 260 aa, Wolbachia endosymbiont of Drosophila melanogaster
MNITIHSQEDFEFMRKAGRLAAETLDFIAPYVKVGVTTNELNDLCHDFIINAGAIPAPLNYRGYPKSICTSKNAVVCHGVPDDTPLKDGDILNIDVTVILNGWHGDTSRMFWVGKPSIKAKRLCDATYNALMEAIKQVKPGNKLNEIGLAIEKYIRDFGYSIVRSYCGHGIGKVFHAPPNVAHFYDQDEDLVLKEGMFFTIEPMINAGKHETLLSKLDDWTVTTRDLSLSAQFEHTLGVTKDGAEIFTLSPKNWHFPPYN

SEQ ID NO: 50833 - protein, 404 aa, Frankia sp. EAN1pec
MEFAQSDKLADVCYDVRGPILDEATRLEAAGQRILKLNIGNPAPFGFSAPPSVLAAVVENLAAAQGYSDSKGLLPAREAVVRYAAGKGMTSVTPDDVYLGNGVSELIMMSLQALLNNGDEVLLPAPDYPLWTAVVSLTGGRPVHYLCDESAGWNPDLDDIIRKITPRTRAIVIINPNNPTGAVYDRPVLEELIEVARRHHLMLFSDEIYDRILYDGAEHHSPAALAPDLFCVTFNGLSKAYRLAGFRSGWMTLSGPRQHASSYIEGLNILANMRLCANVPGQFALQAALAEGSGAGDLVLPGGRLLEQRDTVVKLLNDIPGVSCVPPRGALYAFPRIDPEVYPIDDDESFVLDLLQAERILLVQGTGFNWPRPDHVRLVTLPCVDDLTDAVGRIDRFLTTYART

SEQ ID NO: 50834 - protein, 185 aa, Zea mays
MSEEQFLAVAVEAAKSAGEVLLCTPCLLTLFSCRLLTGCWFPEQIIRKGFYQTKNVEHKGQVDLVTETDKACEDLIFNHLRKHFPDHKFIGEEESAALGATADLTDDPTWIVDPLDGTTNFVHGFPFVCVSVGLTIGKIPTVGVVFNPIMNELFTAVRGKGAFLNGSPIKASSQDELVKALLVTE

SEQ ID NO: 50835 - protein, 279 aa, Bacillus cereus E33L
MKNLQSKAVLNNGVEMPWFGLGVFKVEEGPELVEAVKAAIKAGYRSIDTAAIYGNEKAVGEGIRAGIEATGIAREDLFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 50836 - protein, 624 aa, Thermococcus kodakarensis KOD1
MEFKPYIPPEKSLPEYTVKAFVLGVLLSIVMGAANAYLGMYAGMTVSASIPAAVISMAILLAFKDRNILENNMVQTAASAGESLAAGVIFTFPALVVLEYYTTFPYYIVTIIAALGGSLGALFTVVLRRAFIVEEKLPYPEGTACAEVLIAGDKGGSHAKPIFYGGIFGGIYKLLGQTGLWSGTVETAKMIGSRVYYFGSDLSAALVAVGYIVGLNIAFLVFLGGAIAWFIAIPLYAGQMGSTDMSALDLAWTIWSTKIRYMGVGAMVVGGLWSLIKLRGPITRGIKAGLEAAKRRQAGEAVLRTEEDLPLNYVLILIAAFAIPLFLLYYHIIGSIGIAAVMAVILLIVGFLGSAIAGYLAGVVGSSNNPVSGITIMSLLFTALVLKALGLSGTEGMVATILVAAVICTAAAIAGDTMQDLATGYLVGATPKRQQVFEIIGTFAAALVMAPVLNLLIEAYGIAGTPTAKENALAAPQAFLMAKVTEGVFTGNLEWKMVYIGAGIAIALIIVDEILAMKKAKFRTPVMPVAVGIYLPLSLGVPIFIGGLIRHFASKAKGNGGEDMTDAGVLGAAGLIAGEALMGIIFAALIVANVAPSVGFTSNVLGVLLLAGIVIWLYMMGKKK

SEQ ID NO: 50837 - protein, 522 aa, Nocardioides sp. JS614
MSKHKQHQASMEERTSELAERRHKVELGGGESRQQKQHDQGKLTARERIEALIDPGTFQETGMFARHQSTYFGLDKADYPADGVVTGEGAVLGRPIHVASQDFTVAGGSAGEVHSDKVVAMMQASLTTGTPFVFINDSGGARVQEGIGSLAGYGRVFYSNVLLSGVVPQIAIIAGPCAGGAAYSPALTDFIIQTRKAHMFITGPNVIAQVTGEQVSSDALGGADAHMARSGVTHFVADDDEQAVLITKKLLSFLPQNNTEDPPIVDPDDTIEPDLELPKVVPVSDKKGYDVREVIARIVDRADFLEVQAGYAQNIVIGFGRITGRTVGIVANQPSVISGVLDINASDKGSWFVRFCNAFNIPLVTLVDVPGFLPGVAQEHGGIIRHGAKLLYAYSAATVPKITVVLRKAYGGAYVAMCSKDLGADKVFAWPTAEIAVMGAEGAAEIVFRREIADAEDPDTRRAELVDEYRSTFSTPYVAAGRGLVDDIIDPCCTRAHISRALEMLASKRELRPAKKHGLGPT

SEQ ID NO: 50838 - protein, 98 aa, Thermosynechococcus elongatus BP-1 [sequence omitted]

SEQ ID NO: 50839 - protein, 224 aa, Triticum aestivum
MSFLFGKRKTPAELLRENKRMLDKSIREIERERQGLQTQEKKLIAEIKKVAKQGQMGAVKVMAKDLIRTRHQITKFYALKSQLQGVSLRIQTLKSTQAMGEAMKGVTKAMSQMNRQMNLPALQKIMRDFEMQNEKMEMVSEVMGDAIDDALEGDEEEEETEELVSQVLDEIGIDINSELVKAPATAVAMPVAAGKAPVQAEAAGGMDGGIDDDLQARLDNLRKM

SEQ ID NO: 50840 - protein, 215 aa, Leptospira interrogans serovar Copenhageni str. Fiocruz L1-130
MKISASILATKLTELVKTVPNYDPTAIDLIHMDVMDGNFVPQISFGEALTKEVKSLTSIPLDVHLMVAKPENHVFKYYEFNPYCITFHIETTDFPIRLAQEIKSHGTKVGVSLNPGTPVSSLENVLPYVDLILLMTVEPGFYGQKFIINGMDKIRKVKELIGSRPIELEVDGGVNDTNIQELRKNGVDIVVVGAGLYKTGNPVENAKNLKYLARV

SEQ ID NO: 50841 - protein, 509 aa, Rhodococcus sp. RHA1
MRDTRSKETMTYETMKPDAALAKVPTDLFIGGRWVSPGTGQTLAVENPATGDVIAEIADGGLADMAAALDAAAAAQRDWARTAPRTRSDILRRAYTLMLERSDYLATLTTLEMGKPYAQAQAEVTYAAEYLRWYSEEAVRIGGRYTVTESGVGRIVTMAQPVGPCLFVTPWNFPLAMGTRKIGPALAAGCTCIVKPAKQTPLSMLATASILEEAGVPAGVVNIVPSSDSTRVVAAAMNDPRLRKISFTGSTEVGQSLVRQSADQLLRVSLELGGNAPFIVFDDADVGSAVDAAVQAKLRNNGEACTSANRLYVHSSIAGDFAAELAERFSALTIGPGMDPGTDIGPLIDDKQRRQVQRLVDDAVAKGARVVTGGNPLDRPGCFFAPTVLTEVPGDALLMQEEIFGPVAPIISFDDEPAVLESANSSRYGLAAYVFTRDLDRAIRVAEQLDSGMVAINQGTVSNPAAPFGGVKHSGYGREGGPEGLAEYLETKYVALGAGTAPTSTGGMA

SEQ ID NO: 50842 - protein, 189 aa, Ralstonia solanacearum GMI1000
MLLMIDNYDSFTYNIVQYFGELGQDVRTVRNDEITIEAIEQLNPERICLSPGPCTPKEAGICLPVLEHFAGRIPILGVCLGHQAIGDAFGGRVIRAQKVMHGKVSTIENTGAGVFANLPRHFKVTRYHSLAIERETLPDCLEVTAWTEDGEIMGVRHKTLPVEGVQFHPESILSEHGHALLANFLKERA

SEQ ID NO: 50843 - protein, 478 aa, Bradyrhizobium japonicum USDA 110
MRRLRRIKILATLGPASSDLAMIRRLFEAGADLFRINMSHTPHDKMRELVATIRNVESSYGRPIGILVDLQGPKLRLGAFAEGSVQLQNGQTFTLDSDKAPGDATRVNLPHPEILAALRPGHALLLDDGKVRLIAEETSKEHAVTRVVVGGRMSDRKGVSLPDTDLPVSAMTPKDRADLEAALVTGVDWIALSFVQRADDVIEAKKMIRGRAAVMAKIEKPQAIDRLADIIEASDALMVARGDLGVELPLERVPSLQKQMTRMARRAGKPVVIATQMLESMIQSPVPTRAEVSDVATAVYEGADAIMLSAESAAGKFPVEAVSTMNRIGEEVERDPIYRSVLTAQRPAPESTAGDAIADAARQIAETLDLPALICWTSSGSTAVRVARERPKPPIVAITPNIAAGRRLAVVWGVHCVVAEDARDQDDMVSRAGQIAFRDGFVRAGQRVIIVAGVPLGIPGTTNMVRIASVGPEGGADI

SEQ ID NO: 50844 - protein, 172 aa, Bacillus anthracis str. Sterne
MWCSFTIKLLRIHFIYLKTITNRGAKMKTRVNPELLQGLEMFPDLDLRPGNLQSIREGIAQMRPPTVVDDSLSLIDKVIVGPDDNPLPLRIYRPKSNHESLPVLLWIHGGGYILGSIDDNDDTCMRFAKEASCVVVSVDYRLAPEHPYPAPIEDCYSALKWIADNACKVIKH

SEQ ID NO: 50845 - protein, 60 aa, Actinobacillus pleuropneumoniae serovar 1 str. 4074
MRLAWTREEVDQRLFNIMTAIHQNCVENGTETDGYVNYVNGANIAGFKKVATAMLEQGIV

SEQ ID NO: 50846 - protein, 218 aa, Actinobacillus pleuropneumoniae serovar 1 str. 4074
MYGQYKKLRNEFTSVLTGKSLTWGGSLIRPEATGYGAVYFADAMLATHGQGFDGKRVVISGSGNVAQYAAEKAIQKGAKVLTVSDSNGYVLFPDSGMTEKQLADLLVLKNERRERLSVYAKEQGVQYFEGQKPWGVKCDIALPCATQNELDGEAAKELVKNGCFCVAKGANMPTTLEGVEVFIAAKILYAPGKAANAGGVAHFRFRNEPKRNALSLDS

SEQ ID NO: 50847 - protein, 387 aa, Desulfitobacterium hafniense Y51
MVEDSMIYFDNAATTWPKPECVYEAVDQCLRNKGANPSRSGHFMALLAGQIVLNARVQIAEFFNISDPLQVVFTPNATEALNIGLKGLLKPGDHVITSSLEHNAVTRPLEKLRSQGVEVTKLPTPVQEGLHPEQVEAAIQSNTKLIVLSHASNVMGLIQPIGEIGRIAGEKGVLFMVDSAQTAGSIPIDVQAMGIDLLVFAGHKGLLGPQGTGGLYLREDLRLDTLKEGGTGANSEEPFQPEESPERYESGTLYTPGIAGLGAGIEFIKQEGIEKIREKERTLTRQLMLGLSAIPGVILYGPDPSVERAPVVSINLEGREPSEVSYLLDKLYGIASRPGLHCAPDAHKTLGTFQQGTVRLSLGYFNTSQEVEECLDAVAGLSSPNKK

SEQ ID NO: 50848 - protein, 461 aa, Desulfitobacterium hafniense Y51
MEQYQVGILGGGPGGYVCALRAAQLGLSVVLVEGDRLGGTCLNRGCIPTKALIKSADFWRELQQVEEFGIRAGESSFDFAKMIERKDRIVHNLVLGVEQLFRTAKIPVIKGWGEITEAGRINVETETGQVRLKVENLVVATGSTPFRIPVPGANLDGVMTSDHILDEKTLPEKLVIIGGGVIGLEFASAFQALGVKVTVVEMLPSLLANSDDEIPRRLTSVLKKRGIDIFTKTMVKEIKSAENRLITVVENAKGIQEIFSDRVLLATGRKTNLCGVNAQRLGLQLEGGSIVVDSQMRTSVPNIYAIGDVTGKAMLAHVASAQGMVAAEHIAGHQVEMSYRAVPSVIFTHPEIAAVGATEQELRTAGVKYKVSKFPFSANGKALVLGETMGTVKILANEEGVILGSSIMGPQASSLIQELVLGVEKGLNAEVLAKTIHAHPTLPEAIMESAHGILGKPLHLA

SEQ ID NO: 50849 - protein, 387 aa, Geobacillus zalihae
SLRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVSGAEKLNQWVQASPNTYYLSFSTERTYRGALTGNHYPELGMNAFSAVVCAPFLGSYRNPTLGIDDRWLENDGIVNTVSMNGPKRGSSDRIVPYDGTLKKGVWNDMGTYNVDHLEIIGVDPNPSFDIRAFYLRLAEQLASLQP

SEQ ID NO: 50850 - protein, 580 aa, Aspergillus oryzae
MSLLLPLIFVVLAASIQHTTPPFESPLSSGTGLLSRGVLDNQQFNVNTNYYSKTPDTGVVREYWFDITNATAAPDGVDRPMMLVNGQYPGPTVEADWGDTVKVHVKNNLENNGTSIHFHGIRQFLNNQMDGTVSVTQCPIAPGTSYTYAWRAEQYGTGFYHSHFSLQAWEGVFGGIVIHGPATAEYDEDLGVLFLNDWPHRTFNEMYMNQIRNPATPVIDTGLINMTNVWVNGDGDTVGQRFKTEFVRGKKYRIHLVNAAMHAHFRFSIDDHNLTVIASDFVPIVPFTTNNIAIGMGQRYDIIIQADQSVDNYWIRSVPQSACSNIPTGDNIKGIVHYMGADDDGDPMTVRWDYGDDTQCLDRPMSDLVPWVSLDAMISNATNISDAVAPIAAENSGIFLWTIGGQAFNVSWRDPTLQHSPTTGINNTISDPKAIELPEANQWVIFVITTTQGVPHPIHLHGHDFYILAQGVGPFSKSIPLQTRNTPRRDVALLPAQSDGGYLVIAFPTDNPGAWLLHCHMGFHSSAGFVQQIVEQKTEFWRFLNPELLRDTCDAWDDYAAVNPYGVQYRGTNGQYESGT

SEQ ID NO: 50851 - protein, 404 aa, Chromobacterium violaceum ATCC 12472
MSNSVTRADFDQVMVPNYGPAGFIPVRGEGSRIWDQDGREFVDLAGGIAVNSLGHCHPELVAALTEQANKLWHVSNVFTNEPALKLASLLVEKTFAERVFFCNSGAEANEAAFKLARKYAHDNFGADKNQILSCVNSFHGRTLFTVSVGGQPKYTEGFGPVPGGIDHFEFNNIESLKAAISDRTCAVVIEPIQGESGVLPADPAFLKAARELCDQHNALLIFDEVQSGMGRTGALYAYQQYGVTPDILSSAKGIGGGFPIGAMLTTEKVAKSFGIGSHGSTYGGNPLACAVAHKVVSIVSSPEVLAGVEARHKRLVAGLEAINAKYKVFKQVRGKGLLIGCVLTDEYNGRAREFLKAAEKQQLMILVAGLSVLRLAPSLVISDADIAEGLKRLDAAIADLQSAK

SEQ ID NO: 50852 - protein, 410 aa, Chromobacterium violaceum ATCC 12472
MQPVHKSQKLANVCYDIRGPVLEHAKRMEDEGHRIIKLNIGNPAPFGFFAPDEIIEDVIVNLPAASGYSDSKGLFAARKAIMHYAQQKHLPNVAMDDIIVGNGVSELIVMAMQALLDNGDEVLVPAPDYPLWTAAVSLAGGKAVHYLCDEEQGWFPSIDDIRAKITPTTRAIVIINPNNPTGAVYPPALLQQIVDVARQHQLIIYADEIYDKVLYDAVRHTSIASLAPDLFVVTLNGLSKNYRACGYRAGWMILSGEKKHAKDYIEGLNMLASMRLCANVPSQYAIQTALGGYQSIDDLVAPGGRLARQRDLAHKLLTEIPGVSCVKPQGALYLFPRLDPKVYPIADDQQFILELLQQEKVLLVQGSGFNWIAPDHFRVVFLPNSDDLIEAIGRIARFLESYRKRHGAAE

SEQ ID NO: 50853 - protein, 396 aa, Thermococcus kodakarensis KOD1
MARVIVDAQAARAIGKGAMIVFKKGVVRTEGEINPGDIVEVYTRGGKFLGKGFANPNSNIMVRLVTKDKDTEINKELFRERIRKANEYRKNVLGYDKAYRMVYGEADYLPGLIVDRFNEIASIQISSVGMERFKLDLAEAIMEAEPEIETVFEKNTGRSRRREGLPEIERVLLGKEKYRTVIEEGRAKFIVDMRGQKTGFFLDQRENRIALEKYVKPGMRVLDVFTYTGGFAIHAAVAGADEVVAVDKSPWAINMVKENAKLNGVEDKMKYIVGSAFPVMEEMIKRGEKFDIVILDPPAFVQHEKDLKRGLRAYFNVNYAGLQLVKEGGILVTASCSQHVDLQTFKDMVIAAAAKAGKFLKMLEPYRTQAPDHPILMASKDTEYLKALFLYVEDMK

SEQ ID NO: 50854 - protein, 325 aa, Aspergillus oryzae
MSTMKAFQFDDVQSGLHLRTVSRPQPAHGQVIIQIKAAGLCHSDCFILQDDQYNMIMKRPIVLGHEVAGTIIELGPGVSDYEVGDKVVVGIPTHPVAQDSFIKAIGLGYDGGYAEQAMAWVENLVRIPPGVSFAQAAVANDSIATAYHAVITEGHVSPNSRVAIVGLGGLGLSAIQIAAIHGARIYAVDIDETKFPLARELGAIGCASGLDKFEDIVFDTVVDFAGAGITTAAAVNAVKPCGRVVVVGLAAKQMNLDTHSVITRNITLQGSIGSSLEELKEVLRHIADGRLSPILEEISFDSIPQGLERLAQGKVTGRLFTDPTA

SEQ ID NO: 50855 - protein, 585 aa, Frankia sp. EAN1pec
MTHRQFRLPDLGEGLTEAEIVRWLVEVGETVTVNQPLVEVETAKAVVEIPSPFAGVLVERHGEAGTELAVGTPLLTIDEPGDEPATGPTTGSVTGATEATGQETTPGDATRNGAASLPVSRTGEAADVPGGAGTADLSPMAAGRTPMLVGYGPRSDSGPRRRRRPRNPDGPLPGSTTPAATIAAPAPAPGTAPTASSAPRAMAPVVSSVPASAPATSPASAAAGAPDRSAVVPIGAAPRHGRVAAKPPVRKLARDLGVDLSTLAGTGPAGTISRADVETAARQATPPEPAPVPTTATPTTRTGPVRVPGVVPSSNGIDGPRQPELNGHAATTRRVPGAIPPDAGFNDTDRIWRIPVTGVRRTMARAMVASVFSAPHATEFLSVDVTETMAARERIAALPDFAGIRVTPLLLVAKALLTAVRRHPMINSTWVGDTSGENAEIQVHERINLGIAVAGPRGLVVPNIPDAGSRGLVDLARSLHSLTEAARADRLRPADLSGGTITITNVGVLGVDTGAPVLNPGEAAILALGAIRPAPWVHEGELAVRTVAHLALSFDHRVVDGELGSAVLADVAAVLADPVIALAWS

SEQ ID NO: 50856 - protein, 368 aa, Campylobacter jejuni RM1221
MKEQILEKLKTVKYPGFEKDIVSFNFVKDIKIQDDGVFIDIEIVSANPEVANEIRKNTIEALSSLALKNIELNIITPKIPEEKSNSRSGKNIAPQVKNFIMVSSGKGGVGKSTTTVNLAISMAKMGKRVGILDADIYGPNIPRMLGETKTQPEVVGQRLKPILTHGVYMMSMGVLIEEGQGLMWRGAMIMKAIEQLLADVIWPELDVLFLDMPPGTGDAQITSAQSIPITAGVCVSTPQTVSLDDSKRALDMFNKLHIPIAGVIENMSGFLCPDNGKEYDIFGKGTAEDMAKAYKSEVLAQIPIEMIVREGGDEGKPVSFYHPESVSSRRYLMAAEKIWSFIEKINNEGGADNSAIQPMMNGKSACSH

SEQ ID NO: 50857 - protein, 428 aa, Vitis vinifera
MAGAASALFLLDIKGRVLVWRDYRGDVSAVQAERFFAKLMEKEGDPESQDPVVYDNGVTYMFIQHNNVFLMTASRQNCNAASHLLFLHRVVDVFKHYFEELEEESLRDNFVVVYELLDEMMDFGYPQYTEAKILSEFIKTDAYRMEVSQRPPMAVTNAVSWRSEGIRYKKNEVFLDVVESVNILVNSNGQIIRSDVVGALKMRTYLSGMPECKLGLNDRVLLEAQGRSTKGKAIDLDDIKFHQCVRLARFENDRTISFIPPDGSFDLMTYRLSTQVKPLIWVEAQVERHSRSRIEIMVKARSQFKERSTATNVEIELPVPSDATNPNIRTSMGSAAYAPENDALLWKIKSFPGGKEYMLRAEFSLPSITAEEGAPERKAPIRVKFEIPYFTVSGIQVRYLKIIEKSGYQALPWVRYITMAGEYELRLI

SEQ ID NO: 50858 - protein, 165 aa, Thiobacillus denitrificans ATCC 25259
MSTRHIISLLMENEAGALSRVAGLFSARAYNIESLTVAPTEDATLSRMTIVTVGSEDIIEQITKQLNKLVDVIKVMDLTEGRHIERELMLVKVKATGLGREEMKRTADIFRGRIIDVTDSTYTIELTGTGSKLDAFLEAIDPALIIETVRTGASGIGRGERSLKV

SEQ ID NO: 50859 - protein, 262 aa, Oryza sativa Indica Group
MAPLVSLSLPLPCAVPASSLPPRAEPDASSSFHPPASSSSSPRGGRLALAAAQPGSGRRWVGRWRAGVSSFSFLAPFFAGNKEKENREKAERLKEELLAAIRPLDRGVDATAEDKERVEKIVQQLEEVNQVKEPLKSDLLNGKWELLYTTSESILQPQRPKFLRPFGTIYQAINTDTLRAQNMETWPYFNQVTANLVPLNSRRVAVRFDYFKIFNLISIKAPGSGKGELEITYLDEELRASRGDKGNLFILKMVDPTYRVPL

SEQ ID NO: 50860 - protein, 276 aa, Picea sitchensis
MMTRVPSMNPDAFLMAGSLNNVSKDRRLMAAGASRMEKLLGFAPQNLNSNSAASDAGDLNELKEEDVWGIWPDAGSNPAQYETKKEENFQFRHKTDSANGGGGIGGAVEPGRSLQSGSSRRWKENGGLSIAFEECNRSRLSPLTRSSAVFSVTPANRISVRMIPSADQNGNTSGSSSNMMMMHHQSAPVNVPDWSKILGVGMDRLKENNPNLFFSAAADEDEDGGDMLPPHEYLAREQARSQMTTTSVFEGVGRTLKGRDMSRVRNAVWRQTGFLG

SEQ ID NO: 50861 - protein, 290 aa, Brassica napus
  misc_feature (263)..(263): Xaa can be any naturally occurring amino acid
  misc_feature (276)..(276): Xaa can be any naturally occurring amino acid
METAIQTREILSLPAKPIGARRSLLHPSHGLKHRLFSSKPRTPPALSLSFKKAQSFDPTISISHKERSHEFICKAEADGGALLNEGDTAAVVPSPKIFGVEVTTLKKIIPLGLMFFCILFNYTILRDTKDVLVVTAKGSSAEIIPFLKTWVNLPMAIGFMLLYTKLSNVLSKKALFYTVIIPFIIYFGAFGFVMYPLSNYIHPEALADKLLAALGPRFMGPLAILRIWSFCLFYVMAELWGSVVISVLFWGFANQITTVDEAXNFSPLVGRGANVXLIFSGRTGEYFSNL

SEQ ID NO: 50862 - protein, 261 aa, Triticum aestivum
MALVSLSLSPPCAPAASSSSSHLLTPPSLAGGSGSIRRGGPRGNAGLALTLPAGRRGREWRAPVSSFSSFLPSFFTGSKKKEEEDAKKAATLKEELLAAIAPLDRGAEATPEDKDRVDQIAQQLEEVNPTKEPLKSELLNGKWELLYTTSTSILQPQRPKFLRPYGTIYQAINTDTLRAQNMETLPYFNQVTANLVPLNSRKVAVRFDYFKIFSLIQIKAPGSGKGELEITYLDEELRVSRGDKGNLFVLKMVDPLYRVPL

SEQ ID NO: 50863 - protein, 391 aa, Haemophilus ducreyi 35000HP
MSVKKMADLDLTGKRLFIRADLNVPVKEGKITSDARIRATIPTLKLALQKGAKVMVTSHLGRPTEGVFEEANSLQPVVDYLNASDLGVPVRLVRDYLDGVEVNQNEIVVLENVRINKGEKKNDAELAKKYAALCDIFVMDAFGTAHRAECSTYGIAEFAPIACAGPLLAAELEALGKALKEPQRPMLAIVGGSKVSTKLTVLDSLSKIADQLIVGGGIANIFIAAEGHNVGKSLYEADLIPEAKRLASTTHIPVPVDVRVGTEFSETATATEKLVSEVTADESIFDIGDKSAEELAHIIKSAKTIFWNGPVGVFEFANFRKGTEIISNAIAEATANGAFSIAGGGDTLAAIDLFGIADKISYISTGGGAFLEFVEGKVLPAVEILEKRANS

SEQ ID NO: 50864 - protein, 329 aa, Klebsiella pneumoniae subsp. pneumoniae MGH 78578
MHITYDLPVSIDDILEAKQRLAGKIYKTGMPRSNYFSERCQGEIFLKFENMQRTGSFKIRGAFNKLCGLTAAEKRKGVVACSAGNHAQGVSLSCAMLGIDGKVVMPKGAPKSKVAATCDYSAEVVLHGDNFNDTLAKASDIVELEGRIFIPPYDDPQVIAGQGTIGLEILEDLYDVDNVIVPIGGGGLIAGIAIAIKSINPTIRIIGVQSENVHGMAASWYAGEITSHRHAGTLADGCDVARPGKLTYEIARQLVDDIVLVSEDDIRQSMVALIQRNKVITEGAGALACAALLSGKLDSYIQNRKTVSLISGGNIDLSRVSQITGFVDA

SEQ ID NO: 50865 - protein, 483 aa, Burkholderia vietnamiensis G4
MHEVSLLIDGVSRGASDGGTFDRIDPATGQVASRAAAATLADADAAVAAAARAFPAWAALAPTERRRRLLAAADRMDARAGEFIETGRAETGAMANWYGFNVMLAANMLREAAAMTTQIDGAVIPSDVPGSIAMAVRQPCGVVLGIAPWNAPVILATRALAMPLACGNTVVLKASEGCPGVHRLIGSVLHDAGLGDGVVNVITHAPQDAPAIVERLIANPAVRRVNFTGSTRVGRIVATLAAQHLKPALLELGGKAPVLVLDDADLDAAVDAVAFGAFFNQGQICMSTECVIVDRKVADAFVERLVAKARTLKAGNPAAPGVVLGTLESAAAAQRIAAMVADAHAHGAALPLGCEVDGAVMQPTIVDGVTREMQLYADESFGPVVTVQRVDGDEAALAAANDSEYGLSAAVFSRDIARAMQLAKRIESGICHINGPTVHDEAQMPFGGVKASGYGRFGSKASIAEFTDLRWITVQTTPRHYPI

SEQ ID NO: 50866 - protein, 481 aa, Triticum aestivum
  misc_feature (462)..(462): Xaa can be any naturally occurring amino acid
MASTAAPPAAIVARRAASASVAAAPLRRAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGXELPGVVALDEGVMTRSVSV

SEQ ID NO: 50867 - protein, 483 aa, Staphylococcus epidermidis RP62A
MVEKLKNEWLNQPGKNILAGIVVALALIPEAIAFSIIAGVDPMVGLYTSFIIAVVTAIVGGRAAMISGATGAIALLIVPLVKDYGVEYLLAATILMGLIQLILGLLKVGRLMKFIPRSVMIGFVNALGIMIFMSQIEHIFGISISTYIYVIVTLLIVYIIPRFFKAIPAPLIAIIVLTALYMYTGSDVRTVGDLGNIKQAFPHFLIPNVPFNLETLQIIFPYSLSMAIVGLVESLLTAKIVDDATDTYSSKNRESCGQGIANMITGLFGGMGGCAMIGQSVINVKSGANSRLSTFTAGIVLIFMIIVLGGLVVQVPMPILAGIMVMVSVGTFDWNSFKYIKKAPKTDAVVMLITVIIVLMTHNLALGVVAGVVFSALFFATKISKVEVISEEFGKINRLSFKGQIFFVSIDSMMEQINFEIENSTIELNFNNAHLWDDSAVDAIDTIVRKFEEKNNIVRVEKLNSDSRKVVSELSQLNENHLN

SEQ ID NO: 50868 - protein, 387 aa, Haemophilus ducreyi 35000HP
MPLNLSNIRTQITQLDHDLLKLLAERHQLAFDVLRDKQITEIPLRDRTRETELLNALIKYAEAQQYDLDEEYITQIFQCIMKDSILTQQAYFKDNLKQERENNKKISIAFLGMAGSYSSMAAKQFAKKQQNVMIELNCNSFQEVFEKVEGDLAQIGILPLENSTSGSINEVYDLLQHTNLTIIDEIVYPIKHCILANREATLEDIDTIYMHPEHEKQCSQALEKLGKIDIKYCKSSSHAMSLAACLNKPNIAALSSEAGGKLYDLTNIKTNITNQEHNITRFIIVAKKAVPVSPQLQTKILLLMTSKKQAGILVDVLSIFKQHKIRMLKLVSRPIYGEDWEEMFYVELEANIDSAKTQQALAELQKITCYLKVVGCYPSEVVQPVQP

SEQ ID NO: 50869 - protein, 351 aa, Rhodopseudomonas palustris CGA009
MSVTFRAAVLHELNRPLSIETVEAPPLAAGQLLVKLAYSGVCHSQVMEARGGRGPDRYLPHMLGHEGSGVVVEIGGGVTKVKRGDRVILGWIKGQGADTQGVRYASGERVINAGAVTTFNEYAVVAENRVTPLPAGLPMDVAVLFGCALPVGAGIVINIAKPQPGATLAIFGLGGIGLAALMACKLFACNQVIAVDVEAAKLKMATELGATTVIDASRIDPVEEIRRLTGGLGVDYAIESAGLTRVIEQAFDATRRFGGLCVFASHPRSGEKIALDPFELICGKRILGTWGGDSKPERDIELLAGLYRDGKLPLDAMFTRRYKLDEINEALDDLEHRRSVRPLIEIDPSLR

SEQ ID NO: 50870 - protein, 364 aa, Ralstonia solanacearum GMI1000
MSLQCGIVGLPNVGKSTLFNALTKAGIAAENYPFCTIEPNVGVVEVPDQRLSALADIVKPERVLPAVVEFVDIAGLVAGASKGEGLGNQFLANIRETDAITHVVRCFEDENVVHVAGKVDPIADIEVINTELALADLATVEKALARYSKAAKSGNDKEAAKLVAVLEKARSVLDEAKAVRTLSLSDEEWALLKPLCLITAKPTMYVANVKDDGFENNPHLDAVRAYAAQTGSPVVAVCAAIEAEIADLDDADKTEFLADMGMDEPGLNRVIRAAFKLLGLQTYFTAGVKEVRAWTIHIGDTAPRAAAAIHTDFERGFIRAQTIAYDDFIQYKGEQGAKEAGKMRAEGKEYIVKDGDVLHFLFNV

SEQ ID NO: 50871 - protein, 172 aa, Glycine max
EEEGVEPPRVRPRVRPRVRSKSGRVTEARKLLRVMAEKGYFPDEVTYTSLMNGLCRKGDALGALALLGEMEAKGCSPNACTYNTLLHGLCKARLVEKAVKFYQVIRAGGLKLDTASYGTFVRALCRDGRIAEAYEVFDYAVESKSLTDVAAYSTLESTLKWLRKAKEQGLAI

SEQ ID NO: 50872 - protein, 128 aa, Triticum aestivum
  misc_feature (28)..(28): Xaa can be any naturally occurring amino acid
  misc_feature (35)..(35): Xaa can be any naturally occurring amino acid
  misc_feature (42)..(42): Xaa can be any naturally occurring amino acid
  misc_feature (44)..(44): Xaa can be any naturally occurring amino acid
PFFWPKHKLSLTLRPGKTGRAGFVAAAXIAVCPGXISRSRRXSXGQGGVAIFALLLTFYLFVRAVNTGSLAWSLAAAFGYFYMVSAWGGYVFIINLLPLYVLVLLVTGRYSQRLYVAYNCTYVLGMLL

SEQ ID NO: 50873 - protein, 435 aa, Ralstonia solanacearum GMI1000
MQLLTLGINHHTAPLSLREKVAFPLEQLKPALGTLRQHLPHRKSTAEAAILSTCNRTELYCATDGNLPEDTAHEHAIRWLAHHHNIDAGELAPHVYALGQSQAVRHAFRVASGLDSMVLGETQILGQMKDAVRTATEAGALGTYLNQLFQRTFAVAKEVRGTTEIGAHSVSMAAAAVRLAQRIFESIAEQRVLFIGAGEMIELCATHFAAQKPRETVVANRTLERGEKLAEALSNQGLNARAVRLAELPARLGEFDIVVSCTASTLPIIGLGAVERAIKQRRHRPMFMVDLAVPRDIEPEVARLSDVFLYTVDDLGAIVREGNALRQAAVAQAEAIIETRVQNFMHWLDARSVVPIIRDLHAHAEALRQGELERAQRMLARGDDPALVLEALSQALTKKFLHGPTHALNHAQGEGREQLIDLLPGLFRQSSHSER

SEQ ID NO: 50874 - protein, 165 aa, Kalanchoe daigremontiana
MSSTFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 50875 - protein, 334 aa, Arabidopsis thaliana
MATATSHQSVVSFASLRSSPSSTISQCGFKIDSSLSFTSKKTNFCKIKAMASSVSYDNTLLSPSKTIPDNSQKKSNEAALILIRRGESLWNEKNLFTGCVDVPLTEKGVEEAIEAGKRISNIPVDVIFTSSLIRAQMTAMLAMIQHRRKKVPIILHDESEQAKTWSQVFSDETKNQSIPVIPAWQLNERMYGELQGLNKQETAERYGKEQVHEWRRSYDIPPPKGESLEMCAERAVAYFQDNIEPKLAAGKNVMIAAHGNSLRSIIMYLDKLTCQEVISLELSTGIPLLYIFKEGKFMKRGSPVGPTEAGVYAYTKRLAQYRQKLEDDSEVLCA

SEQ ID NO: 50876 - protein, 164 aa, Vigna radiata var. radiata
MASFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 50877 - protein, 461 aa, Arabidopsis thaliana; identical to SEQ ID NO: 1437

SEQ ID NO: 50878 - protein, 285 aa, Cryptococcus neoformans var. neoformans JEC21
MPQQEQLPSKDYGIREIWADNLESEFAALRQAVERYPYISMDTEFPGIVARPIGNFKTGSDYHFQTMRCNVDMLKIIQLGITLCDENGDSPEVSTWQFNFAFSLGEDMFAPDSIDLLKSSGIDFKRNEEEGIDVEYFGELLITSGLVLFDNIKWVSFHSGYDFGYLLKILTCEPLPADETDFFRLLFIWFPCIYDIKHIVRSIKTLRGGLQEIAESLGVKRIGPQHQAGSDSLLTAAVFFRIQTIYFDGHLNDDYYKNYLYGFSSGRLGKASPAAAGENLVDKPY

SEQ ID NO: 50879 - protein, 421 aa, Corynebacterium glutamicum
MALVVQKYGGSSLESAERIRNVAERIVATKKAGNDVVVVVSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDITFTCPRSDGRRAMEILKKLQVQGNWTNVLYDDQVGKVSLVGAGMKSHPGVTAEFMEALRDVNVNIELISTSEIRISVLIREDDLDAAARALHEQFQLGGEDEAVVYAGTGR

SEQ ID NO: 50880 - protein, 335 aa, Methanopyrus kandleri AV19
MNASPTVVVIPGDGIGPEVIDAALKVVRAVLGDELEIVEEQAGYSLWKKRGVTIEDETIERCREADAMLFGACTTPEDPEAKSPIVTLRKELGLYANVRPARSWPVPRPVDTEFDLVIVRENTEGLYTGCECEIHDGVTVALRKISEEGTRRVAEVACDLAEERSGRVTIVHKANVLKLTCGTFKRVAAETVERRGLEWDDEYVDAAAYKLVREPDSFDVILTSNLFGDILSDLAAGLMGSLGLAPSANLGDDAALFEPVHGSAPDIAGKGIANPVAAILSAAMMLDHLGYGEEARIIERAVEEVLREGVRTPDLGGSATTEEVAEAIAERVATG

SEQ ID NO: 50881 - protein, 371 aa, Campylobacter jejuni RM1221
MSEMSLIMLAAGNSTRFNTKVKKQFLRLGNDPLWLYATKNLSSFYPFKKIVVTSSNITYMKKFTKNYEFIEGGDTRAESLKKALELIDSEFVMVSDVARVLVSKNLFDRLIENLDKADCITPALKVADTTLFDNEALQREKIKLIQTPQISKTKLLKKALDQNLEFTDDSTAIAAMGGKIWFVEGEENARKLTFKEDLKKLNLPTPSFEIFTGNGFDVHEFGENRPLLLAGVQIHPTMGLKAHSDGDVLAHSLTDAILGAAGLGDIGELYPDTDMKFKNANSMELLKQAYDKVREIGFELINIDICVMAQSPKLKDFKQAMQSNIAHTLDLDEFRINVKATTTEKLGFIGRKEGMAVLSSVNLKYFDWTRL

SEQ ID NO: 50882 - protein, 457 aa, Legionella pneumophila str. Lens
MLNPREIRTIEDAKRIVEERQLTHVKVGLFDIDGVMLGKYMSRNKFFSALEHGFAFCDVILGWDSKDKLYDNVKYTGWHTGYPDASVRIIPSTCREILFEENQLLFMAEFSQAAEAICPRGILRRVINKAAGMGYDVYAALEYEFFVFDETPDSVRAKGFRNLKPVTPDNFGYSIIRNTVHAEFYHQILTMAEKMDFPIEGLHTETGPGVLEAAIAVDDAEAAGDKAALFKTFMKILAQRNNKMATFMAKWSGDYPGQSGHIHLSLRDRDGGKSAFYESGREYNMSKIQRHFLAGQQKLMPEFLAMLSPTVNSYSRLIPGYWAPTEATWGVENRTTALRVIPGSDKSQRIEYRLGSADANPYLALAAAIGSGLYGIENELEPEAEVKGNSYEQHHSPELALPRTLWESAQNLKNSSAAYELFGQEFVEHFAASREWEEREFRKHITDWELDRYFEII

SEQ ID NO: 50883 - protein, 519 aa, Synechococcus sp. PCC 7002
MTDAATIQKIKLTKIEQAKQAKPGLAIKDELATLAQAGWEAMDQDDLIIRLKFLGLFHRPVTPGKFMLRLRTPHGILNSAQVRALAEIVQRYGEDGSADITTRQNIQLRGIRLEDTPEILTKLKQVGLTTVQSGHDNVRNITGSPVAGIDPEEYFDTRELAAQLQNMITNYGEGSLEFSDLPRKFNICLEGAPDNSSHVEINDIGFVPAFKDGQFGFNVLVGGYFSAQRQAEGISINVWVPPNEAVLAVSRGILALYTRHSAEEGLRGNRAKARVLWLVEAWGVNAFRARLEAEIGQSLEPAAPEHALTMDKRDHIGVYAQKQAGYHYVGLHVPAGRLTAEDMFEVARLAETYGNGEIRATVEENFIIPYVKSENVEALLQEPLLEKFSVNPSTLVRSFVSCTGNRYCNFALVETKEQGLALARELDAELDIPQRVRMHWTGCPNSCGQAQVGDIGFIGSKAKVDGAIVEAVNVLTGGTVGNQASLGAPVAQKVPCGDTLKATVKHILIEQFGATPKSE

SEQ ID NO: 50884 - protein, 466 aa, Clostridium acetobutylicum ATCC 824
MPEHVGKIVQVIGPVVDIKFDAENLPDIYNSIEIDMGDNKKLIAEVEQHVGDDIVRTIAMEGTDGLKRGMEAVNTGKPISVPVGENVLGRLFNVLGQTIDEAGDMNADKYYPIHRPAPTFEEQSVQPEMFETGIKVIDLLAPYQKGGKIGLFGGAGVGKTVLIQELINNIAKEHGGLSVFTGVGERTREGNDLYYEMKDSGVINKTALVFGQMNEPPGARMRVALTGLTMAEYFRDKGQDVLLFIDNIFRFTQAGSEVSALLGRIPSAVGYQPTLANEMGALQERITSTKQGSITSVQAVYVPADDLTDPAPATTFTHLDATTVLSREISNLGIYPAVSPLESTSRILDPRIVGEEHYEVANKVKHILERYQELQDIIAILGVDELSDEDRLLVGRARRVQRFLSQAFSVAEQFTGMKGQFVPVKDTIRSFKEILDGKCDDLPEAAFLFAGTIEDVKEKAKKMMES

SEQ ID NO: 50885 - protein, 363 aa, Arabidopsis thaliana
MAKDGPNWDGLLKWSLSHADGTRPTRQLSEEDRKWFMEAMQSQTVDVVKRMKEITLVMQTPEQVLVEHGVTPEDIQDLLDELQEHVESIDMANDLHSIGGLVPLLSFLKNSHANIRAKAADVVSTIVQNNPRSQELVMETNALESLLSNFTSDTDIHARTQALGAISSLIRHNKPGVTAFKLANGYAGLRDALASDSVRFQRKALNLLQYLLQQDDSDRSIATGLGLPRVMMHLASSDDAEIREAALRGLLELSREKNDGSSSIDKSDEKLRQLLEERIKGITLMSQEDLETVKEERQLVDLLWSICYNEPSSLREKGLVVLPGEDALPPDVASKLFEPPLRASAANRNATEKKDEPMKLLGP

SEQ ID NO: 50886 - protein, 399 aa, Bacillus cereus E33L
MDTLIFEVGTALVLVAIAAVIAGKFKFSVIPFLIVLGMLVGPHAPTIGVIDFKFIESANVISFLGRIGVLFLLFYLGLEFSMKKLIKSGRSIAIGGTIYILINFSLGLLYGFIIGFPLLEILIIAGIITISSSAIVAKVLVDLRRTGNNETELILGIIMFEDIFLAVYLSVVSGLVLGDHASFLGALTSIGIALGYMLLFFIVARKATTLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESKNVYKLLNKIFKWDMKKS

SEQ ID NO: 50887 - protein, 267 aa, Escherichia coli O157:H7 EDL933
MAIPAFGLGTFRLKDDVVISSVKTALELGYRAIDTAQIYDNEAAVGLAIAESGVPRHELYITTKIWIENLSKDKLIPSLKESLQKLRTDYVDLTLIHWPSPNDEVSVEEFMQALLEAKKEGLTREIGISNFTIPLMEKAIAAVGAENIATNQIELSPYLQNRKVVAWAKQHGIHITSYMTLAYGKALKDEVIARIAAKHNATPAQVILAWAMGEGYSVIPSSTKRENLESNLKAQNLQLDAEDKKAIAALDCNDRLVSPEGLAPEWD

SEQ ID NO: 50888 - protein, 346 aa, Pseudoalteromonas tunicata D2
MKYLVTGAAGFIGSFVAERLCEMGHQVIGLDNLNDYYDPALKLARLKRIEHFANFTFIKMDLADRDAIAALFARAQFDCVIHLAAQAGVRYSIDNPMAYIDSNLVGMATVLEGCRHNKVQHLVYASSSSVYGANTKVPFAESDQVDHPVSLYAATKKSNELMAHTYSHLYQLPTTGLRFFTVYGPWGRPDMAPFLFTDAIAHQRPIKVFNHGNMRRDFTYIDDIVEGVIRIQALIPAPNKVELNKELNEELSKGTTQQSRSPYYQLYNIGNNQPETLEHFISCIETALGKKAIKEYLPMQAGDVIQTYADVSSLESAIDFKPNTTLADGISQFVNWYTDFYKPSGF

SEQ ID NO: 50889 - protein, 465 aa, Frankia sp. EAN1pec
MSTPEAGSPLRISVIGTGYLGATHAICMSELGFDVVGVDVDQDKVRRLADGEVPFFEPGLEELLRKNLETGRLAFTTSFADAANADVHFLCVGTPQRADSGAADMSYVDGAVERLLAAQPKAGSLLVGKSTVPAGTAVRLADWLAREAPEVDLAWNPEFLREGFAVEDTLRPDRLVFGLPADDEWYGVADRTDQGDHTGRRVRVEARLREVYATALAAGTPAVVADFATAELVKVAANAFLATKISFINAMSEVCEVAGADVKTLASALAYDTRIGGRFLGAGLGFGGGCLPKDIRAFQARAEEMGAGPALGFLSEVDRVNLRRRSRTVELAIHLLGGGAAGRRVAVLGAAFKPNSDDIRDSPALDVADALRKAGARVTVYDPAAMANAARKFPDLRYASGVSEAVTDADVVLHLTEWADFREIEPSLLTSLVRRPVIIDGRNTLDPQRWRAAGWIYHALGRPNV

SEQ ID NO: 50890 - protein, 125 aa, Brassica napus
  misc_feature (124)..(124): Xaa can be any naturally occurring amino acid
MNANTSQKLEALVSDGVPVNVYIWDMDETLILLRSLLNGTYAESFNGSKDVKRGVEIGEMWEKHILKICDDCFFYEQVEDCNEPFIDSLREYDDGKDLSSYDFKQDEFTSPTDDLNKRKLAYRXR

SEQ ID NO: 50891 - protein, 577 aa, Klebsiella pneumoniae subsp. pneumoniae MGH 78578
MDAAAVISLFILGSVLVTCSILLSSFSSRLGIPILVIFLAIGMLAGIDGIGGIPFDNYPFAYMVSNLALAVILLDGGMRTQASSFRVALWPALSLATVGVLITSALTGMMAAWLFKLDLIEGLLIGAIVGSTDAAAVFSLLGGKGLNERVGSTLEIESGSNDPMAVFLTITLIEMIQQHQTGLSWMFAVHIIQQFGLGIAIGLGGGYLLLQMINRIVLPAGLYPLLALSGGIMIFAVTTSLDGSGILAVYLCGFLLGNRPIRNRHGILQNFDGLAWLAQIAMFLVLGLLVTPSDLLPIAIPALLLSMWMIFIARPLSVFAGLLPFRGFNLRERVFISWVGLRGAVPIILAVFPMMAGLDNARLFFNVAFFVVLVSLLLQGTSLSWAAKKAKVVVPPISWPISRVGLDIHPENPWEQFVYQLGADKWCIGAALRDLHMPPETRIAALFRNNVLLHPTGSTRLREGDILCVIGREHDLPALGKMFSQSPPVALDQRFFGDFILDAEARFADVAQIYGLDGGEEFREHQQSLGEVVQQLLGAAPVVGDQVEFAGMVWTVAEKENDHVLKVGVRVAEDEAE

SEQ ID NO: 50892 - protein, 167 aa, Zea mays
MAGWRMGFAVGNERIIAALARVKSYLDYGAFTPVQVAATAALNGPDDCIREMRDTYRKRRDALVESFGRAGWDIPPPQASMFAWAPLPKAFEAVGSMQFATLMVEKSGVVVSPGVAFGEHGEGFVRIAMVENEQRIRQAARGVRRFLESGIETLHNVVPLANDADPS

SEQ ID NO: 50893 - protein, 571 aa, Bradyrhizobium japonicum USDA 110
MRWMAAAIVSVSLVTFGAVRAASVAPVAAQNGMVVSAQHLATQVGVDVLRRGGNAVDAAVAVGYALAVVYPAAGNLGGGGFMTIQLADGRKTFLDFRETAPKGATANMYLDKDGNVIKGLSTKGHLAVGVPGSVSGMEYAREKYGTMKRADLLAPAIQLAEQGFALDQGDIDLLRTATADFRDDPATAAIFLNNSQPFQVGERLMQPELAKTLREISSKGTDGFYKGWVGSAIVASSQAGKGLLTQDDLDGYKTRELAPVECDYRGYHVISAPPSSSGGVIICEILNILEGYPLKELGYHSAQAVHVQIEAMRHAYVDRNSYLGDPDFVKNPLDRLLDKNYAANIRAVIDPNKAGISKDIKPGVAPHEGSNTTHYSIADKDGNAVSVTYTLNDWFGAKVTAAKTGVLLNDEMDDFTAKVGVPNLYGLVQGEANAIAPGKRPLSSMSPTIVTKDGKTVMVVGTPGGSRIITAVLQTMINAIDYGMNAQEAVDMPRIHQQWLPDLTNVEDYALSPDTRKILEVMGHKFGPPQPANHLAVIIVGAPSLNGEQVGNNRYYGANDPRRNSGLADGY

SEQ ID NO: 50894 - protein, 255 aa, Bradyrhizobium japonicum USDA 110
MAEAAIMASDGLWQRVRGEAQRAADADPVFGKALAGTILAHDDFAAALSDLIGRRLGGSAAERARFSAFSFDAFRGSPDLIEVAGRDLQAIAIHDPAIADLLPPLLHFKGYVALQAWRVSNWLWHHDHRDAALLFQNEASNALQVSIHPAASIGSSVYLDHATGIVIGANVVIGDEVTILQNVSIGRGSELPTRSPRIGRGIYIGGGATILGDIRVGDFAKIGADALVTSDVPAGCTAVGNPARLTNCPEPASAA

SEQ ID NO: 50895 - protein, 115 aa, Zea mays
VWGSLLLRQPPPAAAGSTGGALIDVAAAVESDKLMGAGPVILNALPPPIVLLHGVFGFGKGRLGGLFYFPGAEKKDHRVLVPDLGALTSFHDRAPELFYFLKGGQVDYRQEHNKG

SEQ ID NO: 50896 - protein, 504 aa, Arabidopsis thaliana
VALETEFFTEYGEASRYQIQEVIGKGSYGVVASAIDTHSGEKVAIKKINDVFEHVSDATRILREIKLLRLLRHPDIVEIKHVMLPPSRREFRDIYVVFELMESDLHQVIKANDDLTPEHYQFFLYQLLRGLKFIHTANVFHRDLKPKNILANSDCKLKICDFGLARVSFNDAPSAIFWTDYVATRWYRAPELCGSFFSKYTPAIDIWSIGCIFAEMLTGKPLFPGKNVVHQLDIMTDLLGTPPPEAIARIRNEKARRYLGNMRRKPPVPFTHKFPHVDPLALRLLHRLLAFDPKDRPSAEEALADPYFYGLANVDREPSTQPIPKLEFEFERRKITKEDVRELIYREILEYHPQMLQEYLRGGEQTSFMYPSGVDRFKRQFAHLEENYGKGEKGSPLQRQHASLPRERVPAPKKENGSHNHDIENRSIASLVTTLESPPTSQHEGSDYRNGTSQTGYSARSLLKSASISASKCIGMKPRNKSEYGESNNDTVDALSQKVAALHT

SEQ ID NO: 50897 - protein, 668 aa, Arabidopsis thaliana
MEYEEYEEVSLPLIHEHLMMPCNYLTRADCCGRFGFTSGGYYCESCSFLVHRKCVEDSSEYIEHPSHSVHPLKLQSKPDHICDICDKRIVDLCYHCEICDFNVDLYCAKYPPPKVIDISETHHHKLTLLKKGIKFDCGASKCGEVMYGFPYKCHECDLAFHVDCVWNPPEAKNPSEVNHSHHPLHPLKLHIGQPPDYSDGKCRLCAQKICDRLFYHCSACNFSLDMCCLLNPPSQYVMDLKVHAHELTFRPRLDSFTCNACGLSGDRNPYICVQCDFMIHQECLDLPRLININRHDHRVSRTSVLGVVNSVCGVCRRKVDWTWGGYSCQRCPHYVVHSKCATREDVWNGKELEGVPEEIEDVEPYVVIDENTIQHFSHKEHYLRFHVSALLWEENKRCNACTQPIGLQSFYGCVVCDFILHQNCAESPRKKWHFLHNERLTLVTSKDDYFHCTACDRLSNGFMYQCGDMKLDVLCGSISEPFVHPSHPHHPLYYIPPEEEKQCNGCDNWSSLVLTCIESGCRYFLCFDCARLPQVVKHRVDAHPLSLCYGEKASGKYWCDICEKETNPSTWFYTCKDHRASLHTKCVMGDFARLMPGSTLTYSHISYEVVRNNSMSRPFCRACESHCMYPIILKVLGSSALYICSLNCVDGFWYPKIVSGIKKRQPAK

SEQ ID NO: 50898 - protein, 1021 aa, Rhodopseudomonas palustris CGA009
MAEDTPGGHLGRIDAVPDSLFLGRGELASLMRAFDWASTPIGPPESWPQALKTAVRIMLTSQQPIWIGWGTELTYLYNDPYKSIIGGKHPWALGRPTSEVWSEIWEDIAPLLAKATSGHEGTYVEAQLLIMERNGFPEETYYTFSYSPIPTDDGSPGGIFCANTDDTQRVITERQLSLLRDLAASAAESRSVGQACERSAAALATDPQDLPFALIYLTDLGGGHAELAASSGIDASHPAVKPTLALAGGDKPWPVAETFRLNAPVVVPDLRDRFGVAFPTGGWRQPPTRAVVLPIPASGDTGRSGLLIAGLNPFRLYDSAYQDFLALVSGQISSAITNADAYQEERRRAEALAEIDRAKTAFFSNVSHEFRTPLTLMLSPLEEALGRDGIADEQRTLLGIAHRNGLRLLKLVNTLLDFARIEAGRVTAHFTPVDLSSFTAELASNFRSALDRAVLRFVIEAPPLPQPVYVDRDMWEKIVLNLLSNAFKFTFEGEIVVRVGPDPDGRHAVIEVSDTGTGIPEAEIPHLFERFRRVEGARGRSIEGSGIGLALVQELIKLHSGSIDVESEIGRGSTFRVTLPFGSAHLPADRPRHAALQVSTNVRAQAYLDEAIGWLDEGGDADLPPASGAQDLGIVSAPAAGRPHILLADDNHDMRDYVARLLGDAYEVEAVGDGVAALEAVKKRRPDLVLSDVMMPRLDGLGLLKALRSDPAVADLPVIFLSARAGEEAKLEGLEAGADDYLSKPFSARELLTRVRANLDTAAIRRTALRTEYALRQEAQAARKHAEGILASISDGFIALDEQYRFTYVNAAAERLIASTAEELIGKVYWDVYPMMLGTKIEQAYRRAMTERVACEFESYHPPSKRWFELRVAPTNGKSISVYFRDITEQKKAEAALRDINEQLEEQVAERTAELQQKEARLRTIFAASYTYQALLDVDGVVLDANRTSLAGIGGQLEDVIGKPVWATPWFGSTPGLPEMIRSDIAVVAAGETVRRELHVNLPAGAGSICRCARCKTRRAR

SEQ ID NO: 50899 - protein, 520 aa, Wolbachia endosymbiont of Drosophila melanogaster
MSAIAIIDFGSQFTQLIARQVRGMGVYCEIFPSNISFETISKFNGFILSGGPQSVNDDCSETSRVVHEIIKLNEATSVPILGICYGQQLICHYFGAKVKESFKQEFGRTKIKILKESPIVKDTWDVNSEVDVLMNHADSVDTIPQGFTVIASGVINQTIAMIVNEQRKIYCTQFHPEVKPTTNGSKLLSNFLDIANCKRDWTMKSFIEEQKEKIKNVVGEKKVIAAVSGGVDSSVAAALTHKAIGKQLNCIFIDTGLLRKNQTIAMLKEIPINYVDKSNLFLSRLKGITDPEEKRKIIGNTFIEVFEEEAKKIGDVDFLMQGTIYSDVVESGHASDNTSTIKSHHNVGGLPEKMNLKLVEPLRYLFKDEVRLLGKEIGLSDEIIFQHPFPGPGLAVRIISEVDKEKVQILQEVDEIYINTMKNYDLYDKIWQAFAVLLPIKTVGVMGDGRTYGYVCALRAVTSSDGMTADAFPFEDKDQHLLVFWDFLRNVGSIIVNNVPGVNRVVYDITSKPPATIEWE

SEQ ID NO: 50900 - protein, 330 aa, Oryza sativa
  misc_feature (45)..(45): Xaa can be any naturally occurring amino acid
MLRPAAAAAGRAIRRAAYHSDGAPPPRKLRGPRFSPLNRHNHEMXCLILRTLMCRLMRCSRKSRIRRSILARQQILVQNVLRSWVIAAAVLSGYCWGYNRVAKRPVAGSEPPTEDEAGQWGEAGEEVGAVAAAGVGGGCDGGEWRASASAAAATWEKGRASPHGRGGAEVVHGGERAGARPPVEEDLPRRRWCMPSAASDDATLGRHLACRLVQVGISDVFAVPGDLNLTLLDHLIAEPGLRVVDCCNELNTGYAANGYAWARGMGTCTVTFTVCGLLLHGRRHRSHWFWNQETGDEAGAAFRNQERASASPSLPSAVARRSGSVVVGGG

SEQ ID NO: 50901 - protein, 606 aa, Arabidopsis thaliana
MQQDNRKKNNLEMEFFSDYGDANRFKVQEVIGKGSYGVVCSAIDTLTGEKVAIKKIHDIFEHISDAARILREIKLLRLLRHPDIVEIKHIMLPPSRREFKDIYVVFELMESDLHQVIKANDDLTREHYQFFLYQLLRALKYIHTANVYHRDLKPKNILANANCKLKICDFGLARVAFNDTPTTIFWTDYVATRWYRAPELCGSFYSKYTPAIDIWSIGCIFAEVLMGKPLFPGKNVVHQLDLMTDLLGTPSLDTISRVRNEKARRYLTSMRKKPPIPFAQKFPNADPLSLKLLERLLAFDPKDRPTAEEALADPYFKGLAKVEREPSCQPITKMEFEFERRKVTKEDIRELISREILEYHPQLLKDHMNGADKASFLYPSAVDQFRRQFAHLEENSGKTGPVAPLERKHASLPRSTVIHSTAVARGGQPKLMNNTNTLNPETTQNIPFNHATIQAQQRNLSAAKPSTFMGPVAPFDNGRISRDAYDPRSFIRSTNLPFSQQSAATVAMGKQQERRTTMEPEKQARQISQYNRYAPDVAINIDNNPFIMARTGMNKAENISDRIIIDTNLLQATAGIGVAAAAAAAAPGGSAHRKVGAVRYGMSKMY

SEQ ID NO: 50902 - protein, 447 aa, Pseudoalteromonas tunicata D2
MKVTFYGIGYVGLVQATVLADAGHDVCCVDINETRIENLKKGIIPIYEPGLTPLVEKNFAEGRLTFTTDAEFGVNFGDLQFIAVGTPPDEDGSADLQYVLKVAETIATHMTSAKVIIDKSTVPVGTADKVRAKAQQVLDSRGSDLTFAVVSNPEFLKEGAAVNDCKRPDRIVIGTDSADAEELMRELYAPFNRNHEKIIVMDIKSAELTKYAANCMLATKISFMNEMANIAERVGADIEHVRQGIGSDSRIGFQFIYPGCGYGGSCFPKDVQALVRTADGIGYESQILKAVEAVNYAQKNKLFEYISKHFGVGIDGKDLSGKTFALWGLSFKPNTDDMREAPSRVLMEQLWAAGAKVQAYDPEAMEETQRIYGSRPDLSLMGTKESALNGADALIICTEWQNFKAPDFSLIKQQLSEAVIFDGRNLFEPTRMKKKGFVYWSIGRLAQ

SEQ ID NO: 50903 - protein, 310 aa, Pseudoalteromonas tunicata D2
MKVQKAVLPVAGLGTRMLPATKATPKEMLPLVDKPLIQYVVNEAVAAGIKEIILVTHASKNSIENHFDTSFELEATLEARVKRSLLDEVRSIVPKDVTIISVRQSAPLGLGHAVLAARPIVGDNPFVVLLPDVIIDKYQSNPKVDNLSQMIKRFEATGFNQIMVEPVPHELVNQYGVVDLKGAAIAAGDNAVVHDMVEKPAIDEAPSNFAITGRYVLSSAIWDLLEFTPPGAGGEIQLTDALHQLRILETIEAYHLKGKSHDCGSKLGYMMANVEYAMQCDNLGEQFKAALHSLLAIENAKTSSKQTNKA

SEQ ID NO: 50904 - protein, 446 aa, Pseudoalteromonas tunicata D2
MKVTFYGIGYVGLVQATVLADAGHDVCCVDINETRIANLKKGIIPIYEPGLTPLVEKNFAEGRLTFTTDAEFGVNFGDLQFIAVGTPPDEDGSADLQYVLKVAETIATHMTSPKVIIDKSTVPVGTADKVRAKAQQVLDSRGSDLTFAVVSNPEFLKEGAAVNDCKRPDRIVIGTDSADAEELMRELYAPFNRNHEKIIVMDIKSAELTKYAANCMLATKISFMNEMANIAERVGADIEHVRQGIGSDSRIGFQFIYPGCGYGGSCFPKDVQALVRTADGIGYESQILKAVEAVNYAQKNKLFEYITKHFGKDLSGKTFALWGLSFKPNTDDMREAPSRVLMEQLWAAGAKVQAYDPEAMEETQRIYGSRPDLSLMGTKESALNGADALIICTEWQNFRAPDFDLIKSQLNEAVVFDGRNLFEPTRMTKKAIKYYSIGRGLSVTGE

SEQ ID NO: 50905 - protein, 332 aa, Pseudoalteromonas tunicata D2
MKYLVTGAAGFIGNFVSERLCAMGHQVIGLDNLNDYYDPALKLARLKRLEHFTNFTFVKMDLADREAIANLFATEQFERVIHLAAQAGVRYSIENPMAYIDSNLVGMATILEGCRHNKVQHLVYASSSSVYGANTKIPFAEEDRVDYPVSLYAATKKSNELMAHTYSHLYSLPTTGLRFFTVYGPWGRPDMAPFLFTDAIANDKPIKVFNNGKMQRDFTYIDDIVEGIIRIQDVIPAPNKQADNKQAVNKAEGSPFYKLYNIGNNQPVELEQFITCIENALGKKAIKQYLPMQDGDVVRTFADVSGLESEIGFKPNTDLQSGINSFVQWYIK

SEQ ID NO: 50906 - protein, 342 aa, Oryza sativa
DNLTPRYRINAKMGEGTFGQVLECWDRERKEMVAIKIIRGIKKYRDAAMIEIGMLEQLGKYEKSRSSCVQIRNWFDYRNHICIVCEKLGPSLYDFLRKNSYRSFPIALVREVAKQLLECIAFMHELRLIHTDLKPENILLVSPEYIKVPDYKVSSRSPKEGSYFKQLPKSSAIKVIDFGSTTYDQQDQTYVVSTRHYRAPEVILGLGWSYPCDIWSVGCILVELCTGEALFQTHENLEHLAMMERVFGPLPYHMLKRADRHSEKYVRKGRLNWPEGCASRDSMKAVMKLPRLQNLVMQNVDHSGGEFIDLLQGLLRYDPASRLTAQEALRHPFLREQSERRR

SEQ ID NO: 50907 - protein, 492 aa, Aeromonas hydrophila
MKFETISVVGLGYIGLPTAAVIASNGIRVIGVDVNQHAVDTINQGKIHIVEPGLEDLVKQAVQDGHLSAHTSPQKADAFLIAVPTPFKGEEHEPDLKYIESASRALAPMLEKGNLVVLESTSPVGATEQMAKWLAEERSDLTFPHTVAEGQTPDIFVAHCPERVLPGQVIRELVENDRIIGGMDKASTAAATQVYKMFVKKGECIATEARTAEMSKLTRKRLSVTSISAFANELSLILRKAGYQMYWGSQVWTDSLANLTRGSIPATGLRRGRPLHRGRPLVCRSIRTRHRKNHPCRRALVQRLQAALCSGTGGASGCWSEQSEDACLGLAFKPDIDDLRESPALDITKTLANNPAYQILAVEPNIEALPTTLENRNNVKLASLSDALKQADVVVILVKHNSSLVRMAMILPAITCLICQRYSLISLKRWSKYIGHLMLKEPNVSTRLAKKTLEKSTATQQEKHLILFSLFMTNIYTSRSSLSGSGLKNRHD

SEQ ID NO: 50908 - protein, 233 aa, Thermosynechococcus elongatus BP-1
MLSAAEIRDRASHLKSTLPPHVRLIAVSKFMPAAAIRAAYEAGIRDFGESRVQEAASKRAELADLTDITWHLIGHLQTNKVRQALQLFDWIHTVDRWKLAERIDTLLKERGAASPRCLLQVKLRPDPQKYGWEKSDLEAALPQLDALLHLRCWGLMTILPLGLAPSEQLQVFQELRAWGEELSTKGWQQLRWQEYSMGMTQDYPLAVQAGATMVRIGTAIFGDRPSALKIQQQ

SEQ ID NO: 50909 - protein, 281 aa, Picea sitchensis
MGVESELLGVLNVKVIGSGQRILVLAHGFGADQSVWQYILPYLVAHYKVIVFDMVFSGNVDPKHFDFDRYTSLSAYTADLLGILDELKVDKCLYVGHSVSGMVGCLASIERPELFEKLILLCASPRYLNDESYHGGFERGEIDRLYCAMKSDYAAWVSGFAPLAVGVDEPSVVKEFSRTMMNMRPEIALLVARTIFESDMRSILSDVKTPCSIIQTAKDIVVPMAVPYHMQGSLGGKMNSVDILDEDGHLPQLTNPGLLLHAFKRVLEGSEVKLEPTPNVN

SEQ ID NO: 50910 - protein, 396 aa, Thermococcus kodakarensis KOD1
MEFLGYLAVLLVVAKSIEWAFEKAEIHPIIAHVITGILLGPFALGIVKPGKEIEVLAQFGLIMMMLYMGLTSNFSAIAQNTKKATFVAVLGVAFSFILGFATVYLFGKGFSAAVFVGVTLGNTAIEVTSGVLVKERVNRRVSAILMGAAFADDILAVYLIGIITGMASGNFNAQSLLILTGKIFAFIVATLLISEYIFKRSRWFYSVVRNLNVFFTFTLILTFALAIISEWVGLNQIIGAYLAGLTISRLRERKDPLVVTRIKLNELIGDLQVVLTEFFMPLFFIYVGLMFNPPIKDINIFLILALYASAVLGKLIGCGLGSKLVGLPWEDSIAVGIGMGGRGSLELAILTFGLSTGLIDQSIFASVIMVSMLTALTTPIFFKAYLKRQRLKAGES

SEQ ID NO: 50911 - protein, 118 aa, Zea mays
MSGVQEQFEIKFRLPDGTDIGPRRFPPASTVATLKETIIAQWPKDKEKGPRTVNDLKLINAGKILENNKTLSECKSPICDFSAMTTMHVVIRAPTSSKQSDKRAEKKAKNFRCGCAIM

SEQ ID NO: 50912 - protein, 384 aa, Thermococcus kodakarensis KOD1
MFPERGASEEEVLRELEEKTREDLTFDSGKILGSMCTYPHPFAVKVVMKYIDRNLGDPGLHIGSQKIEKEAVDMLANLLGLEKGYGHIVSGGTEANILAVRAMRNLAGIEKPELILPESAHFSFIKAAEMLGVKLVWAELNDDYTVNVKDVEKKITDRTIGIVGIAGTTGLGVVDDIPALSDLALDYGLPLHVDAAFGGFVIPFAKALGYEIPDFDFRLKGVKSITIDPHKMGMVPIPAGGIIFREKKFLDSISVLAPYLAGGKIWQATITGTRPGANALAVWAMIKHLGFDGYKEVVKEKMELARWFASELKKIPGIYLIREPVLNIVSFGSEKLEELEKELKARGWGVSAHRGYIRIVVMPHVKREHLEEFLRDLREIAKRL

SEQ ID NO: 50913 - protein, 375 aa, Oryza sativa Japonica Group
TRISSDMSDPSTPRKIEDAKNISIYNDVIDFTLFELETITKSFRADYVLGEGGFGTVYKGYIDENVRVGLKSLPVAVKVLNKDGHQGHREWLTEVRFLGQLRHPNLVKLIGYCCEDDHRLLVYEFMFRGSLENHLFRRTATPLSWATRMSIALGAAKGLACLHNAERPIIYRDFKTSNILLDSDYTAKLSDFGLAKAGPEGDQTHVSTRVMGTYGYAAPEYVMTGHLTARSDVYSFGVVLLELLTGRKSIDKSRPSREHSLVDWALLKLNDKRRLLQIIDPKLEGQYSVRAAHKACSLAYYCLSQNPKARPLMSDVVETLEPLQGSGGSDGAVQSVLGSGLPSYRVNRRLTTNSVHCRAIPNPKCSPAVPACRVR

SEQ ID NO: 50914 - protein, 352 aa, Leptospira interrogans serovar Copenhageni str. Fiocruz L1-130
MNRVLTYLSPGELDWREMPRPILSHPEDAIVRPVASSTCDLDIMIIQGRTPFKGPFDIGHECIGEIIETGEGVRRFYPGQLVVVSWHISCGQCHRCRKGLMNTCASYPQGAMFGMSIGGKWGGFFSDFIRVPNADISLFVLPPGINPSYVASLSDNIPFGYELTVPHLTRNCGVDVLIMGGTGSIGLFAAAYAKAGGAGSVDYVDTNKMRLGIAEKIGVNPIESPPKQRIGRRPGKYPITVDTSGSSEGLLCAIRSTEPEGYCSSIGGHFGDIAFPMLEMYAKGIHFYTGRGLGRINFEAATDFIISGKVKPELIVTEERPFDEAAEVLRDPSMKPVLVRQTMLSKAYQPKV

SEQ ID NO: 50915 - protein, 144 aa, Mesostigma viride
SLDDLVTILREVKNTKGLGPVLIHVLTDKGKGYHHAEKASDKLHGVVKFDVVSGKQYKAKSKTKPYTQYFAEALIAEAERDPRVVGVHAAMGGGTGMNFFQKRFPERTFDVGIAEQHAVTFCAGLATEGLAPFCTIYSTFLQRG

SEQ ID NO: 50916 - protein, 284 aa, Haemophilus ducreyi 35000HP
MNQTTTFDKLCNYSAACLANWQGKTIVVKYGGNAMISAELKQTVMQNILLLNQYGINVVLVHGGGPEISLGMKLLGKEPQFINGLRVTDQDTIDVVLQMLAGKVNKRLVALLKGKGIGLCGIDGGLIQCEKLEAELDYGLVGNIVQVDITVLQMALAANLIPVIAAVAVDQQGIIYNVNADTVASEIAVALGADKLVLMTDIAGLLADRNDERSLMSRVEVSQVETLIAQGIISDGMIPKVASCTRFINAGGIEAHIIDGRIKHAILLSILSDKQNGTRFYKEK

SEQ ID NO: 50917 - protein, 394 aa, Haemophilus ducreyi 35000HP
MMTSDQIKQLDANYIAQTYAKFDLALSHGQGCEVWDFDGNKYLDFTSGIGVNSLGWADPDWLEAVIAQLHKLSHTSNLFYTEPSARLAKHLVQVSGLKRVFFANSGAEANEGAIKVARKYSHDKYGDTRSTIISLVNSFHGRTISTLAATGQKLFHQHFFPFTAGFEHLIANDLNAFKTRIAQNDICAIILEVVQGEGGVCSLDQAYLQAVQGLCQVQDILLIIDEVQTGIGRTGTMFAYQQFELKPDIVTLAKGLAGGLPIGAFLLADKVAETLAKGDHGSTFGANPVSCAAANAVLTKLEPLFLTEVMRKGQKLRKALQSLPHVKSISGLGLMIGVEFDEHINVADVVTNCLKQGVLFLTAKTKLRMLPPLIINDEQLERGVTVLAQVLSEM

SEQ ID NO: 50918 - protein, 462 aa, Coprinopsis cinerea okayama7#130
MAPSQDPLQVMDGIFQTITSQSASPSNVVSHIKSITPKELRDAALASPLSSGQDPLSVVAGAGYGSASWTVGALYILVARLTVQNAQAPPLDVITDFCKHFDPVQARHVPDRVTALARAIQRLAVAANNPRWAIEPLYLLLTRYPPHLSFLTTIHPIFTLTCLQAKHPTAALPILEVPISNIDTNLSELTYNDNLTYHYTGGIIFAMLKRWKEAEEFFEIVVTAPSTYPSSLQMEALKKMSIGQLIWKGKVSPLPKYTHPLLVRQFKSTPYQAFINAYPHNSESLKELLNKEKNLFQGEKNMGLLRQAVDRAPRWVLKKLTATYLSLNLTEIAKAVKIEDVNEVRGILLSMIEDGDLSATLSSTETETTVTFSDPSPRYNKSQIDALLLNAQAQSEYLLGLDRELGKSKEYLSKAVKGKGGDDGFSVGGMGGAMGAGMGGWPGGVEEELFAAGGASWEDGFA

SEQ ID NO: 50919 - protein, 316 aa, Haemophilus ducreyi 35000HP
MTIFADNSYTIGNTPIVRLKHFGQNGNLLVKIEARNPSFSVKCRIGANMVWQAEKDGILTKDKEIVDATSGNTGIALAYVAAARGYKITLTMPETMSDERKRLLRGLGANLVLTESTLGMKGAIAKAEEIFASDPNRYIMLKQFENPANPAIHQQTTGPEIWQATEGKIDVIVAGVGTGGTITGVSRYIKQDKGKQIISVAVEPKESPVITQTLNGEEVQPGPHKIQGIGAGFIPKNLDLTLIDRVEQVSSEEALKIAHQLMAKEGILVGISSGAAVAAADRLAKLPEFADKQIVAVLPSASERYLSTLLFEGIEI

SEQ ID NO: 50920 - protein, 117 aa, Glycine max
MAEEGQVIGVHSVEEWEEHLKKGQESKKLIVVDFTASWCGPCRFIAPILADMAKKLPNVTFLKVDVDELATVSREWEVEAMPTFLFLKEGKLVKKLVGARKEELQDIIVKLAAIDAA

SEQ ID NO: 50921 - protein, 251 aa, Brassica napus
  misc_feature (219)..(219): Xaa can be any naturally occurring amino acid
STHASAHTMIAHSSSSALAASSPLKETLPLFTTRSLTFPRKSSFSRLRLRFFAEKLSQLDSSNGCASLQDSGEHLTEEHDTKEESSTLSITVVGASGDLAKKKIFPALFALFYEGCLPQDFSVFGYARTKLTHEELRVMISRTLTCRIDQRENCVDKMDQFLKRCFYHSGQYNSEDDFAELNTKLKEKEEGKLSNRLYYLSIPPNIFVDVVRCASLRAXSVNGWTRVIVEKPFGRDSESSGELTRCLKQYL

SEQ ID NO: 50922 - protein, 183 aa, Picea sitchensis
MASPSKRREMDVMKLMMSDYKVEMLNDGMHEFNVEFHGPQDSPYEGGVWKIRVELPDAYPYKSPSIGFVNKIFHPNVDELSGSVCLDVINQTWSPMFDLVNVFESFLPQLLLYPNPTDPLNGDAASLMMRDREQYEQKVKEYCERYARGENGSNCPEESSDDEEVSDDDSESSDDEVAGHADP

SEQ ID NO: 50923 - protein, 486 aa, Pseudoalteromonas tunicata D2
MIMFLPIILAGGCGTRLWPLSRGNFPKQFLTIQDDGLSLLQHTITRLKGLNHAAPMLICNEEHRFIAAEQVRQLGCGHSGIFLEPVGRNTAPAIALAALKAVQNNDDAVLLVLAADHVIEDSAAFVASVEQASILAEQGKLVTFGIVAKNPETGYGYIQRGAALPQGTGFTVAGFVEKPNLATAERYLAENADLAHGEDKWYWNSGMFMFKASRYLAALLEYRPDIYHACVAAMANQDVDHDFVRINKAAFIACPDDSIDYAVMEPLCANADSEDVVVVPMDAGWNDVGGFAALWQVSEQDENGNAFKGDVKAFDTKNTLVFGEDKLVATVGVEDLVIINTKDAVLVAHKDKSQQVKEIVNQLKAEQRPEVTFHREVYRPWGKYDSIDSGSRFQVKRITVKPGEKLSIQMHHHRAEHWIVVSGTAKVTNGDKDILLTENQSTYIPVGVIHALENPGKVDLELIEVQSGSYLGEDDIVRFEDRYGRK

SEQ ID NO: 50924 - protein, 118 aa, Zea mays
  misc_feature (23)..(23): Xaa can be any naturally occurring amino acid
MSGVQEQFEIKFRLPDGIDIGPXRFPPASTVATLKETIIAQWPKDKEKGPRTVNDLKLINAGKILENNKTLSECKSPICDFSGMTTMHVVVRAPTSSKQSGKRAATKAKGFRCGCAIM

SEQ ID NO: 50925 - protein, 287 aa, Coccidioides immitis RS
MSKFGVLVMGPAGAGKTTFCTALIQHLQNARRSCFYVNLDPAAESFAYEPDLDIRELITLEDVMEELGLGPNGGLMYCFEFLLQNLDFLNEALDPLSEEYLIIFDMPGQIELYTHVPLLPSLIQYLSRAGPLNISLCAAYLMESIFVVDRAKFFAGTLSAMSAMILLEIPHVNILSKMDQVKGLVGKRELKRFMSVDVELLNDEKNDGETPCDPSSTGELLSGSSFKRLNRAVGQLIDDFSMVSFLKLNVQDEDSIAGVLSYIDDAIQFHEAQEPREPADEQEYDLE

SEQ ID NO: 50926 - protein, 160 aa, Corynebacterium diphtheriae NCTC 13129
MTNTPIIPRVGIATDAHQIEAGKPCWIACLLFSGADGCEGHSDGDVVAHALVDALLSAANLGDLGSFVGVGRKEYDGVSGTQLLTECRELLESHGFTIGNGAVQLVGQSPKMGPRREEAERVMSEILGAPVSVSATTTDHLGFTGRSEGRAAVATAVVWK

SEQ ID NO: 50927 - protein, 413 aa, Rhodobacter sphaeroides
MAKEPMLQFVKMARETPEKRPRSLRSQDFHEICGRICPQDRLCEGNCVIEQSGHGTVTIGAVEKYITDTAWENGWVVPGKPAYERSESVGIIGAGPGGLAAADALRRAGLQVTVYDRYDRAGGLLTYGIPGFKLEKDVVARRVEQLEQAGVQFVLNCNVGEDLSFDAIRGQHDAVLIATGVYKQRDLAAPGVGSAGVVQALSYLTASNRRSFGDEVDDDGLDASGKRVVVIGGGDTAMDCVRTAIRQGATSVKCLYRRDRANMPGSQREVANAEEEGVEFVWLSAPRGFIAGDAVEGVIVQKMRLGEPDATGRQMPEIIEGADYVEPADLAIMALGFEPEDLPTLWGVPDLTVTRWGTIKADFRTHATSLPGVYAVGDIVRGASLVVWAIRDGRDAAQSILDYLAQPAVVAAE

SEQ ID NO: 50928 - protein, 90 aa, Mesostigma viride
LMHCIVDAILGALSMPDIGQIFPDNDPKWKGAPSSVFMKEAVRLMHAAGYVIGNIDSTIILQRPKMSPHKDAIRANLCELLGTHPTVCNI

SEQ ID NO: 50929 - protein, 90 aa, Zea mays
MAMRRVYSEIKGKKVKELPAYFKSSFSTQSVKTYVKKGLDNYNDKYIQTSSVQPLLHICFGGMAFSYLVALPNERRHLEHQQHAKEHGGH

SEQ ID NO: 50930 - protein, 623 aa, Ralstonia solanacearum GMI1000
MATQAVSLARVRGPLALAALTLLGACSTRTAVPTPAPVAGSPSVAPESPRPPEVASGYRTGMTTAYAEQHMAAAANPLAAEAGRRILRQGGSAIDAAIAMQAVLTLVEPQASGIGGGAFLLYWDGKRVQAYDGWETAPAGADENLFLRPDGTSMGLSEARIGGRAVGVPGVLRALELAHRRYGKLPWTRLLQPAVELAEQGFPVSPRLYTQIAADPFIAGSPEMAAYFLTPQGKPKPVGTIVRNPQLAQTLREIARHGPGAFYAGPIAADIVKRVSGGANPGTLSLADLRGYRAKERDPICADYQRWKVCGMPPPSSGGIAIAQMLGTLQALAARDPKYALAAMAPRETTRAAGLEPSVDAVHVVSEAGRQADADRGLYVADADFVPVNVKGLTDPGYLTLRAGLIGDRSTGRADPGTPPGTSIALAPDRSPPRVSTSQIVAVDNAGGAVSMTTAIDSDFGAHLMVRGFVLNSGLTDFSFVPNDGGKPVANRVQAGKRPRSSMAPTLVFERDSGRLVAALGSPGGSQSIEYVSKTLIGLLDWDMDVQSAINLPNFGSRNGPTEVERGLVTQPLVQGLKARGHDVAQIEMTSGTQAIVRRRRDDGRWGWAGGADPRREGVALGD

SEQ ID NO: 50931 - protein, 783 aa, Coprinopsis cinerea okayama7#130
MTTIIAGGLGETAGEIIEIEIFATDPQDGQWNAQGRHDETGTVFPSAILLPEVQNGVIHHHAPVHDLEIEAMTAIETETTGGAQTLTETETGIIGLTTITVPTTVNGREEATRIVVESIPIVHNLLPSQPPPPPAAPPSEPIEPRPPSDTPPPPPPPDPRLMNNPPPPPTGAVKRPSLPPTLPNKPVFSSVPPPSLKPKPPAPPPAPPKIRVVKRRTASKRTDKQDMEAYGRVFVGCGQQSDYEVTTKLGEGTFGEVHKAIQKATGASVALKRILMHHEKEGMPVTALREIKILKALKHPCIVNILDMFVVRSSEKDPLSVYMVFPYMDHDLAGLLENERVKLQPSQIKLYMKQLLEGTEYMHRNHILHRDMKAANLLISNTGNLRIADFGLARSFDTNITKGGSTRKYTNCVVTRWYRPPELLLGARQYGGEVDIWGIGCVLGEMFNRRPILPGSSDLDQLEKIWYLCGTPTQHSWPNFDALPGCDGVKHFKSNHIRRVKMTYESVGAETADLLDKLLVCNPKERITAAQALEHEYFWTDPLPADPKTLPVYEASHEFDKRGQRNHQPMMGHHQPSKYQDPSHRLPPPAGNPQRRQGNHRGPPGPWPGAPPLSHGPHAHPPGPGSYNMNQGPPPGMSGPPPPGFRPGPPGGIPMNPNMGPGPYPGGRPQFNGPGGPRPPGPGAYSLPPNPGGRPPFRGPHNGPPGPPGGPGRMGGPGLPPRPSVSLPPKPAAPLGGGVALGTVPRSNVPMPGRRPQPPQPHPPPPSTGSGNGYAPNGGLNYG

SEQ ID NO: 50932 - protein, 494 aa, Saccharomyces cerevisiae
MSSEEDYFDELEYDLADEVNEEKEDIQTKKFTTVNCQTEKFNPFEILPESIELFRTLALISPDRLSLSETAQILPKIVDLKRILQQQEIDFIKLLPFFNEIIPLIKSNIKLMHNFLISLYSRRFPELSSLIPSPLQYSKVISILENENYSKNESDELFFHLENKAKLTREQILVLTMSMKTSFKNKEPLDIKTRTQILEANSILENLWKLQEDIGQYIASKISIIAPNVCFLVGPEIAAQLIAHAGGVLEFSRIPSCNIASIGKNKHLSHELHTLESGVRQEGYLFASDMIQKFPVSVHKQMLRMLCAKVSLAARVDAGQKNGDRNTVLAHKWKAELSKKARKLSEAPSISETKALPIPEDQPKKKRAGRKFRKYKEKFRLSHVRQLQNRMEFGKQEQTVLDSYGEEVGLGMSNTSLQQAVGATSGSRRSAGNQAKLTKVMKHRISEANQQADEFLISLGHNTEQPNLSPEMVQMHKKQHTNPEEETNWFSGHG

SEQ ID NO: 50933 - protein, 259 aa, Vitis vinifera
MGPAANPQPNNPFGNAFYGAGSGLIRGGLGAYGEKILGSSSEYVQSNISRYFSDPQYYFQVNDHYVRNKLKVVLFPFLHRGHWTRITEPVGGRLSYKPPIYDINAPDLYIPFMAFGTYVILAGLSLGLRGKFTPEALNWLFIKGLVGWCLQVSLLKVSLLSLGSGEAPLLDIVAYAGYTFTGMCLAVFGRIAWSYSYYFLMPWACLCMGIFLVKTMKRVLFAEVRSYDSSRHHYLLLFIALAQLPLFIWLGNISVHWLF

SEQ ID NO: 50934 - protein, 591 aa, Cryptococcus neoformans var. neoformans B-3501A
MSFPRQISTLVVGGGPAGIVSLKYTVEYGEAWSEGEEPLLIDMESEIGGTFRWRGYQNAELVSSKQLTCFSDFRYPLDSPDHPSLPNFVDYLNCYIDHFDLRHMIRTSIKLVSLEYASSDSKDFYKHRATIQPLNDNGLPQGDPLIVLAKRVIITTGLHVTPNIPLIPGLNSTPCIPEPPKWIHSSAYKSRNQLKDKKVLVLGCGETGMDVGYEAIMAPAKKVWLGVRTGFLSFPKLFETAYVHPWVAASHIRWFISDLVIKRLLWVLTGTMAGCNQWAGELPPERQGRAYVFLNKSAKAMQFINRPFYSLSPIHRWIAHYIDPPPPPGDPKIDIVPFPQGFDSEGRAVFPAPPEHRRKETAWKDECKPDLVVLCTGYRQDWSWLGEGYPRGPEDCEIRGITSTKDLSIAFIGFVRPGVGAIPPIAEMQAQLFILLTEKRVPIPVSPETYHLLHSPTSRIQYGVDYSTYMSTLAKDIGSAPGLLRLWWDYGLFVLFVYCFGAAFPTFYRLTGPFKITKAREIVETELWDTIRRRGVIGNIFMGVIPMVFYAYLNIGAYILEFVWRVVTPIFDLPASPLELFQEKSTTVKSI

SEQ ID NO: 50935 - protein, 1057 aa, Zea mays
  misc_feature (1013)..(1013): Xaa can be any naturally occurring amino acid
MWQNSCDTTFVFHFLKALITLKKGSKLIKYSRKGKPKIRSFRLSSDETALIWYSHKKEKFLRLSSVSKVIPGQRTAVFRRFLRPEKDYLSFSLIYKNGQRSLDLVCKDQVEVEVWFSALEALISSCHRNSSVDEHKDRVSFSDDVSYYRDGHPYDSTLDIASSISRSFNTADYCRGSSFSFRRSDAGSDRANMIRTSGADSTRLSISSAPSSSSQGSGTDDIESLGDVYVWGEVWTDAAPSDGHTSSSCSKVDVLIPKPLESDVVLDVNQIVCGSRHVALTTRQGEVFTWGEELGGRLGHGTDTDISRPKLVESLSVTIVDFISCGEFHTCAISASGDLFNWGDGSYRAGLLGYDTGASHWLPKRVSGPLEGLQVLSVACGSWHSALITSTGRLYTFGDGKFGALGHGNRESAAYPKEVEALNGFRTVKVACGVWHSAAIVEASVQTGMNVVSKKLYTWGDGDKNRLGQGDKEARLIPTCLQALLEHNFHQLGCGQNMTVALATSGHVYTMGSSDNGQLGNPKSDGKHPCLVKDKLANELVEEISCGAAHVAVLTSRSEVYTWGLGANGRLGHGDLNDKKTPTIVEALKDRHVKSISCGSNFTTCICIHRWVSGADQSVCTGCRQAFGFTRKRHNCYNCGLVHCHACSSRKVLKAALAPTPGKPHRVCDSCFLKLKNADTSSSNANRRNAATRRSTDSREKPEIRPPRLVATPSAEPGKYMEVKASKSDMKPADSIMKASQASALLQFKDLGFGAQFGGLQPMGMPPALAMSPAIPAFSLAPPSPYTKKMKSPPTSAIPQSSKVDVDHLQKSNDLLNQEVLKLQSQASTVEDLKQKCEAQHEQLQKSDKKAKSVASMATEESSKRNAAVEFVKFLDNELKGIADKLPVDVADSLKALQMRTQSLLREQSGHPLELVNPMERDHLHLSSGGSGRYDLVTHKSGGVGYLTMSQDGSSASGSAMSITSESPSHRFMENSSKAHGDFAPKQGTHGEVQLIEQFEPGVYVTLIQLKDXKRRFAENQAEEWWRENQERVFKKYSHPTHAPHGNTTSHEEEHHS

SEQ ID NO: 50936 - protein, 415 aa, Desulfitobacterium hafniense Y51
MGKVVLEDILRAGQTLKGVINKTPLHRHDLLSEKYQCNIFLKREDLQVVRSFKLRGAYNMVHSIPSERLSSGVVCASAGNHAQGVAYSCKALGIKGSIYVPSTTPKQKISSIKRFGGDFVEVIQIGDTFDDAFNRAKAHCEEANKTFVHPFDDPLVIAGQGTIAMEILNDMEAPVDYILGGIGGGGLMSGVGIAMKSLSPQTQVIGVEATGAASMKEAFSQGEIVTLPHIDGFVDGTAVKRVGDLTFAICREVLDDVIAVTEGKVCTTILEMYNDSAIVVEPAGALSIAALETYKDKIKGKNVVCIISGGNNDIERTPEIKERSLFDQGLKHYFIVNFPQRPGALKEFVGEVLGPNDDIARFEYTKSNNKEKGPTLIGIELSRKEDYQPLIERMDKKGFQYTRINDNPELFGLLI

SEQ ID NO: 50937 - protein, 681 aa, Ustilago maydis 521
MTALRSAHRPSSLRSTANSEAGSIEPIQEEVVSNDGQISAAATPDTETSALLPSHRHRTQLLAPPSSHKSRSRTIWNSILVLLAIFTFAVTISIVLKNLLGEFNDPEDPSLPIDPPGTDPRGRRHPAVLATGRKAGVATENEICSRIGMDILLAKGTAVDAAVASTFCVGVLNMFSSGIGGGGFMIVRDPSACSAKGAKQPDCIEHTTIDFRETAPAAANKTMYVGRVPKAQFGGLAVGVPGELRGLQEAHKRYGRLAWKRLVQPSVELAKSATVSKELERRLSFFGGFIYDEPVWREIFVDDNTGQLKREGDTFHRPAYAQTLQSIADHGPDVFYSGAIAESLVRTTQAHGGILTLQDLHDYKVIVRPALQGSWLGKKVYTTHAPTSGPILLSILNMLSLIPDFTSIGQVTSLNMHRFIEALKFGFGQRTELADPAFMSSAGLERMSQIPTMSEALAIVPNITDDRTHPLDYYHPKFDIIDDHGTMHLSIVDQHGMAIALTSTVNLIFGSRVMDRSTGVILNDEMDDTSTPGVPNAFGLAPSPYNYPEAHKRPLSSTCPTIIESASGQVELVLGGSGGSRIFSSVLQTIFNFYLWGMDLSQSIEAPRLHHQLLPTQLSVETGYSEKVLSGLLGRGHEVSWIDIDLGIAEVQAVAVQAEGKRWKRVWAASDSRKGGVAVAV

SEQ ID NO: 50938 - protein, 281 aa, Campylobacter jejuni RM1221
MNLKELFIHHLEKNLPKVESFHPFFNEALALMLKAGGKHFRAQLLLSVVQSNKPELLNQALDVALALEFIHTYSLIHDDLPAMDNADFRRGIPTLHKSYDETTAILVGDALNTEAFLVLSHAHLKDEIKIKLIKTLAFNAGLNGMVIGQAIDCFFEDKRLSLNELEFLHTHKTARLIAAALKMGCEICELNNEESNQIYKLGLKLGLIFQINDDIIDVTTSQEQSGKPTNNDIHKNSFVNLLGLEQAIKTKENLLNECEQDLEKLNEKLAQMIQNLIIQYL

SEQ ID NO: 50939 - protein, 144 aa, Nicotiana tabacum
RFNKVFNRGMSDHSTMSMKKILEDYKGFEGLNSIVDVGGGTGATVNMIVSKYPSIKGINFDLPHVIGDAPTYPGVEHVGGDMFASVPKADAIFMKWICHDWSDEHCLKFLKNCYEALPANGKVIIAECILPEAPDTSLATKNTV

SEQ ID NO: 50940 - protein, 337 aa, Pseudoalteromonas tunicata D2
MAVLVTGGNGYIGSHTVVELLNLGHEVVIFDNLSNSNRAVLERIETITAKKPHFILGDIRDSQALAQVFNDFSIDAVIHFAGLKAVGESVAMPLSYYDNNVCGSLCLLKAMNDANVKKIIFSSSATVYGSPERLPIDEQCALRTTNPYGANKLQVEQMLSDLCQSDANWSVVALRYFNPVGAHKSGLIGESPNGIPNNLLPYVTQTALKIRKQLSIFGGDYDTADGTGVRDYIHVVDLALGHIKALDLVAAQTGFEPINLGTGIGYSVLDIVRSFEAVNQIAVPYEIVARRPGDIATCYADPKKAKDILGWQAEQTLDDMMKDAWHWQSNNPKGYDD

SEQ ID NO: 50941 - protein, 620 aa, Thiobacillus denitrificans ATCC 25259
MIDLKACPLWLYRLLPFLRWWPNVTAHTFKADSVAALTGALIVLPQAVAFATIAGLPPEYGLYAAMVPAVVAALWGSSWHLVSGPTTAISIVVFAAISPLAEPGSPQFVTLVLTLTFLAGAIQLAMGLARLGGLVNFISHTVIIGFTAGAAILIAASQIKNFFGLDMPRGAHFHEVLIHFGSHLTDIQPWVATVGAATLAAGILARRYLPKLPYMIVAMVVGSVTAAVLNARLGQEATGILTVGALAASFPPLSMPDFSLTAIKQTIFPATIIAVLALTEAVAIARSVATRSDQRIDSNQEFVGQGLSNLAGSFFSGYASSGSFNRSGVNYASGAKTPLAAAMSALFLLLIVLLVAPLAAYLPVPSMAAILFIVAWSLIDFHHIGEIVKRHKRERVVLALTFVGTLVDLEKGIFLGILVSLLFYLYRTSQPSIRELVPDPAELRNPRRKFVAKTPDTATCPQMPILRVEGSIFFGAVEHVQRHFRNVDEADPDKKNLLITARAIGFIDLAGAEMLAKESNRRRKLGGNLYLVGVQPDFCEMLRRSGQVDTVGEDQIFRHKGEALQAIYPRLDNEICRRCTARIFDECHVALPDGTPRAVADQREAEAALARLHAQGATAS

SEQ ID NO: 50942 - protein, 226 aa, unidentified eubacterium SCB49
MDYGKEFKKFAIKDQGVSSTYYDSILTSMYPVGLTPNIIEERQMNAVAMDVFSRLMMDRIIFLGTGINDQVANIVQAQLLFLASVDATRDIQIYINSPGGSVYAGLGIYDTMQFITPDVATICTGMAASMGAVLLCAGEKGKRSGLTHSRVMIHQPMGGAQGQASDIEITAKEIITLKKELYEIISKHTGQDYDKVYEDSDRDYWMKADKALEYGMIDEILTRGKK

SEQ ID NO: 50943 - protein, 466 aa, Actinobacillus pleuropneumoniae serovar 1 str. 4074
MGPATDRGNNLEKVIAAGANMVRMNFSHGVPEDHIERANKVREIAARLGKTVAILGDLQGPKIRVSTFKDGKIFLNIGDKFTLDADLPRGEGHQDAVGLDYKNLPNDVVPGDILLLDDGNVQLKVLSVEGVKVHTEVTVGGPLSNNKGINKLGGGLSAPALTEKDKEDIKLAAKIGVDYLAVSFPQSSADLDYARQLAREAGLEAKIVAKVERAETVATEEAMDDIILGSDVVMVARGDLGVEIGDAALVGVQKRLIRRARKLNRVVITATQMMESMIKKPMPTRAEVMDVANAVLDGTDAVMLSGETANGDYPVETVKSMAEVCLGAETMPSINISRHRMEGTFATIDEAVAMSAMYTANHLEGVSALIALTHSGETAKLMSRISSGLPIYALSRNQQALNRTALYRGVTPVFYDEESRTFEGAKKAIALLKEKGYLMSGDLVLLTQGDELKEGGTNTSRLLKVE

SEQ ID NO: 50944 - protein, 303 aa, Magnaporthe grisea 70-15
MPDLRGKVILVTGGNTGLGLESIRQLAQHNPAHIYMGARSRAKAEEAIESIRASTPAAASTPITHLELDLASFASIKSAARTLLAASDRLDVLINNAGIMNVPEGLTADGYEVQFGTNHVGPALLTQLLLPRLKRTAALPGSGDVRVVFLSSALERSAESGLLSTPDKLKTTMPETGTQSRYANSKLANIHYAWALAEQNPDLKVVSVHPGVVQTGLLSTWKDGFNPIVKGAINLAGRALMTTIEKGAYNQLWAATAAEGVETGTFYWPVGVKGKGTKASKDVKQRDALWAWTQKELNGHLFV

SEQ ID NO: 50945 - protein, 501 aa, Rhodospirillum rubrum ATCC 11170
MSSLVSYTHFVNGAHTAPAGGRSAPVFLPMTGEIQARVDLASRAEVDAAVALAAQAQPAWAAQNPQKRARVLMRFLELARRDNEALALLLAREHGKTIADAKGDIQRGLEVVEFAIGIPHLLKGEYTDSAGPGIDLYSMRQPLGVVAGITPFNFPAMIPLWKAAPAIACGNAFILKPSERDPGVPLRLAELFLEAGLPPGIFNVVNGDKEAVDALLDNPTVKAIGFVGSTAIAQYIYGRGTAAGKRVQCFGGAKNHMIIMPDADLDQTVDALIGAGYGSAGERCMAISVAVPVGEATAEALMDKLIPRVRALKIGPSTDPEADFGPLVTREAVDRVTAAVAQGVAEGADLVVDGRDFSLQGYENGFYMGGCLFDRVTPAMAIYREEIFGPVLSVVRAADYEQALRLPNEHAYGNGVAIFTRDGDAARDFAARVEVGMVGINVPIPVPLAYFTFGGWKRSGFGDLNQHGPDAVRFYTKTKTVTSRWPSGIRDGAEFVIPTMR

SEQ ID NO: 50946 - protein, 93 aa, Mesostigma viride
KRDEELILPINSSISVTIDPTALCATTTVAVSPSFERDRLWLNGKEVPMDNVRYQNCLRIMRERARDVAADGQGSPAVSRSDWQALKVHIASC

SEQ ID NO: 50947 - protein, 113 aa, Zea mays
AGVSSRDIVHIQNAKGLGYAMNTSEELNFVKEVAATTGVVLDPVYSGKAAYAMLKDMSENPKKWERRKILFIHTGGLLGLYDKVDQLASFVGNWQRMDVNESVPRQDGIGKMF

SEQ ID NO: 50948 - protein, 78 aa, Arabidopsis thaliana
  misc_feature (72)..(72): Xaa can be any naturally occurring amino acid
MAPSMRLCFSMDASPARGGFDRAFYGLKSSAAFPATRKANNDITFITSNGGRVNCMQEWPPTGKKKFETLSXYPPDLT

SEQ ID NO: 50949 - protein, 312 aa, Oryza sativa Japonica Group
MAAAWAAAVAVMLLLAQVSAAAPVMGPAFLWAPNNYGFSSDETKEMVYYQTVSPKSLVKSVLEEGGWSNLVCSREDHAKSVDVAVLFLGSKLQSSDISKEKQADSTLVDMLKNSFASSEFSMAFPYVAMSDDDKLEKSLLSGFAENCNNGLGNNHITYTDTCSVSEDLKKHHDMDSIHGLVASQTKKNPSGQTDLVVFCDGGFKDNTKSEGELLSELVTLLKKSGAKYTILYASQPYGLLESPSNLPLGRYLAEKTNTTKPGRGKCDGECLVKSTLLEGSFVGIVLLIILISGLKCMMGIDTPSKFDAPPES

SEQ ID NO: 50950 - protein, 248 aa, Zea mays
  misc_feature (213)..(213): Xaa can be any naturally occurring amino acid
MAVAAPGQLNLDEFPSWGSRGVDCFEKLEQIGEGTYGQVYMAKETETNEIVALKKIRMDNEREGFPITAIREIKILKKLHHQNVIQLKEIVTSPGPDRDEQGKPIDGSKYKGSIYMVFEYMDHDLTGLADRPGMRFTVPQIKCYMKQLLTGLHYCHVNQVLHRDIKGSNLLIDNDGNLKLADFGLARTFSSDHNGNLTKRVITLWNRPPELLXLGSATIGPACDMGSCEIFLCADSPVEPPSPARQGK

SEQ ID NO: 50951 - protein, 456 aa, Actinobacillus pleuropneumoniae serovar 1 str. 4074
MTKHYDYLAIGGGSGGIASINRAASYGKKCAIVEAKHLGGTCVNVGCVPKKVMFYGAHIAEAINSYAPDYGFDVTVNNFDFVKLIESREAYISRIHTSYNNVLAKNNVDVLNGFAKFVAAKTVEVTYADGSSEQVTADHILIATGGRPSIPAIKGAEYGIDSDGFFALREVPKRVAVVGAGYIAVEIAGVLNSLGSEMHLFVRQHAPLRMQDPLIVDTLLEVLAQDGITLHTQAIPQEVRKNADGSLVLTLADGREATVDCLIWAIGREPACDKINLDAVGVKTNAKGQIIVDKFQNTNVPNVYAVGDIIEGGIELTPVAVAAGRRLSERLFNNKPNEHLDYNLVPTVIFSHPPIGTVGLTEPQAIEQYGAENVKVYKSSFTAMYTAVTQHRQPCRMKLVCVGKDEKVVGLHGIGFGVDEMIQGFAVAIKMGATKADFDNTVAIHPTGSEEFVTMR

SEQ ID NO: 50952 - protein, 151 aa, Triticum aestivum
  misc_feature (71)..(71): Xaa can be any naturally occurring amino acid
  misc_feature (91)..(91): Xaa can be any naturally occurring amino acid
QSSQLFPLPSVAAAALGFPLPDPRSSQQQRARRWRRETPEKKMITLKSSDGEEFDVEEAVAMESQTIRHMXIDDDCADDGIPLPNVNSKIXLILAANYLNIKGLLDLTCQTVADMIKGKTPEEIRKTFNIKNDFTPEEEEEIRRENQWAFE

SEQ ID NO: 50953 - protein, 180 aa, Zea mays
MAEHLASIFGTEKDRVNCPFYFKIGACRHGDRCSRLHNKPSISPTLLLCNMYQRPDMITPGVDAQGNPIDPERIQEDFEAIYEDIFVELSKHGDFGSLHVCAGLADRMILTLCIAPSGAPPEAAAARAHTPPPVACPGPGAPPISPAIFTPTTVVAVAPPGAAKDPPAPTTTGAPVYAGG

SEQ ID NO: 50954 - protein, 585 aa, Aspergillus nidulans FGSC A4
MASLRFQYTKANGTLRSVIWKPRLYPMCEDQGMAIVPWAALGGSLLLSCQQRQEREKKQAGQKSFYELGPHELTVSGALEKVAVAKKTTVQAIDGKGFRTRLTPVDHAQYRMGAWIDAPAKQPLPGGDWEWETMHVVGVTRRTQPAACVSAVQPPWLKTCFGVELCSRLGVGSAPIPIPISLEASFGSCPPFRWLKMASTSEGNLHRQQHQHQHRGRIPTGRISGSGSGLPPPANDTTTTTTTATTASATLPSATDLPSSTFRTVSTIPSAPVPVPPFSVCGHEGGFVQPSSYLRSRPLSYPMPPSQPERAIDREERQGLRAIRNFLKVRTSYDVLPLSFRLIVFDTALTVKESLNILTQNGIVSAPLWDSKSSTFAGLLTTSDYINVIQYYFQNPAALDKIDQLRLDSLREVERALDVAPPETISIDPERPLYEACRRMLESRARRIPLVTNDSQTDRHLVLSVITQYRILKFVAVNVSDTQKLRKPLGEIRLGSYHDIATASMDTPVIDVIHILVQRSISSVPIVNSEGVQYFYEDTGRPTNCGLGVVYNVFESVDVVTLIKGGVYDDLSLTVGEALKKRSPV

SEQ ID NO: 50955 - protein, 181 aa, Zea mays
LAGAEEIFMIDHNAYRLEFARQRYGVTPINFDEIDDPAGWIIDHTQGHRGVDAVIDAVGFEAKGSLTETVMSNLKLEGSSGKALRQCIAAVRRGGVVSVPGVYAGFIHGFLFGDAFHKGLTFKMGQTHVQAYLPRLLSLIEQGLLTPEEIVTHHMPLKEAARAYEIFEKRKEDCRKVILVP

SEQ ID NO: 50956 - protein, 294 aa, Aspergillus oryzae
MESFNSTTALPQMASYTDLIKLAHQNPNLSSMENLWEAYYSYWNNDILATGIITFIAHELIYFGRCLPWIIADAMPGTFNRWRIQDHKAPPSVATQWDCTKYILAIHFIVELPLIVLFHPMMDLCGLKYASPFPDLKTLAAQLAIFFIVEDTYHYWLHRAFHWGPLYRSIHRIHHQYATPFGLTAEYASPWETLLLGLGTIAPPLVLGYFTENVHLITVLVWMGLRQVQAIDSHSGYDFPWSLRRIMPFWGGADWHDDHHRYFVGNYSSSFRYWDILMGTVAGPKNGREHRRRN

SEQ ID NO: 50957 - protein, 507 aa, Burkholderia mallei ATCC 23344
MASHDYLKKILTARVYDVALETELERARNLSARLNNAVYLKREDNQPVFSFKLRGAYNKMAHIPADALARGVITASAGNHAQGVAFSAARMNVKAVIVVPVTTPQVKVDAVRAHGGPTVEVIQAGESYSDAYAHAVKVQAERGLTFVHPFDDPYVIAGQGTVAMEILRQHQGPIHAIFVPIGGGGLAAGVAAYVKAVRPEIKVIGVQTDDSCAMKQSLAAGRRVELTEVGLFSDGTAVKLVGEETFRLCAAYLDEVVTVDTDALCAAIKDVFQDTRSVLEPAGSLAVAGAKRYAEQAGIEGETLVAVTSGANMNFDRMRFVAERAEVGEAREAVFAVTIPEERGSFKRFCALVGERNVTEFNYRIADARSAHLFVGVQIRRRDESDEIAANFAAHGFTSVDLSGDELSKQHIRYMVGGRSPLAHDERLFRFEFPERPGALMKFLSSMAPDWNISLFHYRNQGADYSSILVGLQVPQADHAEFDRFLAALGYPFWEESGNPAYRLFLS

SEQ ID NO: 50958 - protein, 252 aa, Campylobacter jejuni RM1221
MIELKKPDEIEKLRIANQIVAKTLNFLENEIKIGMSLKQIDKMAEDYILSLGAKPSFKGLYGFPGAICTSLNQVCIHGIPDDKIIKEGDILGLDVGSLIDGYYGDAARTIAIGEVSPADKALISCAKDALYHAIDIIRDGMRFKELSAALGEFIHARGFVPLRGYCGHGIGRKPHGEPEILNYLEKGASAKSGPKIKNGMVFCIEPMICQKDGTPKHYNGKWDAGSIDGLNAAHYEHCVAVINGRAEILSMI

SEQ ID NO: 50959 - protein, 324 aa, Brassica napus
SSSSSSSSSWSRSKFLDSVFMIGQKEVTRILVLFLGLTASCLVLYKTAYPLQRLNVNNLSSLYASPSSPLPNINSSEISQETAKPKISFKEILENATTKNNTVIITALNQAWAEPNSLFDLFLESFRIGQGTQQLLKHVVVVCLDRKAFERCSQLHTNCYQIETSETDFSGEKVYNNPDYLKMMWRRIELLTQVLEMGFNFIFTDADIMWVRDPFPRLYPDGDFQMACDRFFGDPFDSNNWVNGGFTYVRSNNRSVEFYKFWHKSRLDYPELHDQDVFNRIKHKPFMTEIGIQMRFFDTVYFGGFCQTSRDINLVCTMHANCCI

SEQ ID NO: 50960 - protein, 498 aa, Oenothera elata subsp. hookeri
MRINPTTSGPGVSTLEKKKSGRIAQIIGPVLDVTFPPGKMPNIYNALVVKGRDTGGQEINVTCEVQQLLGNNRVRAVAMSATDGLTRGMEVIDTGAPLSVPVGGATLGRIFNVLGEPVDELGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNKQNVLLFIDNIFRFVQAGSEVSALLGRMPSAVGYQPTLSTEMGSLQERITSTKAGSITSIQAVYVPADDLTDPAPATTFAHLDATTVLSRGLAAKGIYPAVDPLDSTSTMLQPRIVGDEHYETAQRVKETLQRYKELQDIISILGLDELSEEDRLTVARARKIERFLSQPFFVAEVFTGSPGKYVGLAETIRGFKLILSGELDGLPEQAFYLVGTIDEATAKAANLEMESDLKK

SEQ ID NO: 50961 - protein, 80 aa, Glycine max
KSVRGYIVDANLSVLNLVIVKKGEKDIPGLTDTTVPRRLGPKRASRIRKLFNLSKEDDVRQYVVRQPLNKEGKKPRTKAP

SEQ ID NO: 50962 - protein, 624 aa, Oryza sativa
MGTRRRRNPVIFLFLWFVMAFELCASLNHEGVALMRFKEMIDADPFDALLDWDEGNASPCSWFGVECSDDGRVVALNLPNLGLKGMLPQEIGTLAHMRSIILHNNSFYGIIPTEMKYLHELKVLDLGYNTFSGPFPSELRNILSLKFLFLEGNKLSGSLPIEYELASMDQTSLNKISTERNEENATRRKLLASKQKRSQKNRMLLSGTSESPLENVTMPKSHPDNITVPHRPVAPRSSSPQPPLPSEPIPSPAPSMPSPAPSVSTTTNGTSGQENKSKTAIYASIGGVACLVVVAMSAALILCYRHRKTSTVVPFSPTASGQLHTATLGGITKFKRSELETACEGFSNIIDTLPRFTLYKGTLPCGAEIAAVSTLVTYASGWTTVAEAQFKDKVEVLSKVSHKNLMNLVGYCEDEEPFTRMMVFEYVSNGTLFEHLHVKEADQLDWQSRLRIAMGVMYCLNYMQQLNPPVLLRDLSTSCIYLTEDNAAKVSDISFWGDKKEDEKSEASDEHITVYKFALLLLETISGRRPYSDDYGLLILWAHRYLIGDKPLMDMVDPTLKSVPEEQVRELTKLVKLCLSEDPMERPTVAEVTAWMQEITGISEEEAIPKNSPLWWAELEIITS

SEQ ID NO: 50963 - protein, 1010 aa, Magnaporthe grisea 70-15
MSVNYDEAENGPVGQRSSRLQFELAQCVETTTVTTTKTTKLAIPPLLLREPRPLSSLDTKEYPLANRPTPPELAKFTMDIEGYQQGLFPVDSSFEEAMYKREHEPRPCSLDVDALETPDTPQQESPTPTFFNNKPRPTRRASGIPSRNASKPYGSIGREEFSRSNRPIMTSTASERMRRPFTEQRRMESDSAAGYLATPDATELVGGSRRRSSRREPLDQGESAESSTQQTSLFDAASPAESEANTAYSGSVTTPPVMEADSVSLADADEQPARAFHRPRPTVDTIAAQDASLPSPGLSPTLQAAQLQNGQQDDGDVDDDDQMEFSQQLTRQRRSRFLGNNSPANEDDSSDVAEHALERRRRGGTERFSRQSILDTQYMVEQFDTLPNELKTLMMYQLLRRCPRKTLHMVADVVNPALKCDFIKQLPAELSLQVLSYLDYRDLCRAAQVSKLWRSIVDGNETGWKELCDRNGFELSESELEKAISQGWGWQDPAGIYGAELDLSLQSRLTATEPELVKTAKPNASQRTRPAKRKRPMAGYPSADRSKRRANTQDVHKSDGMEPGHHHQNKEGPIAAATAAAMAVSDPGIGLPSLRRLHLFKSLFRRHYMIRQNWTSGKVKPGHVAFAAHPRHVITCLQFDEDKIITGSDDQLIHVYDTNTGKLRQKLEGHEGGVWALQYEGNTLVSGSTDRSVRVWDIEKGLCTQVFYGHTSTVRCLQILMPTEVGSDTEGRPIMSPPKPLIITGSRDSQLRVWRLPEAGSRRYIQTGPPANDAECPYFLRILQGHTHSVRAISAHADTLVSGSYDCSVRVWRISTGEQLHWLQGHSQKVYSVVLDHKRNRCISGSMDSLVKIWDLETGACLYTLEGHSLLVGLLDLRDERLVSAAADSTLRIWDPENGKCKSILTAHTAAITCFQHDSRKVISGSEKTVKMWDIATGECIEDLLTDLSGVWQVKFDGRRCVAAVQRDGLTYIEILDFGAVRDGKPREELGKRIVLNSSEVQRLLEEVEA

SEQ ID NO: 50964 - protein, 100 aa, Cyanophora paradoxa
KRDSKLILPVNSSLSATLDQADLMTHTTVTASKGYERDRMWLNGKEHDIDGNEETAMRLRRCIAALRERAGDVEHDDGHGGKIVVHKEDWPHYKLHIASV

SEQ ID NO: 50965 - protein, 278 aa, Thermococcus kodakarensis KOD1
MLDLVVIGHVSIDTLIFPDGRRVTMPGGAAAGVATSAALAGAKVGLVTKIGTDFPKEWLQALSSVLDISGVQILPGKTIHIQMIYHEDGSVDAPVEMGVAQKMGEIPIPEEYLDAKVFHISPIPPEEQLKLLNRLKGKRVTVDFNPTYKEEYIKRRDLLREIVSRVEIVFPNEREALMITGAEDVKDAARILHGWGAKLVVITRGEKGVLVYDGSFREFPALPIKPEEIVDPTGGGDAFAGGFLAGYSRGRPLEECVRLGLERAREVLKKWGDWSITV

SEQ ID NO: 50966 - protein, 309 aa, Vitis vinifera
MAGFVPPPPPPAPPAPPKPDEKVDYLDLPCPIPYEEIHREALMSLKPELFEGMRFDFTKGLNQKFSLSHSVFMGPTEIPSQSSETIKIPTAHYEFGANFIDPKLMLFGRILTDGRLNARVKCDLTENLTLKANAQLTSEPHMSHGMVNFDYKGGDYRTQLQLGNGALFGASYIQSVTPYLSLGGEVFWAGQHRKSGIGYAARYNTDKMVATGQVASTGMVALSYVQKVSEKVSLASDFMYNYMSRDVTASFGYDYILRQCRLRGKIDSNGCTAAFLEERLNMGLNFILSAEIDHRKKDYKFGFGLTVGE

SEQ ID NO: 50967 - protein, 424 aa, Bacillus subtilis
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVEAANGPTTIDATKILNERGVLLVPDILASAGGVTVSYFEWVQNNQGYYWSEEEVAEKLRSVMVSSFETIYQTAATHKVDMRLAAYMTGIRKSAEASRFRGWV

SEQ ID NO: 50968 - protein, 394 aa, Rhodospirillum rubrum ATCC 11170
MKAANSLFSGLGTTIFSVMSHLAQEYGAINLGQGFPEGLEPADVIAAAARSLAAGPHQYPPMMGLPALRQALAAHEKRFYDLDIDWQTEVMVTSGATEALADALFGLIEPGDEVVLIEPLYDSYLPIIRRAGGIPRLVRLEPPRWSLPREALAAAFSPRTKLILVNSPMNPCAKVFSADEMAFIGDLAIAHDAYIVCDEVYEHLVFDGQSHRPLMAQPGLRERCVRIGSAGKTFSLTNWKVGYVIAAPEVLDPIAKTHQYITFTTPIPLQQAVAEGLAKDDAYFAGLAHDMAARRDRLGAGLRRIGFEVLDCAGTYFLTADFRPLGFAGDDLAFCRHITCEAGVTAVPVSAFYQPGQGGIPTSFARFCFAKRDDALDEAVARLERHFAGGRRNA

SEQ ID NO: 50969 - protein, 158 aa, Striga asiatica
NPAVTFGLFLARKLSLTRALFYIVMQCLGAICGAGVVKGYMEGPYQALNGGANFVNHGYTKGSALGAEIIGTFVLVYTVFSATDAKRSARDSHVPILAPLPIGFAVFLVHLATIPITGTGINPARSLGAAIIYNRDHAWDDHWIFWVGPFIGAALAAV

SEQ ID NO: 50970 - protein, 689 aa, Ashbya gossypii ATCC 10895
MSDESSRTLLPRPGVMPASSTMSLRSYRAIKVDKPLRHDTKSYVSYYLPILRWLPEYSWGKMAKDMLAGLTLTSFQIPLAISLTTMAHVSPYAGLYALVIPPLIYAVFGSVPTMVVGPQTVASLVVGQSCDAWAHKSLEPLMTVAVIGCISGVLVFAMGIFRLGFIDNAISKAFLKGFTSALAVVMLITELLPQLQIDDRYKQALKEGKVGSAAWDKLVFALENAREYSNPFSVKLSVAAFSILLLSKYLKKYLTAKYGWTKLTFFPDLLLVVLGSILLSFYYDWDNKYNLPIVGDLPPNKDHIKVPIQSFQEFKDLFDASFLVAILGLFESATAFKSISATFDIDVSSNRELVSLGLINIVGSVFSSLPAFGGYGRSKLNIFCGAQTPMAGIFVSLSAIFCMRFLMGVFHYLPLCILAVIISFIAYNLLEEVPGDMFFYWSVSGYQELITFSAVVLSTLIWSPQFGLVMGLGLTMIRLLKHTTQSRIQILGKDPITKKFRNIYSEHNEEIPLEEIEKTMVIKVPEPLVFWNVPDLMKKVKRLEKYGSLYVHPSYPTSLRPVSGVTTLKDNVYVKYIIMDLLGMTYIDMSALQALVDMVVNYHKRGIYVIFCRSSIRDLKNKFDKSGITRLQADFISRQLLYQEGIPHDHLQFLKLGLYGSVDEAVTAVDMLEVLSSTSSGTAQNGRMA

SEQ ID NO: 50971 - protein, 401 aa, Bradyrhizobium sp. BTAi1
MMSFLAAALDRVKPSATIAVTDKARVLKAAGRNVIGLGAGEPDFDTPDNIKDAAIKAIQAGKTKYTAVDGIPELKEAIIGKFQRENGLTYKPNQVIVGVGGKQVLYNALMATINPGDQVIIPAPYWVSYPEMVALAGGEPVPVVCTAAHGFKLQPEALEKAITPKTKWLILCSPSNPTGAAYTKAELKALTEVLVKHPHVWIMTDDMYEHLVYDDFVFTTPAQVEPSLFDRTLTVNGVSKAYCMTGWRIGYAGGPANLIKAMATIQSQSTSNPCSIAQWAAVEALNGPQDFIPANNKVFKERRDLAVSMLNQASGIECPRPEGAFYVYPSCAGTIGKTAPSGKVIDNDETFVTELLETEGVAVVHGSAFGLGPAFRISYATKTSDLEEACKRIQRFCGNLR

SEQ ID NO: 50972 - protein, 426 aa, Coprinopsis cinerea okayama7#130
MSSKGSTTETPSKPAGAGRLPSLNQLAARINPTPVANGTPSAPRPRLAASVLRTGSTVSLASTAASTTDSMAVNAPTTRSASPAGSGVSGSPQSSNTPVPEGGEALTSEKLDKLNQENADGAPAPLSKKFVKGYKNVPSLDAITARMVRTRQLSIDGTARPPEPELIEDPKTPGVQMKAPEHPLQFPWTIFHDTKAKYPYTPALASGEAPPLSAAPPVPESSSEYEAGLTVIGEFDTVESFWRYFNWLKPPSALEKNSNYHLFKSGIKPMWEDEANANGGKWVLTMKNNPQLLDRCWYSIAMALIGEELEEGDEICGAVVSLRTKVDRIQLWTRSKEDVERLNAIGKKMVKLLDVSEADGIGLEFQYNSDDRPPPNKFLSISALPQTSYRSSFQPQPGTPVGGPGGAFGSFGMGIGGGWKGGAKRG

SEQ ID NO: 50973 - protein, 556 aa, Cryptococcus neoformans var. neoformans B-3501A
MSYRPSQQQQPGPSNFQQQQQNMLNPQNMAGPGRTSPMPTVPQVSQPNIGQPGSMRPGEGPTPAVAQANAGGQIQGNGAEGLGSLASDKGPDYVYFERKPGQFSEAVQGKAMGAKMKLELFYKEAVEGVVGRKERRTALEKQLAADALTPDSLKARQLINLGRRESNYLRLRRTRIGLDDFRTVKVIGKGAFGEVRLVQKADTGKIYAMKTLRKNEMFKKDQLAHVRAERDVLAESNSPWVVQLYYSFQDTQYLYLVMEFLPGGDLMTMLIKYDTFSEDVTKFYMAECILAIEAVHNLGFIHRDIKPDNILIDSLGHIKLSDFGLSTGFHKQHDSAYYQRLLGGGDVSGSNRHSQTAAGARNSVMVNAINLTMTSKQDIATWKANRRKLAYSTVGTPDYISPEIFLQQGYGKECDWWSLGAIMFECLVGYPPFCSENAHDVYKKIIDWRNYLFFPDDVHLSREAEDLIRRMLCEADRRYTVEQLKAHPFFYGVDWATIREIDAPFVPHLRSITDTSYFPTDELDQVPDIPVGAETGSDAKKDLAFLGYTFRRYEML

SEQ ID NO: 50974 - protein, 201 aa, Rickettsia akari str. Hartford
MSYVPIVIEQTSRGERAYDIYSRLLKERIIFVCSTVEDHMANLIVAQLLFLEAENPKKDVYMYINSPGGVVTAGLAIYDTMQYIKPKVATLCIGQACSMGSLLLCGGTQGMRYSLPHSRIMIHQPSGGYKGQATDIEIHAQETLKIKRLLNELYSKHTGQELKHIEKSMERDNFMSPEEAKKFGIIDNIISSRDVMTMSAK

SEQ ID NO: 50975 - protein, 220 aa, Picea sitchensis
MRPIIPSSDSDSNSSSRAQLYLNVYDLTPLNNYMYWFGVGIFHSGIEAHGVEYAFGAHDYSSSGVFEVEPKSCPGFIFRRSVSLGTLNMSPFEFRQFVEHMAGSYNGDSYHLIAKNCNHFTDDISKRLTGKSIPGWVNRLARIGSFCNCLLPESIQVTTVRHTPEYQGLSEDGSESRSTEGEIESDGEQDHLLISSNGEAESIERDILWETPLKHIKEIL

SEQ ID NO: 50976 - protein, 209 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVVPLPSHGCWPPLPFSSARSTLCSLPMPDLPLPYPWSSPAPPMDAAAALL

SEQ ID NO: 50977 - protein, 496 aa, Pseudoalteromonas tunicata D2
MADQKPQLSFWQIWNMCFGFLGIQFGFALQNGNVSRIFQTLGASIDDIPILWIAAPLTGLIVQPIIGYMSDKTWGKLGRRRPYFLWGAILTTLALVIMPNSPTLWIAAGMLWIMDASINVTMEPFRALVGDNLPKKQRATGFAMQSFFIGIGAVVASALPWMMTNWFEISNVAPEGQIPDSVKFSFYFGAAVLFIAVGWTIIKTKEYSPQELAHFEQAEQDSPVHASVKPTIFTQGLVRNGAIALAILASVFVFELEKELYLAGIGLALFTAMQLLAKKMGQSAKTDNGFYHVMGDLFTMPEAMKQLAWVQFFSWFALFAMWIYTTSAVTSYHYGSSDATSQLFNDGADWVGILFAAYNGFAALAAVVIPVCVKRMGLKATHMLNLGLGALGLMSFLIINDPQLLLLSMVGIGFAWASILSLPYALLSSQVPSAKMGVYMGIFNFFIVIPQLLAASILGVLVKNLFQGQAIYALLLGGLSFLIAAACMLRVKYQNQ

SEQ ID NO: 50978 - protein, 455 aa, Pseudomonas syringae pv. phaseolicola 1448A
MSAHNNPQTLEWQALSSEHHLAPFSDYKQLKEKGPRIITRAEGVYLWDSEGNKILDGMSGLWCVAIGYGREELADAASKQMRELPYYNLFFQTAHPPVLELAKAISEIAPQGMNHVFFTGSGSEGNDTMLRMVRHYWALKGQPDKKTIISRVNGYHGSTVAGASLGGMTYMHEQGDLPIPGVVHIPQPYWFGEGGDMTPDEFGVWAAEQLEKKIIELGVENVGAFIAEPIQGAGGVIVPPDSYWPKIKEILSRYDILFAADEVICGFGRTSEWFGSDFYGLKPDMMTIAKGLTSGYVPMGGLIVRDEIVAVLNEGGDFNHGFTYSGHPVAAAVALENIRILREERIVERVKSETAPYLQKRLRELSNHPLVGEVRGVGLLGAIELVKDKVTRERYTDKGAGMICRTFCFDNGLIMRAVGDTMIIAPPLVISFAEIDELVEKARKCLDLTLAVLLG

SEQ ID NO: 50979 - protein, 121 aa, Corynebacterium diphtheriae NCTC 13129
MADRIELKGLHCFGYHGVFEHEKREGQDFIIDVTCWLDLRPAAASDDLTHTVHYGELAQLAHDIVTGPPRDLIEAVAGEIAESAMATFPLITAIEVTVHKPQAPIPLEFTDVAVVARRSRR

SEQ ID NO: 50980 - protein, 125 aa, Brassica napus
MGFVLISSCPPFSLVLVSRLHQFSAGIKNSEISVGRQVSPTRRTLIAKACCFNLPQEPILSEALKEPIAFVGGMFAGLLRLDLNDEPLKEWVTRTVEASGITEEDVGGGGMASNEEESPQQIEIE

SEQ ID NO: 50981 - protein, 335 aa, Pseudoalteromonas tunicata D2
MIRVAINGYGRIGRNVLRALYESGRQNEIKIVAINDLAPANVNAHLTQFDSVHGRFGFPVTLAENAMIVADDSIVLTQERDPANLPWQALNVDIVLECTGLFTTRESAGKHLTAGAKRVIVSAPGTDMDATVVHGVNSDVLTPECHIISNASCTTNCLAPIAKILNDAIGIEQGSMTTIHAYTNDQNLSDVYHPDLYRARSATQSMIPTKTGAAKAVGLVLPELAGKLDGMAVRVPTINVSLVDLTFIAKRETTAAEVNAAIKGFAEGAMADILEYNELPLVSIDFNHNPASSIFDATQTKVDGKLVKVMAWYDNEWGFSNRMLDQVTTLAKLMN

SEQ ID NO: 50982 - protein, 2141 aa, Kluyveromyces lactis NRRL Y-1140
MISSGKYDPLEESYDGGCSLDERPLSKKAHVYKSWANVIPDKQGLYDPEFEKDACGVGFVANIKGVSSHKIVSDARFLLCNMTHRGAVSSDGNGDGAGILTGIPHEFMQREFKLDVGIDIPDQSQYAVGNVFFKKDSPEALVNSKRTFEQLADSLDLKVLGWRVVPHDSSILGAVALSREPEILQPLVVLKELFSESSSSSSISKDEFQSTCETKFKTSLYILRKQASTSIGLQNWFYVCSLDNKTIVYKGQLTPSQVYNYYHDLTNAHFKSHMALVHSRFSTNTFPSWDRAQPLRWLAHNGEINTLRGNKNWMRAREGVMASEVFGEQLDKLYPIVEEGGSDSAALDNVLELLMMNGVLSLPEAIILMVPEAYHKDMDSDLKAWFDWASCLMEPWDGPALLTFTDGRFTGATLDRNGLRPCRYYITSDDRVICGSEVGVIPVENSLVIQKGKLKPGDMLLVDTESGEMVDTKQLKHKFAKRKDFKSWLSKVIKVEDVLEKTSKFLPPSFISDYNLKAQTDPRLLALGYTYEQVSMILVPMALGGKEALGSMGNDAPLACLNEDPVLLYDYFRELFAQVTNPPIDPIREANVMSLECFVGPQGNLLEMHPSQCDRLVLKSPILHWDEFEALKNIEKAHPTWSTSNIDITFPKEEGLLGYTATIDRITQEASDAIDQGKKILFISDRLLSADRVSISSLIAIGAIHHHLVRNKQRSQVALILETGEAREVHHFCVLLGYGCDGIFPYLAMETLVRMNHEGLVRNVNNDDSSIDDKTLLDNYKHAVDGGIFKVMSKMGISTLASYKGAQIFEALGIDNSVVDLCFAGTASRIKGVTFEYLAQDSFSMHERGFPSRLTIQKSVNLPESGEYHWRDGGYKHINDPTAIAALQDSVRNKNEDAWEMYVKKEMEAIKDCTLRGLLELDYSDSESIPLEQVEPWTEIARRFATGAMSYGSISMEAHSTLAVAMNRLGAKSNCGEGGEDPERSIVNSNGDTMRSAIKQVASARFGVTSFYLSDADEIQIKIAQGAKPGEGGELPAHKVSKEIAKTRHSTPYVGLISPPPHHDIYSIEDLKQLIYDLKCSNPRAGISVKLVSEVGVGIVASGVAKAKADHILVSGHDGGTGASRWTGIKYAGLPWELGLAETHQTLVLNDLRGNVVVQTDGQLRTGFDIAVAILLGAESFTLATVPLIAMGCIMLRKCHLNACAVGIATQDPVLRDKFKGQPEHVINFFYYLIQDLRRIMAKLGFRTVDEMVGHSEKLRKRDNVKTKALNIDLSPILTPAHLIRPGVATKFTKKQDHKLHTRLDNKLIDEAEITLDKGLPVTIDANIINTDRALGSTLSYRVSKRFGENGLPQDTVVVNISGSAGQSFGAFLTAGLTFILDGDANDYVGKGLSGGRLVIRPPKDSRFKSDENVIVGNTCFYGATSGYAFISGCAGERFAVRNSGATVVVERIKGNNAFEYMTGGRAVVLSQMESLNAFSGATGGIAYCLTSDYDDFVGKINHDTVEMQSLVDPVEIAFVKNLIQEHYNYTKSDLAKKILNKFNHYLNNFVKVIPTDYKKVLENEAKEKVKAEKQSTADFLKKFNSSTDSAVDATNGEVDLLRSSVSHKSTLAEPKVLDLEDAVQDTNNLKKAEEKLEKIRGFMKYKMKHEKYRSPAARTKDWKELSNAITKKDARQQTARCMDCGVPFCTSDTGCPISNIIPKFNELVFKNQWKLALDKLLETNNFPEFTGRVCPAPCQGSCTLAIIDDPVGIKSVERLIIDNAFKEGWIKPCPPEVRTGKIVAVIGSGPAGMACADQLNRAGHSVVVYERADRCGGLLMYGIPNMKLDKSIVQRRLDLLAAEGVQFITNTEVGKDISVEELKSKFDAIVYTVGSTIPRDLRIPGRELKNIDFAMTLLKSNTQALLDRDLETIKKQIKGKKVIVIGGGDTGNDCLGTSVRHGAASVLNFELLPQPPNERSKDNPWPQWPRIMRIDYGHAEVKEHYGRDPREYCILSKEFIGNENGEVKAIKTVRVEWKKSQSGVWQMVDVPGSEQIFEADIVLLSMGFVGPEVIEDPTFVKSKRGTITTLSDSSYSVDGDKVFAAGDCRRGQSLIVWAIQEGRKCATAIDTFLMGSTNLPGNGGIVKRDYKLLEELASTI

SEQ ID NO: 50983 - protein, 433 aa, Blastopirellula marina DSM 3645
MDQPAHDIFSHAVARLDKAFLHADIDQEAVQRLKHPKQVLEVTIPVRMDDGSLRIFTGYRVRHDATRGPTKGGIRFHPNVDLAEVKALAFWMTFKCAVANLPFGGGKGGVIVDPKELSRLELERLSRGYIERIADFIGPEVDVPAPDVYTNAMIMGWMMDEYSKIRRQHTPAVITGKPIPLGGSLGRDDATGRGAYHCIKELEAKRGWKPEEQRVAVQGFGNAGQAVARLLHADGYNVVAVSDSRGGIYKESGFDIPSLAHVKNESRHLKAVYCEGSLCESIAADVITNAQLLELEVDILIPAALENQITGENAPRVKADVIVEAANGPLTGEADDILNDKGTLVVPDILANAGGVTVSYFEWTQNRAGYYWPLELVQQRLHETMAREFNTVYNLANHKEIDMRTAAYVVGLNRIGEAIASQGTARYFTAQED

SEQ ID NO: 50984 - protein, 281 aa, Leptospira interrogans serovar Copenhageni str. Fiocruz L1-130
MNSILYLQSAVDSVLEAGKIVLEIYHSDFKVKDKGKNDPVTEADLKASSHISESLRFLNIPILSEEDSEKKDVSKLQTVWILDPIDGTREFIHKNPEFAISLGLSILGKAVLGVVFNPVTLELIYGAEDLGVVYQKLENIPDFFSVKLQNFTKILSDFKPIQKVLISRTEEKEGLFSSSMIPFGWEFVAMGSIAYKLGLVAAGKAALSISLKPKNDWDICAGIALINSSGGSDLEIKTGEPYKFQTLNGKGEGLIAGHTRSLTQVWENSKSYFQSGLRDWN

SEQ ID NO: 50985 - protein, 400 aa, Pinus mugo
MGTLLQTHIGSVAFALQKEGGHSASAKDSAFLGVSLVEHGKKEFSFPVIRAKKVTSRNTNVPRIRAQTVAAPVETKDAPASKKTDRKGNVIITGASSGLGLATAKALGESGKWHIIMACRDFLKAERMARSVGIPKENYSVMHLDLASLESVRQFADNFRRSGRPLDVLVCNAAIYLPTAKLPTYTAEGFELSVGTNHLGHFLLSRLLLEDLKTSDFNSKRVIIVGSITGNTNTLAGNVPPKANLGDLRGLAGGLNGVNISPMIDGGEFDGAKAYKDSKVCNMLTMQEFHRRYHEETGITFASLYPGCIATTGLFREHIPLFRLLFPPFQKYITKGFVSEEEAGKRLAQVVSNPSLTKSGVYWSWNNNSGSFENQLSEEASDPEKAKKLWEISEKLVGLA

SEQ ID NO: 50986 - protein, 587 aa, Bradyrhizobium sp. BTAi1
MSIASEHNARGSVGRHQPTFAELYSPKLLTVLREGYGLADLRADALAGLTVAIVALPLSMAIAIASGVSPGRGLYTAVVGGFLISLLGGSRFQIGGPAGAFIVLVAATVDRQGLDGLLVATMMSGVMLVIAGYLRLGTYIKFIPYPVTVGFTAGIAVIIFASQLKDLFGITLPGKEPGELIPKLVALAHGAPTANIPAVALAVMSIVIIVWLKQLRPTWPGILIAVVIAAIITFALQLPVETIGTRFGGIPRELPAPALPAFSLAKVQAVFPDAIAFTLLGAIESLLSAVVADGMTGRRHRSNCELVAQGFANIGSALFGGICVTGTIARTATNVRAGARGPVSGMLHSLFLLVFMLIAAPLASYIPLSALAAVLVVVAWNMAEKHEFLTLIRSSWGDATVLLATFGLTIFRDLTEGILVGFALGAVLFINRMAQMTGVEDGTPLVAQDRADFEDGARVPYDAKLSADKDVLVYRITGAFFFGAASTVGTVLDSIADRRKAFVVDFAAVPFLDSTAANAMSRVAAKAKRQGIRLFITGASPTVRRALLTHGVRPPLVRYRETIERAVADIKGRETAGEEIADGLAAS

SEQ ID NO: 50987 - protein, 479 aa, Vitis vinifera
MEVAGDSKASSSWKMAKNVRKLLEKTPKDEAVSARDKISGSRFPSSVSAQDLRLLDMKKGKDEHTPKGILEFCAESFVPEMQTSCLGSSESKRSRARSHWRSFLNRFTKNSVIRFPSLTPVMSKRSRGKSQSARENVLAVNTFNSSWKNFSLVELQNATKNFHHENLIGKGGYAEVYKGRLKDGQFIAIKRLTQGTPEERVMSFLHELGIIAHVNHPNTAKLIGYGVQGGLHLVLQLSPLGSLGSLLHVTKSKLEWSSRYKIALGTADGLRYLHEHCQRRIIHRDIKADNILLTEDFEPQICDFGLAKWLPKQWTHFNVTKFEGTFGYFAPEYFMHGIVDEKTDIFSFGVLLLELITGRRAVDHMKQSLVVWAKPLLYKNSVAELVDPALDEYDEEEMDRMLLTASLCIEQSPVLRPRMNQASTNFRKVVVLLRGDEYNPDGAQESQNHMPKRTYSNEILDAAEYNSTKCLDERLGEDQ

SEQ ID NO: 50988 - protein, 361 aa, Arabidopsis thaliana
MKALILVGGFGTRLRPLTLSFPKPLVDFANKPMILHQIEALKAVGVDEVVLAINYQPEVMLNFLKDFETKLEIKITCSQETEPLGTAGPLALARDKLLDGSGEPFFVLNSDVISEYPLKEMLEFHKSHGGEASIMVTKVDEPSKYGVVVMEESTGRVEKFVEKPKLYVGNKINAGIYLLNPSVLDKIELRPTSIEKETFPKIAAAQGLYAMVLPGFWMDIGQPRDYITGLRLYLDSLRKKSPAKLTSGPHIVGNVLVDETATIGEGCLIGPDVAIGPGCIVESGVRLSRCTVMRGVRIKKHACISSSIIGWHSTVGQWARIENMTILGEDVHVSDEIYSNGGVVLPHKEIKSNILKPEIVM

SEQ ID NO: 50989 - protein, 407 aa, Oryza sativa
  misc_feature (297)..(297): Xaa can be any naturally occurring amino acid
  misc_feature (323)..(323): Xaa can be any naturally occurring amino acid
  misc_feature (385)..(385): Xaa can be any naturally occurring amino acid
  misc_feature (400)..(400): Xaa can be any naturally occurring amino acid
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKGKEMGITDFINSKASGKPVHEVIMEMTDGGVDYSFECTXASPDVLREAFVSTHDGWGLTVVLGIXHATPRMLPLHPMELFDGRRITGCVFGDFKGKSQLPEIVEKCMQGEININFDGFITQELPFAXDINKAFQLLEEGKSXLRCLLHV

SEQ ID NO: 50990 - protein, 453 aa, Coprinopsis cinerea okayama7#130
MHSFLGTGVFNSDGEMWKFHRGITRPFFSRDRISDFDIFDAHATDALERGKARLAEGHPIDFQDLVARFTLDSAAKFLFGAELGSLSASVPYPPNSGLPNPTSFTLHPSNTFVNAFFNGLNEVAMRSVIGEEWPLREFSKDLVKPYRDIVDQIIEPMVDAALQAAHSDTSEKEKSGRDEPTTLLQQLVSQTKDKGIIMDELLNLFVAGRDTTACTLTFSVYMLAEHPAVVERLRAEVLNKVGEKGRPSYDDIRDMKYLRAFINEVLRLYPPVPINNRQAINDTLFTTKDGAQPIFVPAKTQVIYSVVDMQRRKDLWGPDADEFDPDRFLDERLHRYLIPNPFIFSPFNAGPRICLGQQFAYNEVSFFLIRLLQQFSKFSLALDAQPADSLPPAAWKGKEGLQAKEKIWPGVNLTLFVKVGCILDTSRGKADASDTGWIMVYSEKNSEKSGEFT

SEQ ID NO: 50991 - protein, 270 aa, Glycine max
MAGSSINRGERWSLNGMTALVTGGTRGIGHSIVSDLAAFGAAVHTCSRTQTELNKCLQEWQSQGFQVTGSVCDVSSPPQREKLIQEVASTFNGKLNIYVNNVGINIRKPTIEYTAEEYSQIMTVNLDSSFHLCQLAYPLLKASEKGSIVFISSVAGVVSLGTGAVYAASKAAINQLTKNLACEWAKDNIRSNCVVPWATRTPLVEHLLRDQKFVDDIMSRTPIKRIAEPEEVSSLVTFLCLPAASYITGQVICVDGGLTVNGFQPSMRIT

SEQ ID NO: 50992 - protein, 122 aa, Brassica napus
  misc_feature (69)..(69): Xaa can be any naturally occurring amino acid
MAANIGIMDSAYFVGRTEILAWINSTLHLNLSKVEEACSGAVHCQLMDSVHPGTVPMHKVNFDAKSEYXMIQNYKVLQDVFNKLKLTKHIEVSKLVKGRPLDNLEFMQWMKKYCDSINGGQL

SEQ ID NO: 50993 - protein, 555 aa, Mycobacterium tuberculosis CDC1551
MTTARPAKARNEGQWALGHREPLNANEELKKAGNPLDVRERIENIYAKQGFDSIDKTDLRGRFRWWGLYTQREQGYDGTWTGDDNIDKLEAKYFMMRVRCDGGALSAAALRTLGQISTEFARDTADISDRQNVQYHWIEVENVPEIWRRLDDVGLQTTEACGDCPRVVLGSPLAGESLDEVLDPTWAIEEIVRRYIGKPDFADLPRKYKTAISGLQDVAHEINDVAFIGVNHPEHGPGLDLWVGGGLSTNPMLAQRVGAWVPLGEVPEVWAAVTSVFRDYGYRRLRAKARLKFLIKDWGIAKFREVLETEYLKRPLIDGPAPEPVKHPIDHVGVQRLKNGLNAVGVAPIAGRVSGTILTAVADLMARAGSDRIRFTPYQKLVILDIPDALLDDLIAGLDALGLQSRPSHWRRNLMACSGIEFCKLSFAETRVRAQHLVPELERRLEDINSQLDVPITVNINGCPNSCARIQIADIGFKGQMIDDGHGGSVEGFQVHLGGHLGLDAGFGRKLRQHKVTSDELGDYIDRVVRNFVKHRSEGERFAQWVIRAEEDDLR

SEQ ID NO: 50994 - protein, 92 aa, Helianthus annuus
MASQQGQQTRKIPEQEKKDLDQRAAKGETVVPGGTRGKSLEAQERLAEGRSKGGQTRKDQLGTEGYKEMGKKGGQTTGDKSAGEREEEEEED

SEQ ID NO: 50995 - protein, 416 aa, Rhizopus oryzae
MSLSNKLSIRDLNLKDKRVLIRVDFNVPMKDGAITNNNRIVQALPTVKYALDNGASAVILMSHLGRPNGEAVAKYSLKPVAAEVEKLLGKPVEFLNDCVGTDVEKTCQSAKDGKVILLENLRFHIEEEGSAKVDGQKVKADAEAVKKFRASLTTLADIYINDAFGTAHRAHSSMVGVNLSQRAAGFLMQKELEYFAKALENPSRPFLAILGGAKVSDKIQLIENMLDKVNALIICGGMAFTFKKTLDNVKIGKSLFDEPGSKLVQNLVKKAAEKNVKIVFPVDFITADKFASDAITGYATDDDGIPDGWQGLDCGEQSNKLFREEILKSKTIVWNGPSGVFEFDAFSSGTKAVLDAVIDATKEGATTIIGGGDTATAALKWGAEGQVSHISTGGGASLELLEGKELPGVTALSSKN

SEQ ID NO: 50996 - protein, 404 aa, Yersinia pseudotuberculosis IP 32953
MSPIEKSSKLDNVCYDIRGPVLKEAKRLEEEGNKVLKLNIGNPAPFGFDAPDEILVDVIRNLPTAQGYCDSKGLFSARKAIMQHYQARDIRDLTVEDIYIGNGVSELIVQSMQALLNLGDEMLVPAPDYPLWTAAVSLSSGKAVHYMCDEESGWFPDLDDIRSKITPRTRGIVIINPNNPTGAVYSKELLLEIVEIARQNDLIIFADEIYDKILYDDAQHHSIAALAPDLLTVTFNGLSKTYRVAGFRQGWMVLNGPKKHAKGYIEGLEMLASMRLCANVPMQHAIQTALGGYQSISEFIQPGGRLYEQRDRAWELINQIPGVSCVKPQGALYMFPRIDQKRFNLKDDQKLVLDLLLQEKVLLVQGSAFNWPYPDHVRIVTLPRVDELEMAVRKLGRFLETYHQ

SEQ ID NO: 50997 - protein, 416 aa, Rhizopus oryzae
MSLSNKLSIRDLDLKNKRVLIRVDFNVPMKDGAITNNNRIVQALPTVKYALDNGASAVILMSHLGRPNGEAVAKYSLKPVAAEVEKLLGQPVEFLNDCVGPDVEKACQSATGGKVILLENLRFHIEEEGSAKVEGQKVKADAEAVKKFRASLTALADIYVNDAFGTAHRAHSSMVGVDLPQRAAGFLMQKELEYFAKALENPARPFLAILGGAKVSDKIQLIENMLDKVNALIICGGMAFTFKKTLDNVKIGKSLFDEAGSKLVENLVKKAAEKNVKLVFPIDFVTADKFAPDAKTGYATDADGIPDEWEGLDCGEQSSKLFREEILKSKTIVWNGPSGVFEFDAFAKGTKSVLEAVIEATKEGATTIIGGGDTATAALNWDAADKVSHISTGGGASLELLEGKELPGVTALSSKN

SEQ ID NO: 50998 - protein, 266 aa, Clostridium acetobutylicum ATCC 824
MKVYVNERSLDVKNGTTLMQLKRQIKKDSDVVVYNGFIMKKDLSLKEEDNVVFIKKGEIPKKEDMEAQLVSRHTPKVHEKVKNTSVGIAGLGGLGSNAAVSLARIGVGRLVLVDFDVVEPSNLNRQHYFIRHIGMKKTEALKEIISQCNPFVKVDVVDTFINGNNAQEIFKDVDIIVEAFDNPVCKAELINSVLTKMNGKKVIGASGMAGYFSSNSIVTKKINKNFYIVGDGENEAAPGCGLMAPRVNIAANHEANQVLRIIMENE

SEQ ID NO: 50999 - protein, 169 aa, Microcystis aeruginosa PCC 7806
MDLSRIPAQPKPGLINVLVEITAGSKNKYEFDKDLNAFALDRVLYSSVQYPCDYGFVPNTLADDGDPLDGMVIMDQPTFPGCVITARPIGMLEMIDGGDRDEKILCVPAKDPRYAEVKSLKDVSPHRLDEIAEFFKTYKNLEKKVTEILGWKDVDAVTALVEQCIAAYK

SEQ ID NO: 51000 - protein, 158 aa, Corynebacterium diphtheriae NCTC 13129
MSIEVTIEIPKGSRNKYEVDHETGKVYLDRYLFTPMAYPLDYGFIDHTLGEDGDPLDALVILPEPVFPGVIVKARPLGVFKMTDEAGGDDKLLCVIDDPRWDHLQDIQDVSSFLRDEIEHFFVHYKDLEPNKEVTGSGWGDKAEAEKIHAESIERYQG

SEQ ID NO: 51001 - protein, 414 aa, Campylobacter jejuni RM1221
MLVIEDVRAYEVLDSRGNPTVKAEVTLSDGSVGAAIVPSGASTGSKEALELRDNDERFGGKGVLKAVANVNETIADEILGLDAFNQTQLDDTLRELDGTNNYSNLGANATLGVSMATARAAAAALGMPLYRYLGGANASILPVPMCNIINGGAHANNNVDFQEFMIMPFGFTSFKEALRSVCEIYVILKKELANSGHSTALGDEGGFAPNLANNTEPIDLLMTCIKKAGYENRVKIALDVASTEFFKDGKYHMEGKAFSSEDLIERYVELCAKYPICSIEDGLAENDFEGWIKLTEKLGNKIQLVGDDLFVTNEDILREGIIKKMANAVLIKPNQIGTITQTMRTVRLAQRNNYKCVMSHRSGESEDAFIADFAVALNTGQIKTGALARGERTAKYNRLLEIELESDEYLGEKL

SEQ ID NO: 51002 - protein, 489 aa, Bordetella bronchiseptica RB50
MRIEHLIDGKAVAGKQYFETINPATQETLAEVAAGGEAEVHAAVAAAKAAFPKWAGLPAAERARLVRKLGDLIAAHVPEISRTETNDCGQTIAQTGKQLVPRAADNFYYFAEMCTRVDGHTYPTPTHLNYTLYHPVGVCALISPWNVPFMTATWKVAPCLAFGNTAVLKMSELSPLTAARLGELALEAGIPPGVLNLVHGYGRDAGEPLVAHPDVRAVSFTGSTATGNRIVQAAGLKKFSMELGGKSPFVIFDDADLDRALDAAIFMIFSNNGQRCTAGSRILVQQSIYADFTQKFVERARRIRVGDPLDEGTIVGPLISPAHLAKVRGYIELGSKEGATMLCGGLDRPSYAPELDARVRDGNFVWPTVFADVDNRMKIAQDEIFGPVACLIPFRDEAHAIELANDIEYGLSSYVWTESVGRAHRVAAAIEAGMCFVNSQNVRDLRQPFGGTKASGTGREGGTWSYEVFCEPKNVAVSLGNHHIPHWGA

SEQ ID NO: 51003 - protein, 351 aa, Prochlorococcus marinus str. MIT 9313
MAKQGPMRIGINGFGRIGRLVFRALWGRPGIEICHLNDPSGDAATAAHLLKFDSVHGRWDQLVGGSENQLLVNQQTISYSQGSTPGAVPWNDAGIDIVLECSGKFKSPETLSVYFDQHALKRVIVACPVKGKLAGKEVLNIVYGINHHLYDPKIDHLVTAASCTTNCLAPLVKVVHENFGISHGCITTLHDTTNTQVPIDSFQTDLRRARSCLQSLIPTTTGSAKAIAMIFPDLEGKLNGHAVRVPLLNASLTDAVFELKRSITVKDANEAFRHAAEHQLKGILGYEDKPLVSIDYVNDSRSSIVDGLSTMVVNGSQLKVYAWYDNEWGYSSRMADLTCYISNLENTSNTF

SEQ ID NO: 51004 - protein, 574 aa, Physcomitrella patens subsp. patens
MGNTCIGAAGYFQGFSAAIALGGRSFTSNSEISPSAKADGDRHKAGGDSTATQQKAPRQNYIPSVEATDQQEFRDVIEAMRKGREIEPVPGQSLTHSVLQRKTENLRDLYTLGKKLGQGQFGTTYLCIEKATSKEYACKSIAKRKLISKEDVEDVRRELQIMHHLSGHPNIVMIKGAYEDPASVHLVMELCAGGELFDRIIQRGHYSEAKAAILIRTIVGVVETCHSLGVMHRDLKPENFLFSSTKEDAALKTTDFGLSVFFKPGEIFRDVVGSPYYVAPEVLRKNYGPEADVWSAGVILYILLCGVPPFWAETEQGIFEQVLKSELDFATDPWPKISDSAKDLIRKMLNPEASKRMKAHHVLCHPWICEDGVAPDRPIDSAVQSRLKHFSAMNKLKKIAIRVIAESLSEEEIAGLKEMFKMMDADNSGSISYEELKEGLKKVGSILKEEDMRQLMDAADVDGNGTIDYGEFLAATLHLNKIERDENMLAAFSYLDKDKSGYLTVDEVQHALAEFRMGDLSVDELLREVDQNNDGRIDYAEFVAMMRKGNTGGAGRSSLRNSQSLSLNDVLMVG

SEQ ID NO: 51005 - protein, 254 aa, Campylobacter jejuni RM1221
MLNLDKFLEIAINASNQASKAILEERKNFKTWEKEDKSPITSADLASNKILNDILGSTDIKILSEEKLLSKEECEELKTFWLIDPLDGTSGFLKGSDEFCVMISLVHDNRPVLSLIQNPSKGDIFYAHAKTKVYKNDKPLQIDQQEYEKNKYKALLSVNHLSKEDEDFAKEHQLEAINIGSGLKFCAILEARAGVYKRFEKLNIWDIVAGDFLINQNGGFMGDFSKKYILYNPLNYKSSPFICVSSRNFLQDFL

SEQ ID NO: 51006 - protein, 380 aa, Oryza sativa Indica Group
MAKLSREQLERGVICSSAGNHAQGVALSAQRLGCDAVIVMPVTTPEIKWRSVERLGATVVLKGDSYDEAQSYAKQRCEQEGRTFIPPFDHPDVISGQGTIGMEIVRQLQGPLHAIFVPVGGGGLIAGIAAYVKRVRPEDMFEEKRSILEPAGALALAGAEAYCKYYGLKGENVVAITSGANMNFDRLRLVTELADVGRKREAVLATFLPEEQGSFKKFAELVGRMNITEFKYRYDCNAKDALVLYSVGIYTDDELKAMVERMESSKLRTVDLTDNDLAKDHLRYFIGGRSEVTDELVYRFIFPERPGALMKFLDAFSPRWNISLFHYRAQGETGANVLVGIQVPPEEFDEFKSRADNLGYEYMSEQNNEIYRLLLRDPKI

SEQ ID NO: 51007 - protein, 439 aa, Thiobacillus denitrificans ATCC 25259
MTISKDDQARLYRYYTEPTLVTELTRKTLALVLAGGEGSRLKDLTAWRAKPAVPIGGKYRIIDFPLSNCVNSGIRRIGVLTQYKSHSLIRHLQRAWGLMRTEVGEFVEILPAQQRTHKKEWYQGTADALFQNLDIMQRHHPEYVLVLGGDHVYTMDYTQMLLYHVQTGADVTVGSVEVPVAEAAAFGVMSVDESLRITEFNEKPREPDSMPGKPGTALVSMGIYVFSKDFLYKALIEDAGATRSSHDFGKDIIPSSISRARIMAFPFRDREGKPGYWRDVGALNCYWQTNMDLCSIEPALNLYDCEWPIWTYQPQYPPAKFIFDDEGRRGEAIDSLVAGGCVLSGARVKRSVLFFATTVGCSSLVKDSVILPKVRIGRNCRISCAIIDKGTVIPDGTVIGEDPVEDAKRFHVTPEGIVLVTPRMLGQNIYARWEDEYDG

SEQ ID NO: 51008 - protein, 567 aa, Kluyveromyces lactis NRRL Y-1140
MLQSIVRTPRVLRASNALKLSVRCVSTDQFSDNLQRMYSHLKADERLEDGSPDYVRLILRSSVYEVIEETPISRAVSLSSRLNTNVKLKREDLLPVFSFKLRGAYNMIAKLDETQKNAGVIACSAGNHAQGVAFSSNHMNIPATIVMPVSTPSIKYQNVSRLGAQVVLYGDDFDEAKLECARLAEERGMTDIPPFDHPYVIAGQGTIAMEILRQVQNGSNIGAVFCAVGGGGLISGIGSYLKRIAPHIKVIGVETYDAATLDVSLKNGKRTPLPSVGTFADGTSVRLIGEETFRVCQDVVDEVILVNTDEICAAVKDVFEDTRSIVEPSGALAVAGLKKYVSQLHPEIDHSKKTYVPILSGANMNFDRLRFVSERAVLGEGKEVFMLVTIPDTPGSFKKLQNVIHPRAVTEFSYRYNEHCHENDSDVPTACIYTSFNVVDREKEIKQVVQQLHALGFEAVDISDNEMAKSHGRYLVGGASKIENEKVIAFEFPERPGALTKFLSGLNVSWNLTLFHYRNHGADIGKILAGISVPPQDNEIFQKFLDDLGYKYQDETDNMVYQKFLKY

SEQ ID NO: 51009 - protein, 248 aa, Vitis vinifera
MGVWGVVLVCLLICARVPSSWSDPDDEACLTHLSESLEDPTKAPPATMGESISSRSPTSLSEAPSLPTFPTAPISNPSDLSSNSLTGPIPSDLQSLVNLAVLNLSSNHLDGEIPPQLAFCAYLNVIDLHDNSLSGPIPQQFGLLVRLSAFDVSNNRLSGPIPPNLGNRSGNFPRFNASSFEGNKDLYGYPLAPLKSRGLSILAIVGIGLGSGFVSLVLSFTAVCIWLRVTEEKMASEEGKISQLMPDY

SEQ ID NO: 51010 - protein, 102 aa, Plantago major
MEKVLQMASENGIVIFSKSTCCLSYTVQMLFQQLGTHPCIHDLDHDPEGKEVEKALMRMGCGGPVPAVFIDGNLVGSTNEVMSLHLSGTLLPMLGAHRAKLH

SEQ ID NO: 51011 - protein, 468 aa, Desulfotalea psychrophila LSv54
MMVRIMKPLRIEKIGGTTMSRFGEVLDNVIFYDSEDIFNRIYVVSAYSGVTNALLEHKKTHQPGIYQTFVQNEACDMAMERLKTTLCEINRGFADIGLDLEVANNFICKRIQDAVEVLHSMANVLSSGYVNRSEMLLAARELLASIGEMHSAFNSANILQNRGYKASYVDLSGWQDSRDMTIDQRILETFTKFDPSDTICIATGYAKGREGIMREFDRGYSEVTFSKIAVLLKASEAIIHKEYHLCSGDPLIIGEDKVHPICNTNYDVADQLADVGMEAIHPKASKQIEIAGISIRIKNSFDPSHSGTLFTKEYICPQSKTEVITGSDKVTCLEVHDTRMVGEVGFDMKIMEVLSAHQVSYINKATNANTIGVIVYDNDCTEELLRDLRAEFELVTDMHTAIVCAIGSNIAKPGILAKATNALATSHINILAVSQTSRQTNMQFIINREHFKEAQRVLHAALCEEGES

SEQ ID NO: 51012 - protein, 487 aa, Ralstonia solanacearum GMI1000
MGKATGFLEFPRQNEAYEAPAARVKHYKEFVFALADSEAKIQGARCMDCGIPFCNNGCPVNNIIPDFNDLVYRQDWKTAIEVLHSTNNFPEFTGRICPAPCEAACTLGINEAPVGIKSIEHAIIDKAWAEGWVQPQVPRHKTGKTVAVVGSGPAGLAAAQQLARAGHDVTVFEKNDRIGGLLRYGIPDFKLEKTQIDRRMQQMEAEGVTFRTGVMVGDKTVPAGICNDARETLAAQDILKTFDAVVLTGGSEVPRDLPVPGRDLDGVHYALEFLIPQNKEVAGDAPNPIRADGKHVIVIGGGDTGSDCVGTSNRHGAASVTQFELLPRPPEEENKPLVWPYWPIKLRTSSSHDEGCERDWSVATKALIGENGRVTGLKAVRLEWKDGKMAEVEGSEFLLKADLVLLAMGFTHPVGGVLEAFGVAKDARSNARAATEGDNAYATNVPKVFAAGDVRRGQSLVVWAIREGRQAARAVDAFLMGHSVLPR

SEQ ID NO: 51013 - protein, 249 aa, Geobacillus stearothermophilus
MIHVKTEREIQLMREAGKLLAACHQEIAKRIKPGVTTMEIDRFVETFLAKYGAKPEQKGYRGYPYATCASINDEICHGFPRNEPLKEGDIVTIDFVVNWRGALADSAWTYAVGDVSEDVQKLLHVTEQSLYKGIEQAVVGNRIGDIGHAIQTYVESHGFSVVRDFTGHGIGPTIHEEPYVPHFGEKGKGMRLKEGMVITIEPMVNMGAWQSKMDANGWTARTIDGSYSAQYEHTIAITKNGPLILTTTA

SEQ ID NO: 51014 - protein, 940 aa, Cryptococcus neoformans var. neoformans B-3501A
MQTPAHHGHRLHGHGAVIREDFCSFCGGTDAINKQGVQETMVSCAACGRSGHPTCLNMLTPKLRKRVMMYDWHCIECKTCEQCAIKGDDSRLMFCDTCDRGWHSYCLNPPLAKPPKGSWHCPKCLSPPAVSSGSISNPRSATRPSKLHPRPSKPGKARPANTPNTSNNRRRPKQSLAGDDALFTSHRIKVKVPNPNYQYRDSEEGRGTPMIVRLKVPKRPVEEEPEEKKIPYGGVITGDDADTTRTKITEADKEAYQMAKNAAEKQLGGPVPTRETPGPGSPLPMASPSGKTTPSSKFPATSRPLRDRLLHQTLPDAHPFPSTPGTTQEVVPWTGSARLEKIKTIRFGPYDINTWYSAPYPEEYAYVPDGRLWLCEFCLKYMKSGFAATRHRLKCKSRHPPGDEIYREGAVSVFEVDGRKNKIYCQNLCLLAKMFLDHKTLYYDVEPFLFYVMTEVDELGARFVGYFSKEKRSMDNNVSCIMTLPVRQRKGWGQLLIDFSYLLSKKEGRTGSPEKPLSGLGAVSYKSYWRLTVFKYLLNAISPSFNHTLELPPVPDATPGPTSELDFNSNTETKPTPPRITSKDISKATSMTLEDIFTTLSAEGMINVLDDLTVDAIGKTPNSARTRGRSRGRPNVNRRKADLNGSGTLDPQIHQDEDDHVKLPKRYEILLDKAYLQAVVEKHEKKGYLKLAPERLKYHPFLVARQTEEPESGGKKEDENEENGNEKDKEREDESENGVVRFVDSIAEAAHIIAQSHAHFHPVPSSTISRTSHHPVYPTPTPNHNSIPNRNTTSPARNLRKRKSDVVLETPVRKLRSRDNIREGMGTSPRTLRMRNAVALGEGIAEGEEENQGLSKLNQLPVKPVTQFADGEIPIDPALLEESITLDPSMYGSVGEEVYDNDAEGEEYIGEDDDAEGEEYIGEEEDAEGEADEEYIDYDV

SEQ ID NO: 51015 - protein, 383 aa, Brassica napus
MDSERNKVRSTMGHRHSKSKSSGPPPSSSSSSSSTNVVHHVQPSGERRGSSGSGPTPVGSSSTGGSRSAASAQQNGRILGRPMENVRGTYDFGKELGRGQFGVTYLVTHKETKKLFACKSIPTRRLVHRDDIEDVRREVQIMHHLSGHRNIVDLKGAYEDRHSVNLIMELCEGGELFDRIIAKGHYTERAAADLCRQMVMVVHSCHSMGVMHRDLKPENFLFLSKDESSPLKATDFGLSVFFKPGDKFKDLVGSAYYVAPEVLKRNYGPEADIWSAGVILFILISGVPPFWGENETGIFDAILKGELDFSADPWPTVSAGAKDLVKKMLKYDPKDRLTASEVLNHPWIKEDGEASDKPLDNAVLSRMKQFRAMNKLKKMALNV

SEQ ID NO: 51016 - protein, 162 aa, Triticum aestivum
  misc_feature (136)..(136): Xaa can be any naturally occurring amino acid
MAPTVMASSATSVAPFQGLKSTAGLPVSRRSNGASLGSVSNGGRIRCMQVWPIEGIKKFETLSYLPPLNTEALLKQVDYLIRSKWVPCLEFNKVGFIFREHNASPGYYDGGTGTMWKLPMFGCTDATQVINKWEKXRRIPDRTSARQVHASVHRLNRLKIRG

SEQ ID NO: 51017 - protein, 275 aa, Clostridium acetobutylicum ATCC 824
MDKITIEDLEIFANHGVLGEEKVLGQKFLLSLYLTLDLRKPGLSKTLSDTVNYAELSDRVEEEFQRENFDLIETAAEKVAEFILLNYDLIQSVKVILKKPWAPVKKHLKYVSVEIERSWHTVYIGLGSNIADKSQNLKDALKIIDDNYLCKITKTSNFYTTRPVGYLNQDNFLNCAAEVKTLMTPNELMDFFLETEKSLKRERKIHWGPRTIDIDILLYDDLVTYDPHCTIPHPRMAERLFVITPLCDINPYLVHPISNKRLINIKNVLSKTQSL

SEQ ID NO: 51018 - protein, 129 aa, Triticum aestivum
  misc_feature (51)..(51): Xaa can be any naturally occurring amino acid
  misc_feature (86)..(86): Xaa can be any naturally occurring amino acid
  misc_feature (91)..(91): Xaa can be any naturally occurring amino acid
  misc_feature (119)..(120): Xaa can be any naturally occurring amino acid
MAPTVMASSATSVAPFQGLKSTAGLPVSRRSNGASLGSVSNGGRIRCMQCXPSEGIKNSETLSYLPPLKHGGLLKQVDYLDSVQSXVLCLXFNKSVYPSRLTQCVSPGTNNGRYWTMLXXPIFGCTDAS

SEQ ID NO: 51019 - protein, 133 aa, Zea mays
  misc_feature (10)..(10): Xaa can be any naturally occurring amino acid
  misc_feature (75)..(75): Xaa can be any naturally occurring amino acid
  misc_feature (115)..(115): Xaa can be any naturally occurring amino acid
MAAKLAQLRXQVTRVGESASKTAAPTSNEVMEKNKQYVVQTPTDEKCQELSKQLFYTRLISLPGRYESFWKELDXDKHEWKNMKDLTDKDLAIASLFGVELYAWVCARDIVRRGXTLTGYKVYMISTCARPAS

SEQ ID NO: 51020 - protein, 1843 aa, Oryza sativa Japonica Group
MRFSASSVALREFHGESRLEAARSERRWWPGLAPVRLALFVEPMNINAQSLMVATLAKSLKNLGYEVEVLAFADGKANDILENICHVNVVSPPSLKYIDWSKYNAVLLSSLEGKMVVSILMQEPFQFLPVVWLIHEDALGQFLRNPELHQSIPNHIEDWRTHFNACTYVVFPDSYLPLLHSALDTGNFLVISGSPVDILATKRYSSSHTQESARNQYGSKEDDVVVLVVGSYLFFDELPWDFATVLRASAPHIMDMAKTKNLGVQFIFFCGNDTDAYNSAFQELASHMGFPLGSVKHFSLTHDIRNLLVFADIVLYGSSRQEPVFPPLLLRSMASEIPIIVPNLTVITKYITDGTHGFLFNADDPSTMVSAFAQILGEKRLSARAFSVALEGKLLSKNMLAYDCITAHVMLLESVLHYPSYAKLPSPVSKLQERTWLWDLFETKAALENSSSDDDSQLLTRIIDNLVDESHESNQTYSDSNDTSLYNYPSLSDWNDLNEVEIFEDIERREIEEASFSPLPFPIDERVERPLLSWDEVYKNARKSERLKPEGNERDEGELERTGQPVCIYEIYSGEGAWPFLHHGSLYRGITLSKGGRRPRSDDVDAVTHLSVLDNPYYSDRLCEFGAMFAVANRIDAVHKLPWIGFQSWQAAGRKVSLSEKAEETLEETMAGENNEDVIYYWAPMDMDQTSNFWSMCDWLNAGRCRTLFEDAFRTMYGLSDGITALPPMPNDGDYWSTLHSWVMPTPSFLKFIMFSRMFVDYLHSLNVNGTDPASCLLGASQLEKRHCYCRILEVLVNVWAYHSGKKMAYLNPVTGDIREQHPLDDRNEMWVKFFNFTLLKSMDEDLAEEADDGMHAGDDQWLWPLTGQVFWPGIADREREEKYIKKLDKKLKNKVPARAAAAAAAARAIAGLPPHEKISLPSNSEDLVSIYGSNPQGHAVDELEEVFFQEEFDPIKYILQSIPAEGDSSYFDKQSTLRLAQLDKIAERLSHHVMGHHEEMDIPVISIFLNFPKITCSVLCYQKCIYTDFLLRKSQITDNKFWPVKGMQLVMELEQDLKVANVICMNGRRHVSSSKNEVSRDLVVNVKSKKKQALLDVLPILTELRNAQDMQMELESFVEKENYFQAFQLLPEYLQILENYSGLSSVQEMGRGIEAWLARTIQKLDTHLLGVCQTFHEESYLTVIDAYALMGDIGGMAEKMQSFFLQEVLSQTHYVLKEMLEEVSRFTYSDLCAQVPEPKLRPCLLRTFQSLFSLMCSYYTIMSFCPGVKSIESEGENSLTGRNNTSQSADESLGDSVVFSTSTYQFLKNYEDLTIFILAGEAFCGFEASEFRQKLKGICLNYSVAFHRQNIYALKMVLERESWTIMSAEASRIISLAGLTGDGAALISPTSRISTLPIHGSTMSDTGKEKNGFAAWTKIENPFFYKVENGTTESPKSNMMFNSVDNSSAHGSTNNGNGNKAPLDEENEDLLADFIDEDSQLPSRLAKTKIVKGNSSHWKDGDISSQTGSSLSLLRCDFFTGIRMMDKYARLMQKLEIVNVELFKGICQLFGIFYHYIYETFGNQDRGQSGKSLPDHQSFRLRVALSKITQDSDQWIKPQSISYSPSSPVSMDVMPTAPPSSMFTLYGLKERCAAAETISLVARVLNRSRAHLHSVLSQSNTSILEEFFGTMVDSVPDLAEHIHRTSARMLLHINGYPDKIANAKWEVKELGMEHNGYVDLLLGEFKHYKTRLDHGGISKELQDLLLEYGIDSIAEVLVEGLSRVLINGLLHIVSANVRPKLQIVDTFIKAYYLPETEYVHWARSHPEYSKSQVVGLVNLVATMKGWKRKTRLETIERIEAGP

SEQ ID NO: 51021 - protein, 555 aa, Roseovarius nubinhibens ISM
MYSYNEFDAAFVAERNRQFRAQVERRIDGSLTEDEFKPLRLMNGLYLQLHAYMLRVAIPYGTLNSRQMRQLALLAEKWDKGYGHFTTRQNIQYNWPELRDVPDMLDALAEVEMHAIQTSGNTIRNVTADHFAGAAADEVTDPRPVAELLRQWSTDHPEFQFLPRKFKIAVTGSENDRAVIRAHDIGIQVVERDGQIGYRILVGGGLGRTPMIGKVLNDFVAQEDLLPYVEAVVSVWNLLGRRDNKYKARIKITVHEHGIDDIRARVDAAYARIRPSFGGLDLDLFEDIKSAFAAPAFSQKPTALFDTAYQTDPIFRAWADTNLAEHRAPGYAIVQISLKAHGETPGDATAEQMRVMADLAERFGHDELRISHEQNVILPHVHKSDLPEIHATLKKHGLATANIGLISDIIACPGMDYCALATARSIPVAQQIATRFDELKLEHEIGDLKIKISGCINACGHHHVGHIGILGLDRAGVENYQITLGGDGSENASLGERTGPGFAYDEIIPAIERLIAAYLQHRDNPEETFLAAYRRLGMAPFKAALYDEAQAYAAE

SEQ ID NO: 51022 - protein, 560 aa, Thiobacillus denitrificans ATCC 25259
MVSSVLVRTGDTRTSGLSTRPVHRLLQAHHSRMADVHMRELFDTDPQRFERFSLQVGDLLLDYSKNRITDETMDLLVRMAEESDVAGWRERMFRGDKINTTENRAVLHVALRNRSNRPVNVDGEDVMPKVNAVIERMGAFAEQVRGGVWRGYSGALITDVVNIGIGGSDLGPQMVVQALKPYRHPRLKLHFISNVDGAHVKETLEALDPETTLFIVSSKTFTTQETMTNAHYARDWFLARAGDVAHVARHFVAVSTNRDAVTAFGIDAANMFEFWDWVGGRYSLWSAIGLSIVLAVGAERFLELLEGAHEMDEHFRHAPLRQNMPVILALLGIWYNNFFGAESHAILPYDHYLRSLPAYLEQADMESNGKSVDRDGRVVDYPTGQIIWGATGINGQHAFYQLLHQGTKMIPADFIVSITPHTELQEHHDILIANFLAQTEALMRGRTREETLEEMGRSPGDPSVQHRVFEGNHPSNAILLKKLTPHTLGMLIALYEHKIFVEGVIWNLNSYDQWGVELGKQLAGRILPELHADAPVAGHDASTNALINHYRRMTQPHPGL

SEQ ID NO: 51023 - protein, 345 aa, Pseudoalteromonas tunicata D2
MSYTLPAEWALQDAIMFTWPHSETDWAPILADVEPVYLNLCRHILRYQSLVLVVHSESEQARVRALLCEQQLDLSKIQFVITPFEDTWARDHGPITVTNAHGQLKSLDFTFNGWGNKFDASLDNSINQAVFAQVLNPLAQSEQVNFVLEGGAIESNGQGTLLTTGSCLLNTNRNPHLTQAQIEQLLSDTLGISHFLWVNHGHLEGDDTDSHIDTLVRFAPNDTLVYVCCDDPSDSHYHELERMALDVKALRKPDGTAYNLISLPWPSAKCAADGSRLPATYANYLIINGAVLVPTYQDKNDAFALSQIAKAYPEHEIIGVDCLPLIHQFGSLHCISMQLPKGFLR

SEQ ID NO: 51024 - protein, 411 aa, Campylobacter jejuni subsp. jejuni NCTC 11168
MNLKEEALKYHLGGKIDIVPSKPMATSYDLSLAYSPGVAEPCLEIAKDNELAYTYTNKANLVAIVSDGSAVLGLGNIGAQASKPVMEGKACLFKKFANVNAYDIEINVHSIEEIVNFCKALAPTVGGINLEDIAAPKCFEIEAALQDLGIPVMHDDQHGTAIISTAGLMNAMEISGKKFKDIKVVVSGAGAAGIASAKMYRNLGVENIILVDSKGVISKDRNDLTPQKLEFAVDSKEKTLKEVLKGADVFLGLSAPKILDDEMVLSMAKDPVIFALANPIPEVMPEDVARLRKDAIVGTGRSDYPNQINNVLGFPFIFRGALDVRASKITENMKVAAAKALADLAKLPVSDAVKKAYNLSTLEFGRDYVIPKPFDERVKAAVSTAVAAAAVKDGVAKVKNFDEKAYFESLK

SEQ ID NO: 51025 - protein, 458 aa, Borrelia burgdorferi
  misc_feature (61)..(61): Xaa can be any naturally occurring amino acid
  misc_feature (89)..(89): Xaa can be any naturally occurring amino acid
  misc_feature (308)..(308): Xaa can be any naturally occurring amino acid
  misc_feature (363)..(363): Xaa can be any naturally occurring amino acid
  misc_feature (426)..(426): Xaa can be any naturally occurring amino acid
  misc_feature (433)..(433): Xaa can be any naturally occurring amino acid
  misc_feature (437)..(437): Xaa can be any naturally occurring amino acid
MKKQNPWIYLNEEEKNQILNFSESYKKFISKFKTEREVTAYALDKAKKLGFINAEEKKNLXPGDKIFYTCREKSVAFAIIGKNPIEDGXNFIVSHTDSPRLDAKPSPISEENELTFIKTNYYGGIKKYQWLSTPLSIRGVVFLKNGEKVEINIGDNENDPVFVIPDILPHLDRKIQRNKKSDEIVEGENLKILIGSLPIETKEKNKVKLATLQLIKEKYKIEEEDFVSSEIEIVPAGTAKDVGFDKALIGAYGQDDKICVFTSLESIFDLEETPNKTAICFLVDKEEIGSTGSTGLDSRYLEYFVSDXIFKIKKSEYNNLHVQKALWNSKSISADVCAAINPLFSSVHDEQNAPQLGYGIPIXKYTGHGGKSMASDADAELVSYIRQLLNKNNIAWQVATLGKVEEGGGGTVAKFLAGYGIRTIDXGPAVISXHSPXEITSKFDLYNAYLAYKAFYRE

SEQ ID NO: 51026 - protein, 473 aa, Vitis vinifera
MGRREKSFLGILKVLLVVSAAFGSEDGYRRSSQGQRHRNAYAAMMYMGTPRDYEYYVALRVMMRSLMKLKVEADLVVIASTDVPLRWVQALEQEDGAKVVRVKNMNNPYKNQDHFDMRFKLTLNKLYAWSLVDYDRVIMLDSDNLFLQKTDELFQCGQFCAVFINPCIFHTGLFVLQPSMEVFRSMLHELAIGRENRDGADQGFLASYFPDLLDQPMFHQPPNATKLDGNYRLPLGYQMDASYYYLKLRWTIPCGPNSVITFPSAPWLKPWYWWSWPVLPLGLSWHRQRLQTLGYNAEMPVVLMQWIVYLGVIAMARLARSNLSKLCYRRVEKSSSSIQTGLKLLTLWSIVAAYVLPFFLIPRTVHPLLGWTLYLVGSFALSSIAMNAFLLPMLAVLTPGLGILGALLVMAFPWYPDGVVRALVVFAYAFCCAPIAWTSLVKIMTCHQVSPEKEVFFPKLGDSQPSPDPIKLC

SEQ ID NO: 51027 - protein, 222 aa, Bradyrhizobium sp. ORS278
MPVIPSTKPYRIGRSKTGLGLFATQPIKKGTKIIRYFGPLLDSKKAEDDAIENKYLFELDNRWTIDGSVRENVARYINHSCKPNAESDVKPRKKKIFIRAIKNIAPGEEINYDYGTDYFKAYLKPIGCKCDACEKKRAKKKAEARAERAKQKAKDERKAAKKAKKKAKKTSDKLPKETVKSKQRVKAKTSTRAKAESRRPAAGKRVKTKSSPAKTLTRAKAA

SEQ ID NO: 51028 - protein, 369 aa, Herminiimonas arsenicoxydans
MKSRAAVAFGPGKPLEIVEIDVEPPRKGEVLIKITNTGVCHTDAFTLSGDDPEGLFPVVLGHEGAGIVVEVGEGVTSVKPGDHVIPLYTAECGECLFCKSGKTNLCVAVRATQGKGLMPDGTTRFSYNGQPLYHYMGCSTFSEYTVVAEVSLAKINPDANPEHVCLLGCGVTTGIGAVHNTAKVQPGDSVAIFGLGGIGLAAIQGARQAKAGRIIAIDTNPAKFELARTFGATECLNPKDFDKPIHEVLIEMTGWGVDHTFECIGNVNVMRSALEAAHRGWGQSIVIGVAGAGKEISTRPFQLVTGRTWKGSAFGGVKGRTQLPGMVEDAMKGEIDLAPFVTHTMGLDEINHAFDLMHEGKSIRTVIHY

SEQ ID NO: 51029 - protein, 258 aa, Triticum aestivum
  misc_feature (70)..(70): Xaa can be any naturally occurring amino acid
  misc_feature (95)..(95): Xaa can be any naturally occurring amino acid
  misc_feature (201)..(201): Xaa can be any naturally occurring amino acid
  misc_feature (240)..(240): Xaa can be any naturally occurring amino acid
MSALLQVKVIPVDGVPCLTSSIFVNDSFSLSHKIHASTVGITRFCYASLAGFHFEEELMQSLKINDTTRXPYIAIIGGSNFLRKAPAPHLLAFNXDGLFLVGKLSFQIMNGLGIPVSSCLLEKNATKEVLQLIKIAHNRNIPIYYPTDLWCLNSNNNEQLEIFDSAELLSGLISLGWTSVDIGPSTLEIIFSLLSSYKKIXWIRPTSFDLTEEFSVGATQLGQILNKASHNSCDVILVGXAACKAVKGISDSSSLYTS

SEQ ID NO: 51030 - protein, 538 aa, Saccharomyces cerevisiae
MSMPIASTTLAVNNLTNINGNANFNVQANKQLHHQAVDSPARSSMTATTAANSNSNSSRDDSTIVGLHYKIGKKIGEGSFGVLFEGTNMINGVPVAIKFEPRKTEAPQLRDEYKTYKILNGTPNIPYAYYFGQEGLHNILVIDLLGPSLEDLFDWCGRKFSVKTVVQVAVQMITLIEDLHAHDLIYRDIKPDNFLIGRPGHPDANNIHLIDFGMAKQYRDPKTKQHIPYREKKSLSGTARYMSINTHLGREQSRRDDMEALGHVFFYFLRGHLPWQGLKAPNNKQKYEKIGEKKRSTNVYDLAQGLPVQFGRYLEIVRSLSFEECPDYEGYRKLLLSVLDDLGETADGQYDWMKLNDGRGWDLNINKKPNLHGYGHPNPPNEKSRKHRNKQLQMQQLQMQQLQQQQQQQQYAQKTEADMRNSQYKPKLDPTSYEAYQHQTQQKYLQEQQKRQQQQKLQEQQLQEQQLQQQQQQQQQLRATGQPPSQPQAQTQSQQFGARYQPQQQPSAALRTPEQHPNDDNSSLAASHKGFFQKLGCC

SEQ ID NO: 51031 - protein, 357 aa, Oryza sativa Japonica Group
MAGAVSALFLLDIKGRVLVWRDYRGDVSALQAERFFTKLLDKEGDSEAHSPVVYDDAGVTYMFIQHNNVFLLTASRQNCNAASILLFLHRVVDVFKHYFEELEEESLRDNFVVVYELLDEMMDFGYPQYTEAKILSEFIKTDAYRMEVSQRPPMAVTNAVSWRSEGIRYKKNEVFLDVVESVNILVNSNGQIVRSDVVGALKMRTYLSGMPECKLGLNDRVLLEAQGRATKGKAIDLDDIKFHQCVRLARFENDRTISFIPPDGSFDLMTYRLSTQVKPLIWVEAQIEKHSRSRIELMVKARSQFKERSTATNVEIEVPVPSDATNPNIRTSMGSAAYAPERDAMVWKVKSFPGGKS

SEQ ID NO: 51032 - protein, 448 aa, Geobacillus stearothermophilus
MKAKTKKYIQVKTAIPGPKAKELLRKKEENVPRGPFHTVPTFAVKGEGALLTDVDGNTFIDLAGAIGSLNVGHCPPKVVEAIQKQAEQYIHPCFHVMMYEPYVELAETLNRITPGNHSKKTFFLNSGAEAVENAVKIARKYTGRRAILSFERGFHGRTLLAMSLTSKVKPYKFGFGPFAPDTYKLPYPYYYRKPAGMTNEELDAELLRRLEDFFLSDVPAEEVAAIIMEPVQGEGGFIVPSKTFVQGVKRICEKYGILFIADEIQTGFGRTGKMFAIEHFDVIPDLITMSKSIGAGVPISAVTGRAEVMDAPNPGEIGGTYGGSPLGCVAALEVIRMLQQEQLVERANVIGQIAIDRFRRLQEKYETVGDVRGLGAMVAVEFVTDAKTKTPNKELTAAILRECHQRGVIVMGAGLYSNVIRLLTPLVITDEQLEEALDVIEEVIAELA

SEQ ID NO: 51033 - protein, 450 aa, Coprinopsis cinerea okayama7#130
MVKPIEPEFEQALNELTNSLQPFLAANPEYTKALEIIQIPERVLQFRVVWEDDQGQPQVNNGFRVQYNSALGPYKGGLRLHPSVNLSILKFLGFEQTFKNALTGLNMGGGKGGSDFDPKGKSDSEIRRFCNAFMMELYRHIGKDTDVPAGDIGTGGREIGFLFGAYKKLRNEFVGMLTGKGLHWGGSFIRPEATGYGVIYYVEHMIARSCPEFSLNKPSTLVAVSGSGNVAQFTALKVIELGATVLSLSDSRGTLIAEEGYTKEFVQEIAKLKRGGGSLEELADTPGYTYHAGKRPWTLLPKVHIALPGATQNEVNKAEAEALVAAGVRIVAEGSNMGCTEEAVEVFEAARKAGKGVWYAPGKASNCGGVAVSGLEMAQNSQRLAWTTEEVDSRLKKIMSDCFSICYDAGAKWSGEDLQDGKILPSLLSGANVAGFIKVADAMREQGEWW

SEQ ID NO: 51034 - protein, 482 aa, Geobacillus stearothermophilus
MIYVNGKWSKGEGKKRPVINPANEEIIIEINEASQQQAVEAIQAARHAFQYTDWPFNPAKRIAALRQLADLLEQNAETFASIETLNTGKPIRESRLDVSDSIQCLRYYADFVEQRAIEEIKRTDGTTSKIIEEPIGVCALIVPWNFPLLLGIWKLAPALAAGNTVVFKPSELTPLSFIELTKLIDSIGLPPGVFNLVPGGGSPVGETLVTHPDVEKISFTGGTKTGRWIYEQGARRLKRVSLELGGKSPLLIFDDADLASTIEWALFASFFNQGEVCVAASRILVQRRVYDSFLDQLTQRLASLRIGDPFAEHTEMGPLISSSHLEKVETYIQIGLQEGGVLLQGGKRMKELGYYLTPAVFAHVRQDMRIVQEEIFGPVITVQPFEHDEEAIKLANDTIYGLAAGLFSRDLERAEQIAGKLRAGTIWINSYHTPYVDAPWGGLKQSGIGRELGPQGFAAFTETKHVNISQHGKPLGWYSSHS

SEQ ID NO: 51035 - protein, 321 aa, Arabidopsis thaliana
MSLLCSCIIGDQMETNNEGLSYSYYEKTCPKVEEIVRSSLSSMFILDPTSPAALLRLMFHDCQVQGCDASILLEPIRDQQFTELDSAKNFGIRKRDLVGSIKTSLELECPKQVSCSDVIILAARDAVALTGGPLISVPLGRKDSLSTPSKHVADSELPPSTADVDTTLSLFANKGMTIEESVAIMGAHTIGVTHCNNVLSRFDNANATSENMDPRFQTFLRVACPEFSPTSQAAEATFVPNDQTSVIFDTAYYDDAIAGRGNLRIDSEIGADPRTRPFVEAFAADQDRFFNAFSSAFVKLSSYKVLTGNEGVIRSVCDKVD

SEQ ID NO: 51036 - protein, 188 aa, Pseudomonas fluorescens Pf-5
MPMNIPNLITVLRVLLIPIFILLFYLPYSWSYMAASSVFAFAAATDWLDGYLARRLQQSTPFGAFLDPVADKLMVAVALVLLVQEHHNLWLTLPAAVIIGREIVISALREWMAELGARAQVAVSNMGKWKTAAQMLALVILLANPSDFSFWVLVGYALLLAAAGLTLWSMLQYLRAAWPHLKTDNEKK

SEQ ID NO: 51037 - protein, 237 aa, Roseovarius nubinhibens ISM
MKNLLWIALAGAVLIGGYFLITGKSPQELVEDGKSMGETAMDEAKEAVDATAEAASEAADAAGDAVNAAAETATEMATEAADAVAEGAEAVTEAAGEAVEAAGDAANAAAESTAEAVENATEATGDAAAAATESATETATETATEAAEATEATTEAAGDAASNVSGAASDAGDAAAETATDAANTATEATSDATSDATMQKIEDAAKEAMDSAAEAAKDATDAATDAAKDAMKKVTE

SEQ ID NO: 51038 - protein, 97 aa, Mycobacterium tuberculosis CDC1551
MVGIVSERDVVRQLHTYGASVLSRPVAKIMSTTVATCTKSDTVDKISVLMTENRVRHVPVLDGKKLIGIVSIGDVVKSRMGELEAEQQQLQSYITQG

SEQ ID NO: 51039 - protein, 315 aa, Pseudomonas syringae pv. phaseolicola 1448A
MRALAALSRFVGNTFAYWVLLFAILAFLFPQAFIGLKSWIVPLLGLVMFGMGLTLKLEDFSEVARNPWRVALGVVAHFVIMPGVAWLLCQVFQLPPEIAVGVILVGCCPSGTSSNVMAWLAKGDLALAVAIAAVTTLLAPLLTPTLIWFLASAWLPVSFLDMFWSILQLVMLPIVLGVVAQRLLGARVSYAVDVLPLVSVVSIVMIVCAVVAASQAKIAESGLLIMAVVILHNTFGFLLGYFTGKVFKLPLAQRKSLALEVGMQNSGLGAALASAHFSPLAAVPSALFSVWHNISGALLSTYFRKMPEEETKPGL

SEQ ID NO: 51040 - protein, 560 aa, Physcomitrella patens subsp. patens
MERPHRWRLRHHPVCRRGKKVMIIILDGWGEQIPDDFNSINVAPTPTMDALKKTAPDRWRLVRAHGLSVGLPSDEDMGNSEVGHNALGAGRIFTQGAGLVDQALATGKLYEGAGFKYISSAFAQNTLHLMGLLSDGGVHSRLDQLLLLMKGCAERGAKRIRVHILLDGRDVAPGSAPKYIDILEKEFVDIRNMGCDACIASGGGRMAVTMDRYENDWGVVKIGWDAQVRGEAPHKFATAMEALKNLKEANPKLDDQYFPPFVIVGPDGNAEGPILDNDAVVSFNFRADRMVMAAKAFDLEEFDKFDRGVMPKIKYAGMLQYDADIELPKHYLVTPPLIEKTSGEYLVHNYVKSWACSETVKFGHVTFVWNGNRSGMFSSSLEKYVEIPSNKGIPFNDNPEMKAIAIAEKARDALLSGKFDHVRVNIANGDMVGHTGDFKATISACEAVDRAVKIMLDAVEEVKGIFLITADHGNAEDMVKRNAKTGEPILNSAGEPEVLTSHTCNPVPCIIGGPGLPKGVKFRTDLPNAGLANVAATFINFHGFEAPWDYEPTLIEYKED

SEQ ID NO: 51041 - protein, 79 aa, Glycine max
MSEKGRPLPKFGEWDVNDPASAEGFTVIFNKARDEKKTGGNPESPGKTATDPHSKPAVEPGKTQTKKWFCCMQNPSAES

SEQ ID NO: 51042 - protein, 636 aa, Magnaporthe grisea 70-15
MSADFPLNKYKAGGGHPSAVRSGIQEKLDESVYSHIARLFNKYANANDMWSRDQLGIFMEHTQHEDPNGISSHLTDKAGMSLRELLDYVASPSGNALEMAAPQDLSLPLSDYFISSSHNTYLTGNQLSSDSSVDAYKDVLLRGCRCIEIDVWDGEERFLAGFSSDDAENERYRAAREAGEEETKPGPTYKVTFKDKMIIKAARWAMNKFDPVDPEGRTIDDRIADMMRGEPRVLHGFTLTKEVLFRDVCRVVKEYAFAVSDLPLIVSLEVHCSPLQQNAMCDIMEEAWEEFLLPTPEEDPTSLPSPADLRRKILIKVKYVAENKKDDGSSIVSGTENGQGEDDDSILDVVDQKDGSKKAQRVKAPKITPRLSRMGVYTRGVSFKSLSQAEATMPNHIFSLSEKVAFDTQRREPGAFFEHNRNYLMRLYPHGMRFDSSNFDPVIFWRAGAQVVALNWQSWDSGMMLNEGMFAGSDGYVVKPEGYRSSDSKDRALQSRTLDKVSITVLAGQNLPLLGGKGDASSFIPYVKVGLHTEPDPLAAMVGEDATPLDVRQVGYSGTTIKSTGTSPDFGGDIIEFLNVEGVVPELTFLSFVVMNDVVGPDVVAAWACIRLDRLRAGYRFKKNSKKSVGSFVVLT

SEQ ID NO: 51043 - protein, 438 aa, Rhodospirillum rubrum ATCC 11170
MRIAMIGTGYVGLVSGACFSEFGVDVVCVDKDVRKIDGLRERGEIPIYEPGLDALVASNTAAGRLSFTTDLKEAMAGADAVFIAVGTPSRRGDGHADLSYVYNAAREVAEHMDRYTVVVTKSTVPVGTGREVARIIREANPAADFDVVSNPEFLREGSAINDFMRPDRVVIGAETERAQAVMRQLYRVLYLIETPILFTALETSELIKYAANTFLATKITFINEIADLCEKVGADVHDVARGIGLDGRIGRKFLHAGPGYGGSCFPKDTLALVKTAQDFGAPLRIIETVVSINDQRKKAMADKVVQFLGGDVTGKTIAVLGLTFKPNTDDMRDSPSLDIVPALQRAGATIRAFDPEGMHEAAKHFTDVLYAESAYDCMAGADALVILTEWNEFRALDLDRVKTLLKAPVLIDLRNIYNPDDMEAQGFRYSPIGRRSVG

SEQ ID NO: 51044 - protein, 292 aa, Rhodospirillum rubrum ATCC 11170
MSRRVRKAVFPVAGMGTRFLPATKTMAKEMLPVVDKPLIQYAVEEAAAAGIDHFIFITGRGKSVLMDHFDHMPELEALLKERGKTDVLENLLGSMPSPGKVFSTRQQQPLGLGHAVWCARAFIGDEPFAVLLPDDLVLADTPCIKQLIDAHAQTGGNVVAVEDVPRERTNKYGILDVVEDNGTLARAKGLVEKPDSDKAPSTLAIIGRYVLDPGIFDLLENQNRGAGGEIQLTDAMNAQIKDVPFHGLRYEGARYDCGDKVGFLQANIAFALERPDMRDAVKAVLADFAKTI

SEQ ID NO: 51045 - protein, 438 aa, Kluyveromyces lactis NRRL Y-1140
MGQILSNPVIDKEQHSGSDVLTAFGLCAMQGWRMSMEDSHIVDLNISDDEKEHLAYYCVFDGHGGSSVAQFCGSQFSKILQKQDAFKKKSYNEALIQSFIATDEELLKDPVLANDHSGCTATTLLISKLQNVMICANSGDSRTVLSRNHIAKALSYDHKPTLKSEYSRIVTADGFVEMDRVNGNLALSRAIGDFEFKSNPDLAPHEQIVTCVPDLIEHTIDYNSDEFVILACDGIWDCLTSQDCVDLVHYGLKQGLTLEEISSKIIDVCCSPTTEGTGIGCDNMSIIIVALLKEDEDETAWHKRIVAKNYTPPNSFENQRRAVFHFYDFPENDDHVFEVTNKRESDETDYNDDRKVGADRGASSLANLEAILGSGGIQITPGENNLSYIHGTALSEVLASLSGGIRSQIEEEDEDDEEDEADEPTHADEVEESEVKKD

SEQ ID NO: 51046 - protein, 366 aa, Phaeosphaeria nodorum
MGCGMSTEEKEGKQRNEEIENQLKRDKMMQRNEIKMLLLGAGESGKSTILKQMKLIHEGGYSRDERESFKEIIFSNTVQSMRVILEAMESLELPLDDQRAEYHVQTIFMQPAQIEGDSLPPEVGNAISVLWKDAGVQQCFQRSREYQLNDSAYFDSIDRIAAPDYIPNDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGPDYAAACDYILNRFVSLNQHETKQIYTHFTCATDTMQIRFVMAAVNGMYFQIRLLLNTANALQTSSSRRTCGYAV

SEQ ID NO: 51047 - protein, 510 aa, Camellia sinensis
MALDTVFLLRELSFATLVILITHIFMRSILSKPLRMLPPGPTGLPLIGAIPHLGSMPHVALAKMAKIYGPIVYLKMGTCGMVVASTPDSARAFLKTLDLNFSNRPPNAGATHLAYGAQDMVFADYGPRWKLLRKLSNLHMLGGKALENWAQVRSSELGHMLKAMYDLSCRGEPVVVAEMLCYAMANMIGQVILSRRVFETKGSESNEFKDMVVELMTTAGYFNIGDFIPSIAWMDLQGIERGMKRLHKKFDVLITKMIEEHKASAYQRKETPDFLDVFMAQQENPGEEKLNTTNIKALLLNLFTAGTDTSSSIIEWALAEMLKDPKILNRAHDEMDRVIGRNRRLQESDLPKLPYLQAICKETFRMHPSTPLNLPRVSAQACRVNGYYIPKNTRLSVNIWAIGRDPDVWERPLEFIPDRFLSGKNAKTDPRGNDFELIPFGAGRRICAGTRMGIVLVEYILGSLVHSFDWKLADDGVELNMDESFGLALQKAVPLSAMVSPRLPPNAYAA

SEQ ID NO: 51048 - protein, 825 aa, Coccidioides immitis RS
MASQPSTNAQKVGHGLAKVLGIKLEKPDADPVTRGESTFSTGSGDTFVEHEPSSIDWLAECVPSGRQVLMFIVNIFPFLRWLTRYNVQWFLGDLVAGVTVGAVVVPQGMAYAKLAELPVEFGLYSSFMGVLVYWFFATSKDITIGPVAVVSTLVGHIIVRVRMEHPEFEPHVIASAFGVICGAVVTFVGLIRCGWLVDFIPLTAISAFMTGSALSISSGQVPSMLGITTFNTRDSTYKLIINTLKHLGDTKIDAAMGLSALFILYAVRSGCTYCARKYPSRAKLWFFLATLRTVIVILFYTGVSAGVNIHRRDNPRFRILGTVPRGFQHAAVPDLNPGLLSAFSGDIPAGVIVLLIEHIAISKSFGRINNYTIDPSQELIGIGVTNLLGPFLGGYPATGSFSRTAIQSKAGVRTPFGGVITAMVVLLAIYALPPVFFYIPNSSLSAVIIHAVGDLITPPNTVYQFWRVSPLEVVVFFAGVFVMVFTNIENGIYTTVCMSLAILLFRLVKAQGQFLGRVKVHTVVGDHLADSDGKYNGWGAETGPRSSAFRNIFLPISHADGSNPEIEVGQPYPGVFIYRFSEGFNYPSVNHYLDHLVSTIYKNTRRTNPNSYSRPGDRPWNMPGPRRGQSEEDRSHLPTLKAVILDFSTVNNVDVTSVQNLIDVRNQLDLYASPQPVHWHFAHLNNRWTKRALASAGFGFHTPTANSGATRWKPIFSVANLEGNASAAAHAEFLDNERENGHAVSSKHDIESPATDSATSTIQRAGGVIGAKNSSSVSVIEKELVTATEYAKHRMTVVNGVNRPLFHADLTSALQSAIANAASMT

SEQ ID NO: 51049 - protein, 414 aa, Herminiimonas arsenicoxydans
METLTHRGDEMTPTGNRIVTFEKPLEMKVNTFKFPELITPQGKSAPHGAILKIVTTNICGSDLHIYRGSFAVPKGMTMGHEMTGEVIEVGSDVEVVKKGDIVSVPFNVGCGRCYNCKHMRSDVCENTNPEIDCGAYGFNLGGWTGGQGDYLFVPYADFNLLRFPDKDAAMEKIRDLTLLSDVLPTAFHGFAGPDWPAAPAYVVGENILIFGAGPVGRAGAACARLLGAGAIIVADYIQERLDLLKPHGVETINLSDGVPIEEHLERITGHREVDRVIDYVGVDCRGFGAEADKIVESAVTNAMLKYVRFGGMTSTVGVYCANPISKDPKAKKGHMDLEWSNAWIKSPRMSAGQSPTANYNHALMRAILNDRMPYLSPMMNTKFIKLEDAPAAYKEFDAGSAYKYVIDPHGSVRQ

SEQ ID NO: 51050 - protein, 209 aa, Zea mays
  misc_feature (52)..(52): Xaa can be any naturally occurring amino acid
  misc_feature (65)..(65): Xaa can be any naturally occurring amino acid
  misc_feature (105)..(105): Xaa can be any naturally occurring amino acid
  misc_feature (155)..(155): Xaa can be any naturally occurring amino acid
  misc_feature (167)..(167): Xaa can be any naturally occurring amino acid
  misc_feature (183)..(183): Xaa can be any naturally occurring amino acid
MLLPERTRDELIKNAAYVDTPGKDILAADESTGTIGNRLSSINVENVEENRXRALRELLFCCPAXLTIHLRGVILFEDTLYHNIQDDEPFDDVHLGGMRPPCYLXHQGPIVDDETDNDTTSHGHDHVAQRCPKDYQARARFAKRGPDLKIVPIEXITALPCDLNAQXLAPYGIIWHENALVPXLCEPDILVDGPHDIDRCADFSDTVLA

SEQ ID NO: 51051 - protein, 584 aa, Coprinopsis cinerea okayama7#130
MSPGLSPLSDSLSAPPTPESFRQNPTDLSTKWLVQKFGGTSVGKFPIKIATDVVAKHLDGHKVAISPPSPRSVDGRSSGSSSPRRNGILGFTPLNGDSVKSALPEFHVTVDLIKDEHFKAARSSIRDPEILAELEKEIDSDCEWLRSFLCAAQVIDEISSRSKDSVIGLGEKLACKLMAAVLRDQVYMHVAVLFSILQISWIDSQGMEAEYVSLEDIVPSSHLTGDSDLSVGGISLEQPFYDELAKVIAQRIDQCGSRIPVVTALFVGFFGPVPGSLLAQIGRGYTDLCAALLAVGLNASELQIWKEVDGIFTADPRKVPSARLIPVISPDEAAELTYYGSEVVHPFVMEQAIRKKIPIRIKNVQNPSGGGTVIHPAPEDPVQDSQWTNGHTTNPSSERPPTHLPLGTNGYGFDDPRNRRLPTAVTIKENIVVINVHSNRKSVSHGFLAGIFGTLDRYGVVVDLISTSEVHVSMAIADGIGKRMADRFVVELKRFGEVSVEHDLAILSLVGKHMRSMVGVAAKMFSSLAERNVNIEMISQGASEINISCLIAARDAVKALNIIHQGCLKITPEEPMGRVGPWLF

SEQ ID NO: 51052 - protein, 195 aa, Herminiimonas arsenicoxydans
MPINIPILLTWLRVALIPLMVGVLYIPDAWLGSFNKTQGLAATLIFIVAALTDWIDGFLARRWNQTSAFGAFLDPVADKLMVAGALLVLIELDRVNAVIAFIIIGREITISALREWMAQIGASKSVAVSSLGKIKTIAQMVAIPMLLYYDSIWGINLKFWGDILLWVAAVLTVWSMFYYLRKAWPLIKESAGHLL

SEQ ID NO: 51053 - protein, 288 aa, Oryza sativa Japonica Group
MGGGSIRAAAKAAMIGGYRSASAVRRAVLPASPAPQTAPSAAGEGRKAASTYAAIDDWVIPDREVFGPVPTHEEAMAATLDLKESFQFAKSAQLEPLPSGDLDVPTKGLVHSESSQGLIHSKTSEHEDNHEISLVSSGAPGRVVQAFTMLQDSPEAQEVVASLASDQNVWNAVMRNEKVMKFYKTYATKLNEDEVEGSESDSVQNSSELGSAGEAFMCYVEKMKALVSEMMTNLSSIMQDLVATSDEGQSKGKLKTMILDSKKDFANAPSAFVLLAIASIMVVLLKRA

SEQ ID NO: 51054 - protein, 423 aa, Oryza sativa
MMASLHRPLSAMAVAAFAAVSSLELPDRLSHHKLPDTAVDAEAVVSNPASRPDVSAATSASAMSRLHFLPRNLQTSHPAKAPPASLPVIHTVYHYAKFAKYYSEEEAVTTAMPSSSSPDVLYLWHLPDPKVCGDSHGKSQTVVVLLGWLGSRQKHLKRYADWYTSRGYHAVTFTLPMSDIVSYNVGGKAEKNVEMLSEHLADWVSEEDGKKIVFHTFSNTGWLCYGVILENLQRQDPSAMDKIKGCVVDSAPVAVPDSQVWASGFSAAIMKKHSVAAKGVKPNDARPDVLVVESNKDHPKPAVSEAILLSALEKLFDVVLNYPAINRKLSGVMELLSSKQPKCPQLYIYSSADRVIPAKSVESFVESQRRAGHEVRACDFVSSPHVDHYRSNPELYTSQLTEFMEDCVLARCQAKEEEEEVTN

SEQ ID NO: 51055 - protein, 368 aa, Oryza sativa Japonica Group
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNSQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIWDCMSSQQLVDFIHEHINTESSLSAVCERVLDRCLAPSTLGGEGCDNMTMILVQFKKPISQNKNVSPAEQSAADKQPTGDTHWSEIHVTEESSS

SEQ ID NO: 51056 - protein, 66 aa, Arabidopsis thaliana
  misc_feature (27)..(27): Xaa can be any naturally occurring amino acid
MAFSMFFYTDVVTSPAQATMDAPFTGXKSSAYLPDTRKANNDITSITSNGCRGSCMKVWPPIGKKK

SEQ ID NO: 51057 - protein, 94 aa, Hydrogenothermus marinus
GIPLNYGIFPHTLSDDGDPVDVLVMTPFPVPPGVVIPCRCRGILLMEDESGVDAKVIAVPVSKLTPLYDTIQSLDDFPKLILEQVKHFFEPYKE

SEQ ID NO: 51058 - protein, 135 aa, Triticum aestivum
MAALASRMALQSRAALASRMAQLQSKAAEATRFAAKHGGREYHKTLMERNRQYVVDPPTVEKCQELSKQLFYTRLASIPGRYEAFWKEVDAVKLLLKNRKDLKAEQAGVAALFGIELYAWLRAGEFIGRGFTLTG

SEQ ID NO: 51059 - protein, 116 aa, Brassica napus
MEKTLATPDNARSLSPSSSAAVKSRTGGFERRTKRRLSQTKASVCVSGQEEDDEEEVKEKIEALQRIIPGGTALGVDALFEETAGYIMSLQCQIKTIKVLTSFIQSLDKQDMKFGG

SEQ ID NO: 51060 - protein, 382 aa, Desulfitobacterium hafniense DCB-2
MIYFDNAATTWPKPECVYEAVDQCLRNKGANPSRSGHFMALLAGQIVLNARVQIAEFFNISDPLQVVFTPNATEALNIGLKGLLKPGDHVLTSSLEHNAVTRPLEKLRSQGVEVTKLPTSVQEGLYPEQVAAAIQNNTKLIVLSHASNVMGLIQPIGEIGRIAGEKGVLFMVDSAQTAGSMPIDVQAMGIDLLVFAGHKGLLGPQGTGGLYLREDLRLDTLKEGGTGANSEEPFQPEESPERYESGTLNTPGIAGLGAGIEFIKQEGIEKIREKERTLTRQLMLGLSAIPGVILYGPDPSVERAPVVSINLEGREPSEVSYLLDKLYGIASRPGLHCAPDAHKTLGTFQQGTVRLSLGYFNTSQEVEECLDAVAGLSSPNKK

SEQ ID NO: 51061 - protein, 417 aa, Acidobacteria bacterium Ellin345
MIETLGVLLAGGAGERLYPLTRDRAKPAVNFGGIYRIIDITLSNCINSGLRRVYILTQYKALSLNRHIREGWSGIVGNELGEFIEILPPMKRVSENWYMGTADAVYQNIYSIGSEQPRYVLILSGDHIYKMNYDLMMRQHKDSGADVTLATILIDPSETRHFGVVDVDNQSHVNGFVEKPKSTELRSPYDPSKVSASMGIYIFNTDVLIPVLLKDAEDPNSKHDFGHNILPKMVGEYKIYSFNFIDENKKEALYWRDVGTLDAYYDANLDLVSVAPVFNLYDKAWPIRTHQRQYPPAKFVFAEQGRMGTALDSVVSMGCIVSGGTVRNCVLSPDVRVNSFSEVDSSILFSHVNVGRHCRIRRSIIDRDVHIPEGTVIGYDTESDRQKYHVTDSGITVVTRDYSLFENPVEVDYFTSE

SEQ ID NO: 51062 - protein, 527 aa, Opitutaceae bacterium TAV2
MQRSTNLDRIASATEPFDIAIIGGGATGLGAAVDAASRGHRVALFEQADFAKGTSSRSTKLVHGGVRYLKQGNISLVLEALRERGRLARNAPHLVHDQAFIIPNYSWWEGPFYGIGMKVYDQLAGKLGLAPSRMLSREETIERLPTVEQEHLVGGVIYHDGQFDDSRLAINLAQTAEDLGAIILNYCSVTGIIKEAGSVAGIEVRDEETGRGFTVRARSVINATGVFVDGIRRMDDPAAKDIVAVSQGIHLILPKEFLPGNAAIMVPKTADGRVLFAVPWHGCVVVGTTDTPLPVHSLEPRALDEERDFVMEHARKYLTKDPTDSDVLSIYAGLRPLVKAGDGKDTAALSRDHTIIVSESGLITITGGKWTTYRKMAEDVIDHAETVAGIDDRRCRTVDLQIHGWTHATIKEPNLAPYGSDAQRISRLIQTDPDLAEKLHPALPCQRGEVIWHIREEMARTVEDVLARRTRALLLNAKASIEAAPVVAALLAKELGRDQAWQDKQVADYTTLARGYVFTDPSSHGHA

SEQ ID NO: 51063 - protein, 148 aa, Arachis hypogaea
MASKRITKELKDLQKDPPVSCSAGPVGDDMFHWQATIMGPADSPYAGGVFLVNIHFPPDYPFKPPKVSFKTKVFHPNIYNNGSICLDILKEQWSPALTVSKVLLSICSLLTDPNPDDPLMPEIAHMYKSDRAKYENTARSWTQKYAMN

SEQ ID NO: 51064 - protein, 572 aa, Coprinopsis cinerea okayama7#130
MPLSPGLVFLGKRSPSLVLPPLLTYGALHVLDQTNILTLPTWAVISLVALAKPIHYACEVYHHRYRVQREAKKRGAKVVPHIEEPWPYFSGLSIIPYLMDSYLNGYVLDSVQEWVGKYGHTFELRLPSENQIWTTEPEHVKAMLATQFQNFEKGHGFIQQMHSFLGTGVFNSDGDMWKFHRAITRPFFTRDRISDFDIFDKHAAQTLELARARLAEGYAIDFQDLVARFTLDSAAQFLFGEKIDSLSAGIPYPKNSRKPNPPSFTSHPSNIFVNAFLSGLHGVTMRAIIGQEWPLAEFLRDTVKPNRDIVDQIIEPIVDKALREASTLGDVEKVEKGEEETLLKHLVSQTKDRRIITDEASPMLCSKKTRAHYTACTLTYSVYMLAENPHVAERLRSEILNKVGEKGRPSYDDIRDMSPFNTRRAINDTVFTTKDGRPPLFIPGDTQVGYSVWDMHRRKDLWGPDAYEFDPDRFLDERLHKYLTPNPFIFTPFNAGPRICLGQQFAYHEASFFLIRLLQQFSKFSLAPDAQPAGTIPPESWKTCEGRKGMEKIWPGTNLTLIVKGGLWVRME

SEQ ID NO: 51065 - protein, 319 aa, Geobacillus stearothermophilus
MAQLSVEQFLNEQKQAVETALSRYIERLEGPAKLKKAMAYSLEAGGKRIRPLLLLSTVRALGKDPAVGLPVACAIEMIHTYSLIHDDLPSMDNDDLRRGKPTNHKVFGEAMAILAGDGLLTYAFQLIVEIDDERIPPSVRLRLIERLAKAAGPEGMVAGQAADMEGEGKTLTLSELEYIHRHKTGKMLQYSVHAGALIGGADARQTRELDEFAAHLGLAFQIRDDILDIEGAEEKIGKPVGSDQSNNKATYPALLSLAGAKEKLAFHIEAAQRHLRHADVDGAALAYICELSPPATIKSGTAALASEQGRLCCFFASAP

SEQ ID NO: 51066 - protein, 630 aa, Geobacillus stearothermophilus
MDLTKIEHPRVLKTMSIPELKQLSAEIRRFLIEKLSKTGGHIGPNLGVVELTIALHREFDSPKDKLIWDVGHQAYVHKILTGRAAEFDTLRQYKGLSGFPKRSESEHDVWETGHSSTSLSAAMGMAIARDLKGTDEYIVPIIGDGALTGGMALEALNHIGHEKTDMIVILNDNEMSIAPNVGALHNILGRLRTAGKYQWVKDELELLLKRIPAVGGKLAATAERLKDSLKYLLVSGVFFEELGFTYLGPVDGHDFEDLFENLRYAKKMKGPVLVHVITKKGKGYSPAENDKVGTWHGTGPYKIETGAFVKTKEAGPSWSALVSETVRRLARTDPRIVAITPAMPVGSKLEGFASEFPDRMFDVGIAEQHATTLAAGLATQGMKPFLAIYSTFLQRAYDQVVHDVCRQNLNVFFAIDRAGLVGADGETHQGVFDIAFLRHVPNLVLMMPKDENEGQHMVYTAIRYDDGPIAMRFPRGNGLGVPLDEELKEIPIGTWEVLRDGRDAAILTFGTTISMALEAADQLAKEGVSVKVVNARFIKPMDEAVLLELLESRLPILTIEEAVLQGGFGSAVLEFAHDRGYHQAVIERMGIPDRFIEHGSVSELLREIGLTAAHIVDRIKTMAPRKQKRA

SEQ ID NO: 51067 - protein, 643 aa, Mycobacterium leprae TN
MLEQIRRPADLQHLSQQQLRDLAAEIRELLVHKVAATGGHLGPNLGVVELTLALHRVFDSPHDPIIFDTGHQAYVHKMLTGRCQDFDSLRKKAGLSGYPSRAESEHDWVESSHASTALSYADGLAKAFELAGNRNRHVVAVVGDGALTGGMCWEALNNIAATPRPVVIVVNDNGRSYAPTIGGVADHLATLRLQPAYERLLEKGRDALHSLPLIGQIAYRFMHSVKAGIKDSLSPQLLFTDLGLKYVGPVDGHDEHAVEVALRKARGFGGPVIVHVVTRKGMGYPPAEADQAEQMHTCGVMDPTTGQPTKIAAPDWTAIFSDALIGYAMKRRDIVAITAAMPGPTGLTAFGQCFPDRLFDVGIAEQHAMTSAAGLAMGRMHPVVAIYSTFLNRAFDQIMMDVALHKLPVTMVIDRAGITGSDGPSHNGMWDLSMLGIVPGMRVAAPRDAIRLREELGEALDVDDGPTAIRFPKGDVCEDIPALKRRSGVDVLAVPATGLAQDVLLVGVGVFASMALAVAKRLHNQGIGVTVIDPRWVLPVCDGVLELAHTHKLIVTLEDNGVNGGVGAAVSTALRQVEIDTPCRDVGLPQEFYDHASRSEVLADLGLTDQDVARRITGWVVAFGHCGSGDDAGQYGPRSSQTM

SEQ ID NO: 51068 - protein, 286 aa, Silene latifolia
VNRIRELPQNSNIVATHTDSPDVYIWDLESQPNRPANLGTPASRPDLTLTGHQDNAEFALAMCSSEPLVLSGGKDKSVVLWSIHDHISTLATEPGSAKSPNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADSSINLFDRRNLTASGVGSPVHKFQGHDAPVLCVQWSPHNRSIFGSAAEDGLLNIWDYEKVSKMETESGGKKSNHPAGLFFRHAGHRDKVV

SEQ ID NO: 51069 - protein, 493 aa, Lactobacillus reuteri
MATENKAVITLFGATGDLAKRKLYTALFKLYQKGYLADHFALLGTSRRPLTDEEFQQIVRESISNIPETEDGQAEAFSKHFFYKSHDVTKPEHYEILKQRLAELDEQFGAEGNRLFYMSMAPQFFGTIALNLKKQGLLTDNGFNRLVIEKPFGRDFESAKKLNDELSQTFSENQIFRIDHYLGKEMVQNIQALRFGNTMIESLWNNRYIDNIQVTLSEKLGVEERAGYYDQSGALRDMVQNHIMQIVAQLAMEQPVAFTDADVRVEKIKALRSLRLYTPSEAAANFVRGQYDAGEGTNAYRHEDGVDPESGTETFVAAKLMFDNYRWSGVPFYVRTGKKLADKFTRIDVVFKKPLIDIFANPRSESDQSLNSNVLTIFVEPNSGFAIQLNAKRAGQGFTTEPVDLRFLQSDSDKKESPEPYERLFHDALEGDHTNFASWAEIAYAWKFVDVIRKLWDIEKPQFPNYTPGSMGPAASDELLARDGRKWVYRLNH

SEQ ID NO: 51070 - protein, 68 aa, Vigna radiata
YFDGWKAYDQNPFHPTDNPNGVMQMGLAENQLTSDLVEDWILNNPEASICTPEGINDFRAIANFQDYH

SEQ ID NO: 51071 - protein, 89 aa, Hydrogenobacter hydrogenophilus
YGFVPQTLADDGDPVDVLVISRYPVIPGSVMRCRPIGGLEMRDEEGIDTKLLAVPHSKVDPTYDHIKSVDDLPKALLDKIKHFFEHYKE

SEQ ID NO: 51072 - protein, 47 aa, Rosa rugosa
GSTVEVVAAQTKAIAEKVKDWTNIVLAYEPVWAIGTGKVASPAQAQE

SEQ ID NO: 51073 - protein, 370 aa, Shewanella sp. ANA-3
MTNANVDATQLTTKPSEDGFYMPAEWAAQQAVWMIWPYRPDNWRSAGAYAQATFAKVADAIGGATPVYMGVPQAFLAEAQTVMPSHVTLVEIDSNDCWARDTGPTVVVNAEGECRGVDWGFNAWGGHNGGLYFPWDKDEQVAAQMLKQHGFARYSAPLILEGGSIHVDGEGTCMTTAECLLNANRNPDLTKEQIEALLRDYLNVKQFIWLEEGVYMDETDGHIDNMCCFARPGEVILHWTDDETDPQYPRSKAALDVLQNTVDAQGRKLKIHLLPQPGPLYCTEEESKGVTEGTGVPRTAGERLAGSYVNFLITNDRIVFPLLDPATDDIAAQKLQEIFPEHKIVGVPAREILLGGGNIHCITQQIPSGK

SEQ ID NO: 51074 - protein, 368 aa, Malus x domestica
MGKGGQSCNGMVRDVKPVEKENMAAWLVDVNTIKILPFKLPTIGPNDVQIRIKAVGICGSDVHYLKTMKCADFEVKEPMVIGHQCAGIVDKVGSEVKHLVPGDRVAVEPGISCAHCQQCKGGRYNLCPDMKFFATPPVHGALANQIVDPADLCFKLPENVSLEEGAMCEPLSVGVHACRRANVGPETTVLIVGAGPIGLVSVLAARAFGAPRIVIVDMDSKRLAVAKSLGADGTVKVSRKMEDLDDEVAKIKETMGAEVDVTFDCVGFNKTMSTGLNATRPGGKVCLVGMGHSMMTVPLTAAAAREVDVVGVFRCKNTWPLCLEFLRSGKIDVKPLITHRFGFTEKEVEEAFATSARGGDAIKVMFNL

SEQ ID NO: 51075 - protein, 293 aa, Paracoccus sp. N81106
MRRDVNPIHATLLQTRLEEIAQGFGAVSQPLGAAMSHGALSSGKRFRGMLMLLAAEASGGVCDTIVDAACAVEMVHAASLIFDDLPCMDDAGLRRGQSATHVAHGESRAVLGGIALITEAMALLAGARGASGTVRAQLVRILSRSLGPQGLCAGQDLDLHAAKNGAGVEQEQDLKTGVLFIAGLEMLAVIKEFDAEEQTQMIDFGRQLGRVFQSYDDLLDVVGDQAALGKDTGRDAAAPGPRRGLLAVSDLQNVSRHYEASRAQLDAMLRSKRLQAPEIAALLERVLPYAARA

SEQ ID NO: 51076 - protein, 617 aa, Oryza sativa
  misc_feature (13)..(13): Xaa can be any naturally occurring amino acid
  misc_feature (32)..(32): Xaa can be any naturally occurring amino acid
RSRRLGFPPLNPXGHLLLTPHLPPLSSDRARXRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTNLLIQRHARRTLSLSGGTAATVGWCVRGGRVSAAWQHLQRHNSHANVDASRVNGWATHRNGGRVRLLLLQRRFHQTPGANGGAVADGGLVLSFSPACCMSRKREKGKGGKPTGGEMEEIESRKGAVQAWNIQQRKFQHKSHPPQLNNTPTIPPAIRAPLGRTLDTMASSRFNI

SEQ ID NO: 51077 - protein, 261 aa, Buchnera aphidicola (Schizaphis graminum)
MCSLEELELWNMIKHKAQKILKKEPILSNFYQKSILNHKKLSHSLSCILSDKLSTSMISEKDIYNIFNKIYANNISIINSVVKDIKAASQRDPVVKHYLTPLLYLKGFHALEAYRLSHYLWNIKRYELSAYLQSRISTVFSVDIHPAASIGSGIMLDHATGIVIGEGVIIENDVSIFHSVTLGGTGSNTGKNRHPIIRKNVTIGAGAKILGNIEVGQGVKVGAGSIVLKNIPPFVTVVGVPAKIIKKIKNSNKNLFQKEKK

SEQ ID NO: 51078 - protein, 374 aa, Capsicum annuum
MASIINNPFTSLCCNTNKCEPNRICSLRSQQSLVFDNVNRKVGFPSVVCKAVSVQTKSPTEIEGLNIAEDVTQLIGNTPMVYLNTIVKGCVANIAAKLEIMEPCCSVKDRIGFSMISDAEEKGLISPGKTVLVEPTSGNTGIGLAFIAASRGYKLILTMPASMSLERRVILKAFGAELVLTDPAKGMKGAVSKAEEILNNTPDAYILQQFDNPANPKIHYETTGPEIWEDTKGKIDILVAGIGTGGTISGTGRYLKEKNPNIKIIGVEPTESNVLSGGKPGFIPGNLDQDVMDEVIEISSDEAVETAKQLALQEGLLVGISSGAAALAAIQVAKRPENAGKLIAVVFPSFGERYLSSILFQSIREECEKMKPEL

SEQ ID NO: 51079 - protein, 349 aa, Triticum aestivum
  misc_feature (50)..(50): Xaa can be any naturally occurring amino acid
IRIDAVGKFLQMQQMLGPTRYAYTDITAVTSHFRDKLGQGGYGSVFKGVXPGNVHVAVKMLDGNSNCNGEDFISEVSTIGRIHHVNVVRLVGFCPEEMRQALVYEYMPQGSLDKYIFSAEKNFSWDKLNEIALGIARGIDYLHQGCDMQILHFDIKPHNILLDNNFIPKVADFGLAKLYPRDISFVPSRALRGTIGYIAPEMISRSFGVISSKSDVYSFGMLLLEMAGGRRNADPNTGNSSQAYYPAWVYDRLTQQDHVGEIYAHVDAQMHELERKLCIVGLWCIQMKSHDRPTMSEAIEMLEGSADTLQMPSRPFFCDEGHVHTDDTYRLSSELTEISEEDMSENIDV

SEQ ID NO: 51080 - protein, 222 aa, Listeria innocua Clip11262
MKMIAASIMCADSLHLADELRALEQANVKMLHCDVMDGVFVKNAAMGAYVLQDIKNNTDMLLDIHLATVNPDKFVDLYAAIKPAYMSFHVEASPDVDATINHIRELGIKPSIAISPDTEIEQIYPFLEKVDMVLMMTVNPGFAGQKFQHHVLEKIKKLQKELESHTNKPLIEVDGNIFEETVRLLEPIGADVYVVGTAALFNDKAGSYTEKLAPLREIIQER

SEQ ID NO: 51081 - protein, 244 aa, Manihot esculenta
DGVPINHFLGTSTFSEYTVVHRGCLAKINLLAPLDKVCILGCGISTGLGATLNVAKPKKGSSVAVFGLGAVGLAAAEGARIAGASRSIGVDLNPSRFEEAKKFGVTDFVNPKEHDRPVQEVIAEMTNGGVDRSVECTGHVDAMISAFECVHDGWGVAVLVGVPNKEAVFMTKPINVLNERTLKGTFFGNYKPRTDLPSVVDMYMKKKLELDKFITHRLSFSDINKALELMVKGQGLRCIINMEE

SEQ ID NO: 51082 - protein, 80 aa, Herminiimonas arsenicoxydans
MSDIEQRVKKIVAEQLGVAEADIKIESSFVDDLGADSLDTVELVMALEDEFEMEIPDEQAEKITTVQQAIDYAKAHVKAA

SEQ ID NO: 51083 - protein, 247 aa, Herminiimonas arsenicoxydans
MTTVELAGQVALVTGASRGIGRAIAQALAKQGVKVIGTATSESGAAAISEYLAESGKGVVLDVNDAARSVALIDEIQKEFGTVTILVNNAGITQDQLAMRMKDEEWDSVIATNLTSVGRLSRAVLRGMMKAKHGRIINITSVVGSTGNAGQMNYAAAKAGVAGMSRALAREIGSRNITVNCVAPGFIDTDMTKTLSEQQISALLQQVPLGRLGVPEDIAAAVSFLASPQASYITGTTLHVNGGMYMN

SEQ ID NO: 51084 - protein, 502 aa, Cryptococcus neoformans var. neoformans B-3501A
MSTLSDDDKMGYLPEQDIDTTIHAAPLAELETPKKRKWMQTLSVLIAGVALFSDGYNIQITGYTNTVMAKLYPTALSSTMKTRLSNSILIGDIFGMILFGLCADRLGRRWGIIGCTFFLVLGVTLATAAHGKSEVGMLWMIVIGRGVAGLGAGGEYAVCTTSAVEAADETHTLRKKRGLLVASSTNTAIIAGFVASAIVFLIVLAAYGGEPHVGVWRICFGIGIIMPLSIFLFRVRMADSTLYSKHSIKSPKFPYWLAFKRYWKPLLGCSLVWFLYDAVVYPFNLLAPTIAAGFSSNQSLLASNGWGALVNAFALPGAFFGGFIIDRLGPRQTYAFGLVMVAIFGFVIGGAMEPLRNNGTGAFAAFVILFGLFQCFLSVGPGNCNFIVSSESFPTPVRGHALGLAAAIGKAGAAVGTQVFPLIEARFATTLKGQQAIFLIGSGICVVAAIVVMTIVPNRRAQLEDEDVEFRRYLEENGWDTSDMGSVGRIVSDEVVERGEKV

SEQ ID NO: 51085 - protein, 550 aa, Coprinopsis cinerea okayama7#130
MPSDSSSSKPAKRVVDDKESWEYPLSQLKAQQALVRSPNLKDPGYIRQKANKKLWVRERIDGILDKDSFAEVGSISGKPIVDPKTGELVSFTPANNVTGWGKVDGRKVFVTADDFSVRGGHADGGIMNKPIYGEIRLLDGSSGGGSVALYLTMGATYIPQMNILSRTIEALSVVPVVSALLGPVVGLASAKACLGHFSVMVKDLSQLFAAGPPVVKQATFEDLSKEELGGWEIHARNGTVDNVASSEADAFRQIRAFLSYLPSSVLSLPPVLHSTDPVDRREEELLNIIPRRRARPYDIRRVIHLIVDRLEGGESTFFEIGEHWGRSIVTGFARLAGRPVGVLSSDCKVNGGAIDALGSQKTTKFVNLCNHFGVPILNLVDQPGFAIGSQAERNATIKHGAATMVALYHATIPIYTTIIRRAFGVAGCAFADPEDGRGVRVAWPSGDWGSLPLEGGIEAAYKRQLENAGSPEARERMMEELLGKFEDVRSPMRTANQFGIEEIVDPRDTRRLVCEWIVHVYEHVLPPLVAYKQATYGPDGVLNGGRAYRL

SEQ ID NO: 51086 - protein, 173 aa, Oryza sativa
  misc_feature (75)..(75): Xaa can be any naturally occurring amino acid
MENFGGSFLVLSAMVLGGLPASPGAAVGQIVFTADDAEAWHAQGKSVILVRTGIGLSVPPGFTVSTEACQQWTHXDGAGWAAAGAGDGGAEPRSEAARRPAGEKSRRGGGRRGVGRRPLGAEEPPVARGRLRVRAGVHLDVGVAVGDQGLEVGLLVAGDEAERAQARAPLRPP

SEQ ID NO: 51087 - protein, 286 aa, Silene vulgaris
VNRIRELPQGSNIVATHTDSPDVYIWDLESQPNRPVNLGTPASRPDLTLTGHQDNAEFALAMCSSEPLVLSGGKDKSVVLWSIHDHISTLATEPGSAKSPNSGSNIKKAGNGNSDNPSIGPRGIYLGHDDTVEDVQFCPSSAQQFCSVGDDSCLILWDARAGLTPVTKVEKAHNADLHCVDWNPHDENLIITGSADNSINLFDRRNLTASGVGSPVHKFQGHDAPVLCVQWSPHNRSVFGSAAEDGLLNIWDYEKVSKMETESGGKKSNHPPGLFFRHAGHRDKVV

SEQ ID NO: 51088 - protein, 253 aa, Zea mays
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAAQPDVDGFLVGGASLKPEFIDIINAATVKSA

SEQ ID NO: 51089 - protein, 214 aa, Cryptococcus neoformans var. neoformans JEC21
MLNTVKGLPAAPTAYDGSGLRIAIVHARWNDTIIHALLAGARATLRQQGVRDENIVVKTVAGSYELPLACKKLIEAGKTQSANAAPSMLASSTNLLSLIDGASQPQAAGQPQTAPPAASTAPFDAVIAIGCLIKGSTMHFEYICEAVSQGLMNVQLQTGTPVVFGVLTVLNDEQALLRAGIGSGEDKGHNHGEDWGLAAVELAAQYKEWEKGFL

SEQ ID NO: 51090 - protein, 426 aa, Triticum aestivum
MELASIVSTARGPHRPHRRVRRLMEEDNKKAMRKARREYNDAVRGLAAFCKKRDKRVVDMALRKKAEEEKKKKEEMERKKAEEKKKKERAMAYQEPEWARVDDIELAFEEEDDEETREKAKEELYCVACNKKFKSEKQWKNHEQSRKHKDKVADLRMAFKEEEAALKEAEEEAGGEWEEVDVGFDFKPANESEESDWSDAAEELAEELDEGLEVADQDNGNKDFNNGEQEVGSYDETSVLEAMLSSCKNKKSGYVVPQEEAPSVLTEDDNSEDRNSEVKSVKKKGRRRRASKKGQDEGSYADSGHGMKNDVPNEESVHDNDENDADDKAEGPPSSNDDGTSASVGGQQNEKTDNPKKNKKNKKGAEKKTTVSADLKFTSKGKKQKEVSKASNDCETCGDTFESRSKLFSHLEETGHAVIKARQKKR

SEQ ID NO: 51091 - protein, 359 aa, Aspergillus oryzae
MASQKPTYRIASIPGDGIGIEVVDAAIQVVEKLAKTLGTFNIDFTHIPWGTAYYKEHGRYVSEDCLDTLRKFDAGLFGAVGAPDVPDHISLWGLLLALRGPLQLYANVRPVRTFPGTKCPLNTATEGIDWMLVRENSEGEYSGQGGRSHVGQPWEAATEVAMFTRVGIERIMRFAFEVAQSRPRKLLTVVTKSNSMRNGMVLWDQVAAEVAKDFPDVTWDKMLVDAMTVRMVAKPQSIDTIVGTNLHMDILSDLAAALAGSIGVAPSSNLDPTRKNPSIFEPVHGSAFDITGKGVANPVATFWSAAEMLSWLGEKEAAKQLMDCVEKVCAAGILTPDLGGTSNTQGVVDAVKKEIERLV

SEQ ID NO: 51092 - protein, 114 aa, Thermocrinis ruber
KYELDKESGVLFVDRFLFTAMHYPFNYGFIPQTLADDGDPVDVLVISREPVVPGAVMRCRPIGMLEMRDEEGVDTKVIAVPHTKLDPTYDNVKTLDDLPPVVLDRIKHFFEHYK

SEQ ID NO: 51093 - protein, 417 aa, Aspergillus oryzae
MATQPATTETEASASFFEAASYIPPDAIFALTAEYNADTFAQKVNLGQGTYRDENGQPWVLPSVQKARETLLSKGLNHEYLPILGLQTFRNEATKLALGSEIYDKKQSQLAICQSLSGTGALHLAGLLLRSVRSPLPKVYIPSPTWSNHGQVFSSLGFQCETFQYYDAEKRDIDIEAYYSALRAAEPNSVVIIHACAHNPTGCDPSKEQWKQIGLIMKERKLFPLFDAAYLGFNSGNVDDDAFAMRYFINELQMEAGGCLSFAKNMGLYGERVGCLFFAAGTEKAATNTQSVLEMLQRSEVSNPPAYGAKIASAILGDETLKEMWYADLITMSGRIRSMRQALYDGLIKFGAPGTWDHLIRQSGMFGFLGLSPAVVQKLKDKYHIYMASNSRVSIAGLNPSNVEYVARSIAECLNES

SEQ ID NO: 51094 - protein, 780 aa, Yersinia pseudotuberculosis IP 32953
MSKENIVTRENTAVSENAVSEPTVNNDVGASATNSVTHPAFTLNVRPDNIGIITIDVVGDKVNTLKAEFADQIATILQQAHALPKLQGLVIVSGKPDSFIAGADITMIAACRTAHDARVLAQKGQSILAQIAAFPVPVVAAIHGACLGGGLELALACHSRICSLDDKTVLGLPEVQLGLLPGSGGTQRLPRLVGVSKALDMILTGKQIRPRQALKMGLVDDVVPRDILLDVAIQRAKAGWLNRRALPWQERLLSGPLGKALLFRIVRKKTLAKTRGHYPAAERIIDVVRKGLDQGGPSGYEAEARAFGELAMSPQSAALRSLFFATTSLKKETGSAATARAIHRVGVLGGGLMGGGIANVTATRAGLPVRIKDINPQGINQALKYTWDALGKRVRSKRMRPTEQQRQMMLISGSTDYRGFERVDIVVEAVFEDLSLKQQMVADIERFGAAHTIFASNTSSLPISQIAALAQRPEQVIGLHYFSPVDKMPLVEVIPHEKTSEETIATTVALARKQGKTAIVVADRAGFYVNRILAPYINEAARCLLDGEPIESVDNALVDFGFPVGPMMLLDEVGIDVATKIMPILVEQLGPRFAAPPSFDVILKDGRKGRKNGRGFYLYSNPTLHSNSTKNSSPTKNGNSPAKRNSFKWRKNKVKPVDSSIYTLLGVTPKAHLGAGVITQRCTMLMLNEAVRCLDESIIRNPRDGDIGAVFGIGFPPFLGGPFRYLDSLGADKVVQALRLLVQQYGERFEPCQRLVTMAEQQQQFYPVDANIDEVTDVAS

SEQ ID NO: 51095 - protein, 351 aa, Francisella tularensis subsp. holarctica
MKALAKLKKQPGIWMINDAPIPEYGYNDVLIKIKKTAICGTDLHIYNWDKWSQNTIPVPMITGHEFAGEVVAKGDGVTSVDIGDRVSGEGHLVCGQCRNCRAGKRHLCRKTIGIGVNVQGAFAEYLVMPAVNVFKIPDSISDDIASTFDPMGNAIHTALSFNLTGEDVLITGAGPIGLMAVKIARFCGARRIVITDINEYRLQMARDFGATVALNVAPFKNQDELVKQMRKVMSDIGMTEGFDVGLEMSGINSAISMMLDVMNHGGKLSLLGISAGDISVDWGAILFKGLTLKGIYGREMFETWYLMTSMLQAGMDMNPIITHRLHIDEFQKGFEIMKSGQCGKVILDWSS

SEQ ID NO: 51096 - protein, 262 aa, Triticum aestivum
  misc_feature (235)..(235): Xaa can be any naturally occurring amino acid
LLEQVCTKKHSPTGPEFPGYRRPTRPVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTXIIGGGDSLAAVEKVGVADVMNHFSPGG

SEQ ID NO: 51097 - protein, 304 aa, Mycobacterium tuberculosis CDC1551
MANASETNVGPMAPRVCVVGSVNMDLTFVVDALPRPGETVLAASLTRTPGGKGANQAVAAARAGAQVQFSGAFGDDPAAAQLRAHLRANAVGLDRTVTVPGPSGTAIIVVDASAENTVLVAPGANAHLTPVPSAVANCDVLLTQLEIPVATALAAARAAQSADAVVMVNASPAGQDRSSLQDLAAIADVVIANEHEANDWPSPPTHFVITLGVRGARYVGADGVFEVPAPTVTPVDTAGAGDVFAGVLAANWPRNPGSPAERLRALRRACAAGALATLVSGAGDCAPAAAAIDAALRANRHNGS

SEQ ID NO: 51098 - protein, 331 aa, Thermus aquaticus
  misc_feature (149)..(149): Xaa can be any naturally occurring amino acid
MKVGINGFGRIGRQVFRILHSRGVEVALINDLTDNKTLAHLLKYDSIYHRFPGEVAYDDQYLYVDGKAIRATAVKDPKEIPWAEAGVGVVIESTGVFTDADKAKAHLEGGAKKVIITAPAKGEDITIVMGVNHEAYDPSRHHIISNASXTTNSLAPVMKVLEEAFGVEKALMTTVHSYTNDQRLLDLPHKDLRRARAAAINIIPTTTGAAKATALVLPSLKGRFDGMALRVPTATGSISDITALLKREVTAEEVNAALKAAAEGPLKGILAYTEDEIVLQDIVMDPHSSIVDAKLTKALGNMVKVFAWYDNEWGYANRVADLVELVLRKGV

SEQ ID NO: 51099 - protein, 171 aa, Picea sitchensis
MPNPKVYFEMTVGGAPVGRIVMELFADVTPKTAENFRALCTGEIGVGKSGKPLHYKGSSFHRVIPGFMCQGGDFTAGNGTGGESIYGSKFPDENFVKKHTGPGILSMANAGKNTNGSQFFVCTAKTEWLDGKHVVFGQVVEGLDVVKVIEGVGSSSGRTSKPVAIADCGQL

SEQ ID NO: 51100 - protein, 318 aa, Shewanella sp. ANA-3
MSRPIILDCDPGHDDAIALILALAHPELTPLAVTTSAGNQTPDKTLNNALRILTLLNRSDIPVAGGAVKPLSRELMIADNVHGETGLDGPALPAPSFQPQAVNAVELMAEKIRQSDKPVTLVPTGPLTNIALLLASHAELHAKIERIVLMGGAAGVGNWTPAAEFNIFVDPEAADIVFKSGIPITMCGLDVTHQAQIMDEDIERIRAIANPVAKCVAELLDFFMIYHRDPKWGFVGAPLHDPCTIAWLLNPALFDAQDCWVGIETQSELTLGMTVVDRYQLTGKPANATVLFGIDRQGFVDLLVDSLAVYTPTYLNRR

SEQ ID NO: 51101 - protein, 237 aa, Fragaria x ananassa
MAQSVTGIQIGGMSFPPSVKPPGSGNTFFLGGAGVRGMEIQGNFVKFTAIGVYLEDKAVPALAVKWKGKTAEELTESVEFFREIVTGPFEKFTQVTMILPLTGQQYSEKVSENCVAIWKKFGIYTDAEAKAIEKFIEVFKDQTFPPGASILFTQSPDGSLTIGFSKDGCIPEVGNAVIENKLLSESVLESIIGKPGVSPEARKSVATRLSELLKESDHCVAGNGKVDECTKEAEVKA

SEQ ID NO: 51102 - protein, 303 aa, Shewanella sp. ANA-3
MSHILVIGSANADHVMNFEYLPVPGQTLMSRAYRLEHGGKGANQAVACARLCQGDAEVAFICHLGQDSVGNDMRTSWLKDGIKAEGITQVANMSTGTALIFVGDNGENSIGIAAGANADLTPSELEKHYALFANAQFLLIQLETPMETVHHALQTAKRLGITTVLNPAPATSQELDYLKWVDIITPNETEAEALTGIEVNNEEDAELAAQWLHQQGVATVVITLGSKGAFISSAGFTGLIPALTVQAIDTVAAGDTFNGALVVGLSEGMSIAAAVGFANAASAITVTREGAQRAIPYRHEVQR

SEQ ID NO: 51103 - protein, 495 aa, Debaryomyces hansenii CBS767
MSAPTGDIGLIGLAVMGQNLILNAADNGYTVVAYNRTVAKVDDFLDNEAKGKSVIGAHSIEELCANLKRPRRIILLVKAGKPVDAFIEQLLPHLEKGDIIIDGGNSHFPDSNRRYEELNGKGILFVGSGVSGGEEGARYGPSLMPGGHKDAWPHIKDIFQSIAAKSDGEPCCDWVGDAGAGHYVKMVHNGIEYGDMQLICEAYDLLKRVGKFSNKEIGDVFAKWNKGVLDSFLIEITRDILYFNDPTDNKPLLEKILDTAGQKGTGKWTAINALDLGMPVTLIGEAVFSRCLSALKDERVRASKSLAGPSVEDDESPIQDKQKFVDDLEQALYASKIISYAQGFMLIREAAKEYGWKLNNPAIALMWRGGCIIRSVFLGEITSAYRETPDLENLLFHPFFNDAIKKAQKGWRSTIGKAVEFGVPVPAFSTALSFYDGYRSAKLPANLLQAQRDYFGAHTFQVLPGEENDFLKKDQWIHVNWTGKGGNVSASTYDA

SEQ ID NO: 51104 - protein, 64 aa, Brassica napus
  misc_feature (19)..(19): Xaa can be any naturally occurring amino acid
QACSGAVHCQLMDSVHPGXTVPMHKVNFDAKSEYEMIQNYKVLQDVFNKLKLTKVLFNLLYLRV

SEQ ID NO: 51105 - protein, 161 aa, Neurospora crassa
MTVFSLVIINKAGGLIYNRTFHEGGLNKISTNDYLVLAGTFHGVHAITARLNPVKSAPERPLSNSIPGVPGGILTRPEPPSGLEVLESENFRLQCFNTLTGVKFLLFTDTTQTNVDVIIRRIYDLYSDYVMKNPFYQLEMPIRCDMFDRKLLSYIREVNNR

SEQ ID NO: 51106 - protein, 322 aa, unidentified eubacterium SCB49
MYSNQNLLLLKILVTGAAGFIGSHACERLASLGHEVIGIDNFSSYYDVALKELNAEILKNKNITIHRIDLRDDDLTGIITEEIGAIFHFAAQPGISAACTFKEYFSNNVLATQRILDVIETLEVKPYFVNIATSSIYGLEATLTENEAPLPASWYGVTKLAAEQLVLSYSRRGLLKGTSLRLYSVYGPRERPDKLYTRLIDCGLNDKSFPLFKGSVKHLRSFTYVQDIIDGIVSVLDNQEACDGEVFNLGTEKENTTQTGINTVEEILNTSIKIDQKPARPGDQSRTKANINKARRVLGYNPQTTLKEGLEAQVAWFKESFE

SEQ ID NO: 51107 - protein, 216 aa, Listeria innocua Clip11262
MAKIVPSVFGADIGRINEQLEVLEKNGIDLLHVDMMDGSFVPNIAFGPDQIKMMKKGTKLQFDVHMMVYEPDRYIPRLVEAGAHMITVHQEATTHLHRTIQLIKSYGVRAGVVLNPGTPPSTLEYVLDDIDCILLMTVNPGLGGQKFFQSSLEKIRKTKAYIGNRPIQIEVDGGVNDELAKECTLAGADLIVVGSYLFEGDIEANLEKLSKGVLTE

SEQ ID NO: 51108 - protein, 348 aa, Listeria innocua Clip11262
MKALKLYGKRDLRYEDADMPTIEQPDDVILKVKTVGICGSDISRYSKLGPYVPGMVWGHEFSGEVIEVGSAVTDIEIGDRAAGCPALYCGECEYCKKGEFARCRKLTVIGARHPGAYAEYIKLPAENVVKIPDELDYEAAALVEPSAVVVHGFYHTKLQAGDDVVVVGSGNIGLLAIQWAKVFGARRVIAIDVDDKKLALAKEVGADVVINSLKEDPLEVVAAHTDGLNADLVVEAAGSPITSAQVFAYAKKGGGVVFLGIPYADVTIERFYFEKIVRSELTVWGSWNAISAPFPGKEWQTTIHFLANKQINIEPMITHRLSLAEGPEVFERIYERNEFFGKVLFFPE

SEQ ID NO: 51109 - protein, 143 aa, Erythrobacter sp. SD-21
MGLVIAAGETREGGCHCGAVRFSFTVPEGAIIRRCNCTICAMKGVVMLDVPMASLKITRGEDALTLYTFGSGQAKHRFCSRCGIHTFHQLRSEPDHYGVNLACVDGVSIYELAQVPVFNGQRHPGDGNAYEYTGVLRFAPIKP

SEQ ID NO: 51110 - protein, 286 aa, Lychnis flos-jovis
VNRIRELPQNSNIVATHTDSPDVYIWDLESQPNRPVNLGTPASRPDLTLTGHQDNAEFALAMCSSEPLVLSGGKDKSVVLWSIHDHISTLATEPGSAKSTNNGSNIKKAGNGNSDNPSIGPRGIYLGHEDTVEDVQFCPSSAQQFCSVGDDSCLILWDARAGLTPVTKVEKAHNADLHCVDWNPHDENLILTGSADNSINLFDRRNLTASGVGSPVHKFQGHDAPVLCVQWSPHNRSFFGSAAEDGLLNIWDYEKVNKMETESGGKKSNHPAGLFFRHAGHRDKVV

SEQ ID NO: 51111 - protein, 311 aa, Listeria innocua Clip11262
MTGKMKLFSVTSERPLATKIADYLDIPLCEVELQKFSDGEVKINIEESIRGTNAYVVQSMNANVNERLMELLIMVDALKRASVHSINIIMPYYGYARQDRKARSREPITAKLMANLIQRAGANRLITVDLHAAQIQGFFNIPIDHLSAVPLIGDYLIEKYGEEDVVVVAPDHSGVVRARRIADRLNAPIAILNRKPRPHEDEIMSVIGDVKGKVAIVVDDIIDTGVRATTSADILLEKGAVEVIACATHSVMAGDATERLQNSRIKEVITSDSIDLPEEKQFEKLTTISIGRILGRAIEGVQENRSLHPLF

SEQ ID NO: 51112 - protein, 102 aa, Striga asiatica
CKRHVDAAAASATKADDKPSPDDDLKNFDADFVKVDQATLFDLILAANYLNIKSLLDLTCQTVADTIKGKTPEEIRKTFNIRNDFTPEEEEEVRRENQWAFE

SEQ ID NO: 51113 - protein, 447 aa, Sinorhizobium meliloti 1021
MTHLLHRAIHAKLPVAVRGEGIRLFDAEGRAYIDASGGAAVSCLGHAHPDVLAALHAQLDRIAYAHTGFFTTEAAERLADRLVADAPDGLDHVYLVSGGSEAVEAALKMARQYFVEKGEPQRRHIIARRQSYHGNTLGALAAGGNEWRRAQFRPLLVETHHIDPCFAYRLQQAGESDTDYAARAAGQLEAKILELGADQVIAFVAETVVGATAGAVPPVADYLKRVRAICDKYGVLLILDEVMCGMGRTGTLHACEQDGVVPDLMTIAKGLGGGYQPVGAVLLSSAIFQAFSEGSGFFQHGHTYMGHPMAAAAGLAVQEVIRRDGLLENVVSMGDYLERCLVERLGNHHHVGDIRGRGLFRAVELVADRATKSPFDPGLKLNARIKKEAMARGLMVYPMGGTIDGQRGDHVLLAPPFILNREDVGQIVERLGDAVDAAIASLTKAAG

SEQ ID NO: 51114 - protein, 263 aa, Vitis vinifera
MHFQGSDDTSTDGGWLDGVRRGWRWKCVAGKCSTRPHELAREIQAAGEETHVVGVWLRFSLRCFEYIEEMIHKQEPLVNETKSNWLTIKRALQLVVEDTDTTNPNDIAYVFSGYAPLSIRLVQQAVRSGWRPIEEILKLLPGPHSETKRSGFASSQSIDNLAGAPASIDKVTDGRRSLVLVVFIGGVTFAEISALRFLSAQPLDKKLGAIRPLDRHITIGITSRPSDQHGRDLGRQITLHEGGEISPKNQRYITDFLPPEAIF

SEQ ID NO: 51115 - protein, 99 aa, Brassica napus
TEEVDVHTSNGVKDTAAVPSGTSTGIYKALELKDGGSDYLGKGVSKAVGNVNNNLEPTLIGKDPTQQTAIDNFMDHELDGTHNEWGWCKQKLETNANLA

SEQ ID NO: 51116 - protein, 173 aa, Rickettsia akari str. Hartford
MFIDKIKAKANDDEINVIIEIPMNSGPIKYEFDKESGAVFVDRFMQTTMSYPCNYGFIPHTLSNDGDPVDVLVVAHHPVVPGSVIKCRAVGVLMMEDESGLDEKIIAVPTSKLDITFDHIKELDDLCEMLKKRIVHFFEHYKDLEKGKWVKVNGWENKAKAETLINEGIDRVS

SEQ ID NO: 51117 - protein, 404 aa, Mycobacterium leprae TN
MREVPQVLGIVLAGGEGKRLYPLTADRAKPAVPFGGAYRLVDFVLSNLVNARYLRICVLTQYKSHSLDRHISQNWRLSGLAGEYITPVPAQQRFGPHWYTGSADAIYQSLNLIYDEDPDYLVVFGADHVYRMDPEQMLRFHIGSGAGATVAGIRVPRSDATAFGCIDADDSGRIRRFTEKPLKPPGTPDDPDKTFVSMGNYIFTTKVLVDAIRADADDDHSYHDMGGDILPRLVDGGMAAVYDFSQNEVPGATDWDRAYWRDVGTLDAFYDAHMDLVSLRPVFNLYNKRWPIRGESENLAPAKFVNGGSVQESVVGAGSIISAASVRNSVLSSNVVVDNGAIVEGSVIMPGARVGRGAVIRHAILDKNVVVGPGEMVGVDPERDREHFAISAGGVVVVGKGVWI

SEQ ID NO: 51118 - protein, 456 aa, Francisella tularensis subsp. holarctica
MSSQIKQVFARQILDSRGNPTVEVDVVLESGAFGRAAVPSGASTGIREALELRDGNKALFIGKSVYKAVENVNTKIAQAVKGLDALDQRLIDKTMIELDGSENKKNLGANAILGVSLATARAAASHLRKPFYRYLMDVKEYLMPVPMMNVINGGSHADNNVDMQEFMIVPAGFDTFSEALRCGTEVFHTLKKVLIADGYSVAGVGDEGGYAPDLPSNEAAIEAILKAVKEAGYEPGKHVFIALDPASSEFYKDGKYELKSENKSLTTEEMIDYYAAWVEKYPIVSIEDGLAEEDWAGWKLLTEKLGNKVQLVGDDLFVTNPSILAKGIEKGIANSILIKLNQIGTLTETFEAMAMAGQAGYTCVVSHRSGETSDTIIADLAVATCSGQIKTGSLSRSDRIAKYNQLLRIEEELGENAIYPGIKAFVFNSDEEVEEVVQEIIVEDSEAEKVVVQVEE

SEQ ID NO: 51119 - protein, 716 aa, Desulfotalea psychrophila LSv54
MKKYLIVGTVIALVSAYYFFGLDSYLSLQAIKTRQVQLESWRNAEPILAGLSFFGLYAVVASLSLPGAGVLTVAAGAIFGLIWGVLIVSFASTLGASLAFLLSRFLLREIVQSRFQDRLHAVNRGMEEEGAFYLFTLRLVPIFPFFVINLLMGLTSIRLRTFAWVSQLGMLVGTIVYVNAGTQLAQVESLGGILSTRLLFSFALLGIFPLICKRGIAWFKGRRLYAKWLRPARFDRNLIVIGAGAAGLVSAYIATTLKAKVTLVEAAEMGGDCLNYGCVPSKALIKSAKVAHHIRNGDKYGLDAVELSFSFRRVMARVHRIIATIEPHDSVERYTDLGVEVLCGYARLLDPWTVEVKLKSGETRRLTSRAVIIATGAGPFIPPLPGLDAVDYLTNETLWNAFANLDEAPRRLLVLGGGPIGCELSQALARLGSEVWQIQRGARLLPREDADAAAIVEASLGADGVHVLTGHTALRCERAGEEKYIVVEHEGQELRLAFDALICAVGRVARLKGYGLEELGIPVKRTVLTNEYLQTLYPNIFAAGDVAGPYQFTHTAAHQAWYAVVNALFGGIKKFKVDYSVIPWTTFVDPEVARVGLNEQEAAERGVDVEVTRYDLDDLDRAITDGVREGFIKILTVPNKDRILGVTIVGEHAGDLLAEFVLAMKHGLGLNKILSTIHTYPTLAEANKYAAGGWKRKHLPRRLLAWAERYHSWRRL

SEQ ID NO: 51120 - protein, 406 aa, Bacillus anthracis str. Ames
MNIHEIRKQFPILDQKVNGKQLVYFDSAATSQKPIQVIETLERYYKEYNSNVHRGVHTLGTKATDAYEGAREKVRKFINAKSMEEIIFTCGTTTALNTVAASYGLENVKEGDEIVISYMEHHSNIIPWQQVAKKTGATLKYLPLQPDGTISIEDARQTITPNTKIVSIMYVSNVLGTINPVKEIGAIAHENGAIMVVDGAQSTPHMKVDVQDLNCDFYALSAHKMCGPTGIGVLYGKKELLNNMEPIEFGGEMIDFVDLQESTWKELPWKFEAGTPIIGNAIGLGAAIDFLEEIGLDNIEKHEHELAQYALERLSEVDGVTIYGPKHRAGLVTFNIEDVHPHDVATVLDVEGIAVRAGHHCAQPLMKWLKASSTARASFYLYNTKEEIDTFVESLIKTKEYFTNVI

SEQ ID NO: 51121 - protein, 162 aa, Oryza sativa
FCFFFNLSLWCLELRLCVSLLSTVSRLATIVRSWPWVISVPLWCRVIVCPVEFFLFVPYVLTHMTLGYIRDDLGKFLPIYLSQGILQHDPFEVLDQRGVGELVKLATERGRKARPNLKVGICGEHGGEPLSVAFFAKAGLDYVSCSPFRVPIARLAAAQVLL

SEQ ID NO: 51122 - protein, 406 aa, Roseovarius nubinhibens ISM
MYDVETVRRDFPILSREVNGKPLVYLDNGASAQKPQVMIDAVTRAYSEEYANVHRGLHTLSNIATEKYEAVRGIVARFLGVRDEERVILNSGTTEGINMVAYGWAMPRMQAGDEIVLSVMEHHANIVPWHFLRERQGVVLKWVETEPDGALEAQKVIDAIGPHTKLVAISHLSNVLGTRVDVKPIIEAAHARGVAVLVDGSQGAVHAPVDVDDLGADFYVITGHKLYGPSGSGAIVVSRDRLAEMRPFLGGGDMIREVTRDSVSYADPPMKFEAGTPGIVQTIGLGVALEYLMGLGMENVAAHEDMLRDYAVEKLSGLNWLSQQGTTKDKAAIFSFTLGGAAHPHDISTILDKKGVAVRAGHHCAGPLMQHLGVTATCRASFGLYNTKGEVDALVEALELANDLLS

SEQ ID NO: 51123 - protein, 302 aa, Pseudomonas syringae pv. phaseolicola 1448A
MQDLLNEILDEVRPLLGQGKVADYIPALGGVRPDQLGIAVYGNDGQVFSAGDAETQFSIQSISKVFSLVQAIGHSGEDIWQRLGHEPSGQPFNSLVQLEFERGRPRNPFINAGALVICDINQARFAAPSLSMRDFVRRLCGNRAITSDSKVAESEYQHRSRNAAAAYLMKSFDNFHGDVEDVLRSYFHHCALSMNCIDLAKAFGFLANQGFCTHSGEQILTARQATQVNSIMATSGLYDEAGNFAYRVGLPGKSGVGGGIVAIVPERASVCVWSPELNAAGNSLVGMAALEKLSARIDWSVF

SEQ ID NO: 51124 - protein, 436 aa, Borrelia burgdorferi
MSNFFENYLRQVDDIETVSFVGRVQKIKGLLVESLGPQCAIGDLCLIDQRNGKKVCAEVLGFNGPYVSLMAYEGFNGIEVGNKVYSLNKGLEINLSDELLGRVIDSLGRPIDNKGSFFNNSYKELIFQKINPINRSIFEDQILTGVKVLDGFLPVAKRTKELVFFWFGVGNSYLCLGMIAKNSNADVNVIAFIGERGRELNEFIEHELGEERLKKSVLVVSTSDESPISRYKGAYVATMIAEYFREQGKDVLCFDSITWFANAKKRDVSFFRGAPVAKGYPPSVFVEIPILLERSGFNGNGGSVTGFYTVLVEGDDFTEPVDDNIKAVLDGHIILDRDLFDRGIYPSINVLSSTSRSIHRIMSLEKQKLIMKARNLLSIYKDYEDLIRTGIYLKGSNKDVDFAISKYPKIINFISQGINETFDFENLEDEIKEILS

SEQ ID NO: 51125 - protein, 313 aa, Oryza sativa
MAWPGQWRTRKGAFSRVLSLSSEEPSFEESEAGVGGRAGQGLAAGGGRLHVGRGMATGGVAVRRAARQAVACGSAGGEAGGGSGAHGYVGGLEGPAATPRFSQSFAIAWRAPSEAMEYWYWIDTGAAAGGRRAGEDKHLSKWTDADVDEFIASDPVYSPQLKAMRESRKSALGGALVGGTHLGGIALKYSKAPHDIITNRDLSNQLLFCAVRVRLVPDLVDETAVAYNAEADAWVPLPDMATERDEARGLYVGGVFVVVGGGGDGARSGSHDGAASAVHALLLAAASTMYGVGGGGGFNAPSTAFARRPQPGG

SEQ ID NO: 51126 - protein, 420 aa, Synechococcus sp. RS9916
MTHQLAIYLLVFGGLLLLAVLLDDLAERIRMPGVLMVLLLGLLIDNKLGSGAGAAPLLSLHQAQQITEAALVLVLFFGGLTTNWSQVKGVIRPAARLATLGVVFTSVLLAVVMLLFGVGVSGASWTTGLPKALFVGAMVGSTDASAVFALLRPLRNRLPKPLLDLIEIESGFNDPMAVVLAGVALALVGGGGVTPGQLVIDVVRQFLLGIMVGFFGGSLTVQLLRSRTSLSHSTMLPVVSLALLLVLSGGTILLGGSSLLAAYVAGLVMGNADSLDREVLEEAHASFAKMAELLLFLCMGLVVDPTHVVHAAGWGLLLFVVMQVVRLVIVQVLLLRTAFPPPQRMFVVCAGLRGAVPIALAIGAWASDVPWGWQMPPLALAVVLYGLLIQGFALVPLARRLQITLPDPGADPPLDTAPSS

SEQ ID NO: 51127 - protein, 304 aa, Shewanella sp. ANA-3
MSQLYLEDGIKQLASEFIAAGCPSVREQSLEERRQGYIASTVLAGEPEAVFEVKTLSLEGIELTLFKPSVDNNLPVVIYYHGGCFVSGGIATHNQQLRKIANDSGALVVAVSYRLAPEHVYPAAHDDAFNAANLVQQHCQQWGGDDTNITLMGDSAGGHLALVTCLRLKAQGQWLPKKQVLIYPMLDATAKSQSYIDNGDKYIITRDTLLTGFDMYLDWHPRTDVEASPLRSHDLAGLPETHIITAEFDPLLDEGEQLFRNLLDAGVNAHCRRYLGVIHGFFQLAGVSQSARDAMVQITHIIRV

SEQ ID NO: 51128 - protein, 163 aa, Physcomitrella patens subsp. patens
MSPCAACKLLRRRCARDCVFAPYFPPDEPQKFANVHKVFGAANVNKMLHDLPVHQRGDAVSSMVYEADARVRDPVYGCVGAISSLQQRIAFLQNQLAVANAEILCMRMQQAANNAPTLKVEPQATPPSQPPEMSSPLQPQSPELQHHHKPCTNASESGEAVWT

SEQ ID NO: 51129 - protein, 322 aa, Synechococcus sp. RS9916
MVIASDITALVGRTPLVRLNRLPAASGCRAELVAKLESFNPTASVKDRIAGAMVQAAEEAGTISPGRTVLVEPTSGNTGIALAMVAAARGYRLILTMPDTMSTERRAMLRAYGAELQLTPGTEGIQGAIDLARELVDEIPEAYLLQQFANPANPAIHARTTAEEIWADTEGQLDVLVAGVGTGGTITGCGRLLKQRHPGLKVVAVEPAGSAVLSGQPPGPHRIQGIGAGFVPPVLDRDLIDEVMAVSDEEAMVIGRRLAREEGLLSGVSSGAAVAAALQLGQRPELEGKRIVVILASFGERYLSTPMFSSALPLPPRLDGQL

SEQ ID NO: 51130 - protein, 204 aa, Thermus thermophilus HB8
MAANGAKGRKVMRVLVVDNYDSFTYNLVQYLGELGAEPIVWRNDRFRLEEVEALDPDRILISPGPCTPFEAGLSVPLVQRYAPRYPILGVCLGHQAIGAAFGGKVVPAPVLMHGKVSPIHHDGTGVFRGLDSPFPATRYHSLAVVEVPEALVVNAWAEEAGGRTVMGFRHRDYPTHGVQFHPESYLTEAGKLILKNFLEDPWTR

SEQ ID NO: 51131 - protein, 166 aa, Hyphomonas neptunium ATCC 15444
MFTRRLFLASSALGLAACTAASAKDLSKNTETAGYAGDEWRQLSEADWKARLSPAAYEVLREHGTERPFSSPLDKETRAGMYHCAGCDLALFSSEAKFDSGTGWPSFWEALPGAMGMSVDRRLFYPRDEYHCARCLGHQGHVFDDGPAPTGKRWCNNGVALTFKPA

SEQ ID NO: 51132 - protein, 661 aa, Debaryomyces hansenii CBS767
MNSLTRGGNSIKRLFGDAYSILRKYSRFIGPGLMVSVAYMDPGNYSTAVAAGSAFKYKLLFLILLSNCLAVFLQILSAKLGAVTGLDLAANCKANLSFRVNIFIYCLAELAIIATDLAEVVGTAISLNILFDLPLLAGVIVTVVDVLIVLMAYKPNGPLIFVRIFESFVSVLVGATVVCFAIELYQVSHEEGINFSTWEVIKGFMPNEKVVDMSDRDGGNGLYLSLAILGATVMPHSLYLGSGLVQARLKDYDIKHGHYKPLTDEPSNSEESADPEHNDEFERNEHPDQCTTNPFEKDEDEDENDHYRPSIHSINDTMTYTIVELVISLFTVALFVNSAILIVAGATLNNNKHKRDDDHDGNDTDDSDDEDDYQNADLFTIYNLLSTHLSPTAGFVFALALLCSGQSAGVVCTLAGQMVLEGFLLWSLPPITRRLITRGLAIIPCLVVVTLAGREGLSNVLNMSQVVLAILLPVVSAPLIWFTCSKEIMKVPIFVRDGDEEVDIMLDDDMDSSISRTITTSSAATLTNGKVKRFKSTEPAIRLQDLRNSHPCAGWDDDEAEASEEQQRLINHNNDSDSEITTSLGANEFQYGQHRRNISAGSDTYANTIIESEEDTYRVKGYKDMSNGPVTAFTAVLVWGFITCLNIYLLGSLILGYDVPL

SEQ ID NO: 51133 - protein, 626 aa, Silicibacter pomeroyi DSS-3
MESFLYQATIYLAAAVIAVPLAARLGLGSVLGYLAAGLIIGPVLGLVGAETADLQHVAEFGVVMMLFLIGLELEPRALWDMRDKLLGLGGLQVGVSTLAIMVVAMVAGQPWSVALAVGLTLSLSSTAIVLQTLSEKGLMQTNGGRATFSVLLTQDIAVIPILAFLPLLASAPVAHFAGDGSINRVHKAGAGHEASLSLVEGLPGWAVTLVTIAAVAFVVLAGIYLTRPLFRFIHASRLREMYTALALMIVVGISFLMTLVGLSPALGAFLAGVVLANSEFRHEMESDLEPFKGLLLGLFFITVGAGIDVGFFLADPLDLIGLALLVILFKGVILYIVGRAFQLKGRDRWLFTLGLAQAGEFGFVLLAFSTQQNVIPAHLSQKLLMIIALTMMITPLLFILYELLSRRMRDHVADMVPDTIDEQGPVIIAGIGRFGQIVNRLVTASGFKTIVLDHDMETIQLMRRFGVKGFLGDPTRPELLKAAGLAKAQVLVAALDDDNQVTKLVAYARRQRPDLHIIARARDRNHVYELYRAGANDIVREMFDSSVRAGRYVLENVGLSEYEAAQAAQTFYHHDRQAVRDLAEVWDPNIPTADNKAYVERSQALQKDLETALMELSEELASRRSA

SEQ ID NO: 51134 - protein, 166 aa, Striga asiatica
  misc_feature (99)..(99): Xaa can be any naturally occurring amino acid
VCVKSIKLFCSTTKMVNYWKSKVLPKIKKAFENPKKAAAAEACKAFDEAKEQYSKELDEKKTELQPKVVEIYEASSTEIKALVKEPKGSSVKKHSAAVXKFLDELAKIEFPGSKPVCEAATKVGPAYVVGPVSFVLEKVSTFVVVKEEEEEKKVEPPKTEPAAEEA

SEQ ID NO: 51135 - protein, 381 aa, Pichia angusta
MTAMDRLDHVSNQLAAKRQKKNPEGKPFRITVVGSGNWGSTIAKVVAENAKELPEEFHQIVKMWVFEEEVDGRKLTEIINTDHENVKYLPDVKLPDNIVAIPDIVDACADADIIIFNIPHQFLPKILAQLKGKVNPKARAISCLKGLEVTKDGCKLLSNYITEELGIYCGALSGANLAPEVARQKWSETTVAYRIPQDFRGEGKDVDQSVIRNLFHRPYFHVRVIDDVAGVSLSGALKNVIAMAAGFVEGLGWGDNAKSAVMRIGLVEMIKFAHMFFEDCQSTTFTHESAGVADIITTCAGGRNVRVGRYMAEHKVSGFEAEKVLLNGQSCQGLHTTREVYELLAAKNVIDEFPLFKATYQIIYEGLPMEKLPELLEASED

SEQ ID NO: 51136 - protein, 411 aa, Kluyveromyces thermotolerans
MFSISRITRTSSFTTQFRALYRFKHSARKLQSIPFSIYKKMSAADRLNQTHDILSESVQAVENPFKVTVIGSGNWGTTISKVVAENAALRPHLFVKRVDMWVFEETVDGQKLTEIINTKHQNVKYLPNIDLPENLVANPDLVSAVKDADILVFNIPHQFLPRIVSQLQGNIKKDARAISCLKGFDVSKDGVKLLSTYVTEKLGITCGALSGANLAPEVAKENWSETTVAYELPKDFKGEGKDVDHAVLKALFHRPYFHVNVIDDVAGISVAGALKNVVALGCGFVEGLGWGNNASAAIQRVGLGEIIKFGQMFFPDSRVETYYQESAGVADLITTCSGGRNVRVATHMAKTGKSAEECEKELLNGQSAQVFTHVRRSTSGWPSAVRPMNSFCSRPFTRLSTRTLLWTLCQT

SEQ ID NO: 51137 - protein, 394 aa, Lentinula edodes
MQSLLRWGIENSTPQNTNTNTNTTTTANNTANTNTTTANAPPSRRPDLNPEIIDLLLGKSDAVLMKEAMAIAVDEGNTEEDRVSALDNLEMLIEQIDNANNLTNLKMWEPLHALLTSSPDSVATQALWVIGTALQNNPSAQDAYLKLNPLPTLTSFLSPPPQSTNSNSTPPKSPKTPSKPLRSKAIYALSGLLKHNAPALLQLSVNDAHGCDGWDRLCLALQDPDITIRRKTLFLLNALLIPSPSPDPSPSPDRSPSPSLGNLHTPSQTQHSQNSQHPIHPNSHSIHLSDPSRVSTSAPTYQALLTHGIIDTLIAGLTRSLPYGGDGDTGDTKEEVDGEFKEMGVSLLNTYISLSQSHTHTQHPTTPLTPSQKTVSGNGSPLSLPPKNKNWLPS

SEQ ID NO: 51138 - protein, 317 aa, Triticum aestivum
NLLQSFPWVFFLRFPFQGRLFLGREEAILFGLNRIREEEEEEEEEEEEEEEEEEEEEMELIAKVRSPYIVEYRDSWVEKGCYVCIVIGYCEGGDMLEAIKKANGSHFPEEKLCVWLVQLLMALDYLHASHILHRDVKCSNIFLTKDQNIRLGDFGLAKVLTSDDLASSVVGTPSYMCPELLADIPYGSKSDIWSLGCCIYEMTALKHAFQAFDMQTLINQINQSVVAPLPTIYSGAFRGLIKSMLRRNPDHRRSAVDLLNHPHLQPYVLEIQSKSSPARNMFPAILPNRHEKNKTTCSDDEDNCKPQYIKSQSFKVQ

SEQ ID NO: 51139 - protein, 465 aa, Schizosaccharomyces pombe
MAPISKVFDYLVIGGGSGGLASARRAAKHGAKVALIEASGRLGGTCVNYGCVPKKIMWNIADLVAKMKTAKQNGFPNSQLGSFDWGMIKRKRDAYIGRLNGIYERNVNKDGVAYISGHASFVSPTEVAVDMNDGSGTQVFSAKYILIAVGGHPIWPSHIPGAEYGIDSDGFFELESQPKRVAIVVGAGYIAVELAGVFAALGTETHMFIRQSKFLRKFDPIISDGIMDHFQHIGINVHTNSLEFKKVEKLPSGELCIHQQDGSTFNVDTLLWAIGRAPKIQGLRLEKAGVKTLPNGIIIADTYQRTNVPTVLSLGDVCGKLELTPVAIAAGRRLSDRLFGGIKDAHLDYEEVPSVVFAHPEAGTIGLTEQEAIDKYGESQIKVYNTKFNGLNYSMVEQEDKVPTTYKLVCAGPLQKVVGPTFSWRFSAEILQGFGVAIKMGATKSDFDSCVAIHPTSAEELVTLV

SEQ ID NO: 51140 - protein, 547 aa, Cryptococcus neoformans var. grubii
MSAIIPQVQQLLGQVAQFIPPWFAALPTSVKVVIAVIGIPALVICLNVFQQLCLPRRKDLPPVVFHYIPWFGSAAYYGEDPYKFLFECRDKYGDLFTFILMGRRVTVALGPKGNNLSLGGKISQVSAEEAYTHLTTPVFGKGVVYDCPNEMLMQQKKFIKSGLTTESLQSYPPMITSECEDFFTKEVGISPQKPSATLDLLKSMSELIILTASRTLQGKEVRESLNGQFAKYYEDLDGGFTPLNFMFPNLPLPSYKRRDEAQKAMSDFYLKIMENRRKGESDHEHDMIENLQSCKYRNGVPLSDRDIAHIMIALLMAGQHTSSATSSWTLLHLADRPDVVEALYQEQKQKLGNPDGTFRDYKYEDLKELPIMDSIIRETLRMHAPIHSIYRKVLSDIPVPPSLSAPSENGQYIIPKGHYIMAAPGVSQMDPRIWQDAKVWNPARWHDEKGFAAAAMAQYSKAEQVDYGFGSVSKGTESPYQPFGAGRHRCVGEQFAYTQLSTIFTYVVRNFTLKLAVPKFPETNYRTMIVQPNNPLVTFTLRNAEVK

SEQ ID NO: 51141 - protein, 187 aa, Agrobacterium tumefaciens str. C58
MFIQTEATPNPATLKFLPGKVVLESGTVEFLNASQAQASPLAERLFTIPGVTGVYFGFDFITVTKDDAEWQHLKPAILGSIMEHFMSGRPIMGTAIAAEVSDEEGEFFEEGDETIVATIKELLDTRVRPAVAQDGGDITFRGFRDGTVFLNMKGACSGCPSSTATLKHGVQNLLRHFVPEVREVEAV

SEQ ID NO: 51142 - protein, 398 aa, Triticum aestivum
  misc_feature (130)..(130): Xaa can be any naturally occurring amino acid
  misc_feature (146)..(146): Xaa can be any naturally occurring amino acid
  misc_feature (165)..(165): Xaa can be any naturally occurring amino acid
  misc_feature (219)..(219): Xaa can be any naturally occurring amino acid
MRSTDSSSRFVQELVLYAASAALSCLVLFAGLRQLDPNRESSKKALQHKKEIAKRLGRPLISTTPYEDVIACDVINPDEIDVEFESVGGLDEVKQALYELVILPLRRPELFAYGKLLSPQKGVLLYGPPXGTGKTMLAKAIAKESXGAVFINVRISNLMSKWFGXDAQKLVSAVFSLANKLQPAIIFIDEVDSFLGQRRNTDHEALTNMKTEFMSLWDXGFTTDQNARVMVLAATNRPSELDEAILRRFTQIFEIGVPSRSERSKILEVILKGENIESNIDYDYIASLCEGFTGSDILELCKQAAFYPIREILNSEKDGTRANSPRPLRQSDLEKAFSTSRKGKKAASSAASGLQSPEWIRPSDPEDDQVQSAIFEISKLMSRIVQNSQSEPQEPSSP

SEQ ID NO: 51143 - protein, 523 aa, Vigna unguiculata
MAMASLARRKAYAVVSSSRSSVFLTSLRGFASGSDENDVVVIGGGPGGYVAAIKASQLGLKTTCIEKRGTLGGTCLNVGCIPSKALLHSSHMYHEAKHSFANHGIKLSSVEVDLAGMMAQKDKAVSNLTKGIEGLFKKNKVNYVKGYGKFVSPSEVSVDTIDGGNTVVKGKHIIIATGSDVKSLPGVTIDEKKIVSSTGALALTEIPKKLVVIGAGYIGLEMGSVWGRLGSEVTVVEFASDIVPTMDAEVRKQFQRSLEKQGMKFQLKTKVVGVDTSGDGVKLTLEPAAGGDQTILETDVVLVSAGRTPFTAGLGLDKIGVETDKIRRILVNERFTTNVSGVYAIGDVIPGPMLAHKAEEDGVACVEFIAGKVGHVDYDKVPGVVYTTPEVAYVGKTEEQVKALGVEYRVGKFPFMANSRAKAIDNAEGLVKILAEKETDKILGVHIMAPNAGELIHEAAIALQYDASSEDIARVCHAHPTMSEAVKEAAMATYDKPHSHMKSWLLLHSLLFIFVQQFTMTWR

SEQ ID NO: 51144 - protein, 376 aa, Chlamydomonas reinhardtii
MPDGGAGVHMTAALVLHDAAVEAAAAAGSGAAGAQGAGTGGGGGGGQAAEAAAALLAERDEHVRSFLDSYPEAMDSENDEFLYGRAGYLQARDGAQLLNAAIGPGTIPDEIIEGVATEMLESGREMAERLRWRRTDTPAPPLFYMWPGRERGEPYLGAAHGMMGILFMLLHCGPAILEVEENRQQLRACLTYVASHEKDAPGCSARGGHYPTKMAMSPPEPPPPGEAGGAAAKTLVHWCHGAPGAVFLWCKAHEVFGDAEYLAAARRAGEVVWQLGLLRKGHGLCHGTSGNAYALLALHRATGGGEAAVWLHRARQFAGHVSGAEGRSVFDTPDRPLSLFEGRAGVLCLLADLLADDGGSHGSRFPAFELPPPTRA

SEQ ID NO: 51145 - protein, 353 aa, Sporothrix schenckii
MGCGMSVEEKEGKARNEEIENQLKRDRMQQRNEIKMLLLGAGESGKSTILKQMKLIHEGGYSRDERESFKEIIYSNTVQSMRVILEAMESLELPLEDQRMEYHVQTIFMQPAQIEGEVLPPEVGNAIEALWKDAVVQECFKRSREYQLNDSARYYFDNIARIAAPDYMPDDQDVLRSRVKTTGITEKTFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDYEGGDDYAAACDYILNRFVNLNQHESKQIYTHFTCATDTTQIRFVMAAVNDIIIQENLRLCGLI

SEQ ID NO: 51146 - protein, 306 aa, Candida albicans SC5314
MATYSEMTFNSQHYDDSRPNYPQPFYKELIKYHTKKGDTKLAIDIGCGSGFVAFQLVNYFDSVIGTDPSSTMIEQCNSNIPPEWLRNSPKKISFMKGTAEHHPVSIKENSVDLITGAECCHWVNHKQFFDESYRVLKSNGTLAYWFYKDPVFIGYPEANKVYTNYTYNSSFDESRDEEFERYMGPYYQQPGHDYLRSLMKEIEVPTDKFYDIVRHEYISDIHGAPKENEDPYITKTPLFIKKTITMKWFLDYVKSWSAYHTWMTHHGDKYDIAEKFVAELKQKMNWNDDTEIDVIWDTVYTFARKK

SEQ ID NO: 51147 - protein, 616 aa, Physcomitrella patens subsp. patens
MCTPLNRRKNRLGEVGQDLAVEVFNKYCENGKMGAEALLRFLHEEQGESKATLEDAKHLLEANRKENSIIPKLHSLEMKLEDFISFVVNPKLNGSLNTQVHHDMTQPVSQYWIFTGHNSYLTGNQLSSDSSDVPIINALRRGVRVIELDLWPDDKGNIKVTHGNTLTDPVSFEKCLIAIKANAFVASQYPVCITLEDHLTCALQSIAAEMLLRILGPALYYPPTGEAPKEFPSPESLKGRIIVSTKPAKEYLESTAVDKKDDEKNAELMTEIRREGQENESLSDTASKLNINKENAAPEVDKAGEDSDSDDDDSKKNPEYSRLITIRQVKPMKGTSLKDRLVIEDTVKRISLAESKLEDVADQFPEILVQFTQRNILRVYPDGTRINSSNYNPVLAWNHGAQMVAQNMQGYGKELWLSHGKFRANGGCGYILKPKFLRENLPTGQIFSPSAKKNVEMVLRVKVMTSPGWKETFSKRHFDLFSAPDFFTRLLIAGVRDDIAKAKTQPVKDTWNPHWNEEFDFSLRVPELALLRVEVREDDGGTKDGFAGQTCLPISEIKDGYRCEILFDKTGAEIPGVKILFHFQKLLLHKSTCPSTLLTDSHPHHAVHPSEASTKL

SEQ ID NO: 51148 - protein, 482 aa, Hyphomonas neptunium ATCC 15444
MKRTVEKIGGTSISNTQVVLENVLIGGRKGADLYNRIFVVSAYSGMTNRLLEHKKSGEPGVFSLFAGAGNKWAWTEALASVAEAMEAKNAEMFSGEPEQAVADNFVRERIEDVRNCLIDLHRLCSYGQFRLDENLTTVKEVLSSLGEAHSAFNTALLLQKHGVNARAVDLTAWRDERDLTMEERMEDALGGIDLSSELPIVTGYASSRDGLVRQFGRGYTEVTFSRLAAFVQADEAIIHKEFHLSSADPNLVGQDRVRKIGLTNFDVADQLSNMGMEAVHPKAAKILRQAGIPLRVKNTFDPKDGGTVISADYAPENPRAEIVTGLKGVFALEVFDQDMVGEKGYDSTILDALTRHSIRIVSKCSNANTITHYIEGSRKALKRATADIETKLPGAEVSTSRVAIVSVIGADINVPGITAKALTALHEAEVPIIGLHQVSRKTDIQAVIQEDDFDKAICALHEALVEQVSVATPRAEALRPAA

SEQ ID NO: 51149 - protein, 835 aa, Oryza sativa
MASSSPLCCYLLLFVVVVVLTGSCRARDTVVPGRPLAANETLVSGGDANFVLGFFTRPGANSTYVGVWYNKVSVRTVVWVANREDPLPGDVADNPDATLSVSPTGTLAIVAGNSTVVWSVTPAAKLASPTARIMDSGNLVIADGAGGGVAWQGFDYPTDTLLPEMRLGVDYVKGRNRTLTAWKSPSDPSPGPVVMAMDTSGDPQVFIWNGAEKVWRSGPWDGVQFTGVPDTVTYSGFTFSFINNAKEVTYSFQVHNVSIISRLGLNSTGSYGLLQRSTWVEAAGTWNLYWYAPKDQCDEVSPCGANGVCDTNNLPVCSCLRGFTPKSPEAWALRDGRAGCVRSTPLDCQNGTDGFVAVEHAKVPDTERSVVDLGLSLEQCRKACLMNCSCTAYASANVSGGGRGHGAGTGCVMWTTGLTDLRVYPEFGQDLFVRLAAADLGLTSKSNKARVIIAIVVSISSVTFLSVLAGFLVWTRKKKRARKTGSSKWSGGSRSTGRRYEGSSHHDDDLELPIFDLGTIAAATDGFSINNKLGEGGFGPVYKGKLEDGQEIAVKTLSKTSVQGLDEFKNEVMLIAKLQHRNLVRLLGFSISGQERILVYEYMANKSLDYFLFARYRIIEGITRGLLYLHQDSRYRIIHRDLKASNVLLDKEMTPKISDFGMARMFGSEETEINTRKVVGTYGYMSPEYAMDGVFSVKSDVFSFGVLLLEIISGRRNRGVYSYSNHLNLLGHAWSLWNEGKSLELADETMNGSFDSDEVLKCIRVGLLCVQENPDDRPLMSQVLLMLATTDATTLPTPKQPGFAARRILMETDTSSSKPDCSIFDSATVTILEGR

SEQ ID NO: 51150 - protein, 430 aa, Acidobacteria bacterium Ellin345
MVAALGGLLFGFDTAVISGATHALTEAYSLSPSLLGVTVSSALWGTVAGSLLAGIPADRIGRRDSLRFMAVLYLVSSLGCAFAWNWPALLVFRVIGGLGIGGSSVIGPMYIAEIAPAKWRGRLVGFFQFNVVFGILLAYFSNYLVGLGCFGANEWRWKLGIPAVPAALFLIMLFGIPRSPRWLVKKQRVPEARESLQLIGEEDYEKELHDIIESIDADHAQGDSLFDRKYLFPIFLAVSIGMFNQLAGINAILYYLNDIFAQAGFNKVSSDLQAVAIGGTNLLFTMLAMSIIDYVGRKTLLLIGAVGTALCLGGVAWIFHVHQHQGYLLWLLVVYIAFFAFSQGAVIWVYISEVFPNRVRAGGQSLGSSAHWIMNAIIAGVFPALAAKSGSIPFAFFAAMTAIQFFVVLFVYPETKGITLEAMQKKLGIS

SEQ ID NO: 51151 - protein, 197 aa, Brassica napus
KRGDGLIERADCPVCLNEFEEDESLRLLPKCNHAFHIFCIDTWLRSHTNCPLCRAGIAISTPRCSGPVDVPPGGSGSRDVVDDDRGEIENDESGSKETLSSSNTDQSSDVRIEIGAVNEVNDGGGFETEADEQVRVLGECMDLNVGDEASCSKENNGHNVEPNGEETEDTEKSQSGMSMKAAGSSCFSTNKSSVFPV

SEQ ID NO: 51152 - protein, 272 aa, Juglans nigra
EDERPKVAYNQFSTEIPIISLAGIDEVHGRRTEICQKIVEACEDWGIFQVVDHGVDASLISDMTRLARDFFAMPPEEKLRFDMSGGKKGGFIVSSHLQGEAVQDWREIVTYFSYPIRTRDYSRWPDKPEGWRKVTEEYSDKLMGLACKLLEVLSEAMGLEKEALTKACVDMDQKVVVNYYPKCPQPDLTLGLKRHTDPGTITLLLQDQVGGLQATRDGGKTWITVQPVEGAFVVNLGDHGHFLSNGRFKNADHQAVVNSNYSRLSIATFQNP

SEQ ID NO: 51153 - protein, 220 aa, Thermus thermophilus HB8
MFSEIAPRYDLLNRLLSFGADLRWRRRAVDLALEKAPRRILDLATGTGDLALMLKERAPGAEVVGADFAPPMLAIARRKAEARGLEVRFLEADALALPFPDGAFDAVTIAFGFRNFADYEKALRELYRVLAPGGRLVVLEFPPPPKGAFGLVYRVYFQRVLPFLGGLISGNFGAYRYLPESVEAFPAPEALKAMMAAAGFSVRYELLTFGVAAIHVGDRP

SEQ ID NO: 51154 - protein, 586 aa, Schizosaccharomyces pombe 972h-
MRVLVAETGREDNVSVHSREVSVNGSDSGTGNDAYKLETDDEHPPATPVRGLSTRSQKRPFRPLTIQQDEDVENDTGMNTEYNDDNSSLVNTPRDSTTYAETNSPNTEKLAGRDDDRSLLNLIDRGEIDSKRQRHYVPVHCKRMPKKEITLNQKLYVSQVIGPADAPKSKTIFGKRIMQWEPSQFKESVWASEISKSGKYLATAGKDAIIRVWKVIETPERRETLLKEGPQSCGRFFTPSSIFEPEPVLECVGHNAEVLSISWSKNDFLLTSSADRTVRLWHPKSTKSLAVFRHNEIVTCVAFHPIDDRYFVSGSLDCKIQLWSILRHKILHWTELEYVVSTICFYPDGESIVVGMFYGLCAIYETKNLQYVSSWLIHHSPSRNKKCRVTGLQCASIIPNDSKSDNVVLVSTNDNAIRLYNTVTHALVLKLSDAHRVNGRVLSRLSEDNSYIISGSDTNEVVLWHIPNKVLINASRKRSVILHLPTETFKVCSERLTSTIIAPARTAVEAKESEHDRSLIAEGYNLVKPHSHRSYGTPPVHPIDIIIATNMAGMTIVLCVDYDLGNSHHGFRNSKFGHFVKRLLRT

SEQ ID NO: 51155 - protein, 357 aa, Schizosaccharomyces pombe 972h-
MTTVSITFDLLSSMQPRKWLKNQNFVGEITSLSFDDSGELCLASCTDDTLQLYNCISGKFVKSLASKKYGAHLGRFTHHSNSLIHASTKEDNTVRYLDVVTNRYLRYFPGHKQTVTSIDVSPADETFLSASLDNTIRLWDLRSPNCQGLLNVSSPVVAAFDATGLIFASVSERKYKISLYNIKSFDARPFQDIPLTFLPPHVRIANVEFSTDGKYLLLTTGNDFHYVIDAYSGSELLRVPSKVSTKTQDGNLTYYASACMSPDSKFLFTSYDNEHLCMYQLPELKQTVNSDHIVNSFTEMGLASTTPTSNSHSTENPLAIIPSSTSKNLLPETPSIVRFNPRFSQLVTAHSGVIFWT

SEQ ID NO: 51156 - protein, 693 aa, Xanthomonas campestris pv. campestris str. ATCC 33913
MPACDCDSSSQACGAATPRVHHGCCSHHFPLTPEPVCLPGLRMGRTIWLQHIDTMMIDSTRYPRLSRIQTPDDLRTFEEADLTAVADELRAYLIESVGKSGGHFAAGLGVIELTVALHYLYQTPVDQLVWDVGHQTYPHKILTGRRDQIHTVKQKDGVAPFPKREESVYDTFGVGHSSTSISAALGMAIAAQRNGDDRKVVAVIGDGAMTAGMVYEALNHAGGMDPEPNLLVILNDNRMSISEAVGGLTKMLGRASGSRTLNAIREGGKKILGDKKNNPTARFVRRWEEHWKGMFVPSTLFEEMGFHYTGPIDGHDLPSLVGALKTLKTLKGPQLLHVITTKGKGYELAEGDQIGYHAVGPFDPSKGLVAKAGAKKPTYTDVFSDWVCDMAAADPKMLVITPAMREGSGLVRFSKEYPQRYFDVAIAEQHAVTLAAGMATQGAKPVVAIYSTFLQRGYDQLVHDVAVQKLDVLFAIDRGGVVGPDGATHAGNLDLSFLRCVPHMVVMAPADEAECRQMLTTGLRYEGPAAVRYPRGTGPGTALDAALTTLPIGKAQLRHSGARIALLGFGATVDAAEAVGRELGLTVVNMRFVKPLDKAMLLELAKCHEAFVSIEDNVVAGGAGSGVSELLNAEGVLMPMLHLGLPDSFQHHASREDLLAEAGIDQAGIRAAVLKRWPQLMAKGQQALNAAAG

SEQ ID NO: 51157 - protein, 77 aa, Oryza sativa
  misc_feature (17)..(17): Xaa can be any naturally occurring amino acid
  misc_feature (33)..(33): Xaa can be any naturally occurring amino acid
MAPSVMGSWATNVAHFXGFKYSAGMPVGRRSGXSSFGNVSNGGRIRCMYVWPIEGIKKFETVSLLPPLTVEELLKQI

SEQ ID NO: 51158 - protein, 145 aa, Triticum aestivum
PRSSAPRPPPGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARF

SEQ ID NO: 51159 - protein, 303 aa, Synechococcus sp. WH 5701
MLGLGTWNAQPGEVGAAVHAALRLGYRHIDCAAIYGNEAEIGTVLSAAIDEGVVTREQLWITSKLWNNAHAPEAVEPALKKTLADLRLDYLDLYLIHWPVAFRPGVLMPESAEDLIALEELPIAATWEALEATVEQGLCRHIGVSNFGAATLGALLDQARIRPAVNQIELHPYLQQSNMLSFCEARGVHLTGYAPLGSAGRPAFIRPSGEPVLLEDPTIHAIAGHRGITPAQVLLRWALQRRTAVIPKSVSPARLCENLAAAEGDLAAEDMEAIAALDRGRRYIDGSIWVKPGGPYTLESLWA

SEQ ID NO: 51160 - protein, 197 aa, Erythrobacter sp. SD-21
MLNLPNILTLSRIVAIPLLAFLLWWPGWEAGYLMAFGLYSLMGITDYFDGYLARTSGAVSKLGIFLDPIADKIMVAAVILVLAAQGVLTGPYVGDAHVIAGLIILVREIAVSGLREFLGGLQVSVPVSRLAKWKTTFQLLALGSLILGQGLPDWHVMLGPIEANVPHTVGLVTLWAAAVMTVITGWDYLRVGLKHMD

SEQ ID NO: 51161 - protein, 277 aa, Vibrio fischeri
PPNQKWWRYNVLSQPEAMAHLFQYDSTHGRFQHKVTHDQEYLYIDLPDGSQDKVRILHQADLSLLPWHSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHSAIVD

SEQ ID NO: 51162 - protein, 299 aa, Agrobacterium tumefaciens str. C58
MITVFGSINMDLVATAKRLPKPGETVTGDTFSTAAGGKGANQALAARRAGVTVKMAGATGDDTFAAPALTLLRDAGTDLSLVKTAPGPTGTAVILIGEGGENMISVIPAANGEVSAFDATKVVGEMDAGDILMLQFEIPAAAIEAALTAAKAKRITTVINTAPLTADGPRLAGLADIVIANETEFELLIGKNGLSSGERESELKALHDRTGQTLIVTLGADGVIAMRNGKVFSASGLKIEPVDTVGAGDTFCGYLAASLDQGMDFEKALKRAAVAGSLACTRAGAQPSIPQAAEVDAAL

SEQ ID NO: 51163 - protein, 173 aa, Oryza sativa
  misc_feature (19)..(19): Xaa can be any naturally occurring amino acid
  misc_feature (27)..(27): Xaa can be any naturally occurring amino acid
  misc_feature (40)..(40): Xaa can be any naturally occurring amino acid
MAPSVMASSATTVAPFQGXKSTAGMPXARRPNSSFGNVSXGGRIRCMQVWPIEGIKKFETLSYLPPLTVEDLLKQIEYLAPFQVVPCLEFSKVGFVYRENHKSPGYYDGRYWTMWKLPMFGCTDATQVVKELEEAKKAYPDAFVRIIGFDNVRQVQLISFIAYNPGCEESGGN

SEQ ID NO: 51164 - protein, 327 aa, Francisella tularensis subsp. holarctica
MKITTRKICIAPMLDWTDRHYRYMMRLITRHTMLYTEMVTLNAILHGNKEFLLKYNPQENPVTLQLGGCVPKDFISCGKLAEELDYNEININVGCPSERVKKGNFGLSLMAEPELVADCVKAMKDNLNIPISVKCRIGYDHNDSYEELYNFVDKQVQAGIDYLCIHARKGWLSGLSPKENRTIPELKYDVVYSIKKDFPNLELGINGGITTIQEIQQHLKYVDSVMIGREAYHNPMLFKDFDNIFYNQPTTNISALEIAYKMAEYIKDQMDNDPYIKLNNITKHTLNLFNGLPNAKVYRRYLSENATKKEANVDTFLTALEVFENKL

SEQ ID NO: 51165 - protein, 365 aa, Rickettsia akari str. Hartford
MILKLGIVGLPNVGKSTLFNALTASQAADAANYPFCTIEPNSSKVLVPDERLQRLASLAGSGKIIPSYIEFVDIAGLVEGASKGEGLGNKFLSHIREVSAILHVLRCFEDEDITHVHNKVDPIYDLEVIETELILADIESVEKRLVTSEKRLKSGDKTMVEQIELLKEVYKVLANGKPARVLNEVLGSDNLKQLQLITSKPVLYICNVLEKDAAIGNECTKLVAARAKKENARSVVISSKIEAEIALLESIEEKEEFLKFIGLNKTGLSKVIKEGYNLLNLKSFFTIGPKEAHSWTFKDGTLAPAAAGIIHTDFEKGFIRAEVIGYEDYINLGSEAKAKEVGKMRLEGKEYKMQDGDIVHFRFNV

SEQ ID NO: 51166 - protein, 387 aa, Francisella tularensis subsp. holarctica
MNLHEYQAKDLLESYGLKVQKGIVAHNPNEAAQAFDQLGGKFAVVKAQVHAGGRGKAGGVKVVKSSQEAREVAESLIGKNLVTFQTDAEGQPVNSVGIFEDVYPVTRELYLGAVVDRSSRKVTFMASTEGGVDIEEVAHNSPEKILKVEVDPLVGLQPFQAREVAFKLGLEGKQINDFVKTMLGAYKAFIECDFALFEINPLAVRENGEIVCVDGKINLDSNALYRHPKLLALRDKSQENAKELKASEHELNYVALEGNIGCMVNGAGLAMATMDIIQLYGGKPANFLDVGGGATKERVIEAFKLILDDENVKAVLINIFGGIVRCDMIAEAIIEAVKEVNVTVPVVVRLEGNNAEKGAKILADSGLKLIPADGLADAADKVVKSLG

SEQ ID NO: 51167 - protein, 641 aa, Gibberella zeae PH-1
MGFWKRLTEFLFVGGGYNDQFRFTSDHSLVDPVNSVVDVFDPSTVVGGSCNTPTNRSCWAPGLDIYTDYEEVIPEGEVRKFHLVVGNHQISPDGYLVERMLFNGSYPGPTLEGNWGDTFEITIHNNLTNFNGTSVHWHGIRQLNTNWMDGVSGVTECPIPPGETMTYRWKATQYGTSWYHSHFSLQYADGLLGAIKINGPSSMNYDYDLGPVLITDHFHKTAFSQVMLEYLGRPPAPDSILMNGNGTYYCCPKGNKNCDNNCVGKSKLTSFNFEKGKKYKMSLVNTGVSTHMTFWIDNHNFSVVATDFVPITPYNTSILNIAIGQRYDIIIEANATLHDSANSKRTNFWMHARDCNNGGARSNLGIIRYDAKNQKVPWTPPPDEKHLCYGCLDELGVNLKPIVKRTVPLAANVNYQNESFKVHLVGYPDDTAESSTLHKWVLKDSSFYLDWAEPSLSLVKVAYEKDWKHPKWPKGYEPVNLEYTNGSWVYFLIEGKFKESLHNMPGHPKIYKTQAPVAHPMHIHGHDFVVLASGDKEFDASTVKLNTNNPPRRDVALLPVNGYLVVAFQMNNPGVWLMHCHIAWHASGGLALQFVESPRQIGPQFQKSGILPHYSEQCNNWAAYYTMFNKNENATQEDSGI

SEQ ID NO: 51168 - protein, 534 aa, Physcomitrella patens subsp. patens
MGATAQKDAPPTVEAVAPALSEDTSERTNSDQPIKEKSVAGGCLSVVVLGASGDLAKKKTFPAIFNLYKQGFLPDEMHIFGYARSKMTDEELREKLRGYLKPDRIDPAKDPEDVIKQFLNKITYIHGAYDADESFIQLNEEVSRHEQKRSDDVSPTRRLFYLALPPSVYPLVSKRISKHCMNQRGWTRVIVEKPFGKDLESSEALSSELGALFSEDQLYRIDHYLGKELVQNLLVMRFANRFFVPIWNRDNIASVQIVFKEDFGTQGRGGYFDEYGIIRDIIQNHLIQILCLLAMEKPISLSPEHIRDEKVKVLECIKPFNDKEVVIGQYEGYKDDQTVPNDSSTPTFASLVLHINNERWDGVPFILKAGKALDSRKAEIRVQFKDAPGDIFKCKKQGRNEFVMRLQPKEAMYMKLTVKEPGLDMRATQSELDMSYHQRYQDIVIPEAYERLILDTIRGDQQHFVRRDELRVAWEIFTPLLHRIDVGKLELIPYKEGSRGPAEADELNARVGYRRTEGYCWKPPTLQAVGNSRM

SEQ ID NO: 51169 - protein, 615 aa, Oryza sativa Japonica Group
MASISGAAAAAPSSSGASCGLRLRRDHLPRSSHFRLARPSSITDVSRSCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 51170 - protein, 398 aa, Schizosaccharomyces pombe 972h-
MAGSKWETEETNQFAIENQKLEEEWRKKRRLEKKRKRKILEEEEKAEERNIDACRLYLMGNTPELKSCNSIDDYEILEKIEEGSYGIVYRGLDKSTNTLVALKKIKFDPNGIGFPITSLREIESLSSIRHDNIVELEKVVVGKDLKDVYLVMEFMEHDLKTLLDNMPEDFLQSEVKTLMLQLLAATAFMHHHWYLHRDLKPSNLLMNNTGEIKLADFGLARPVSEPKSSLTRLVVTLWYRAPELLLGAPSYGKEIDMWSIGCIFAEMITRTPLFSGKSELDQLYKIFNLLGYPTREEWPQYFLLPYANKIKHPTVPTHSKIRTSIPNLTGNAYDLLNRLLSLNPAKRISAKEALEHPYFYESPRPKDPKFFPTFPSKAKGESKEKNVFQSFRSASPKK

SEQ ID NO: 51171 - protein, 516 aa, Gossypium hirsutum
MAYTSLLSFSVCLLVLFHGCCAQIDLVTNHHQDPPWGQPQQPQPRHQSQCQLQNLNALQPKHRFRSEAGETEFWDQNEDQFQCAGVAFLRHKIQRKGLLLPSFTSAPMLFYVEQGEGIHGAVFPGCPETYQSQSQQNIQDRPQRDQHQKLRRLKEGDVVALPAGVAHWIFNNGRSQLVLVALVDVGNDANQLDENFRKFFLAGSPQGGVVRGGQSRDRNQRQSRTQRGEREEEESQESGGNNVLSGFRDNLLAQAFGIDTRLARKLQNERDNRGAIVRMEHGFEWPEEGQRRQGREEEGEEEREPKWQRRQESQEEGSEEEEREERGRGRRRSGNGLEETFCSMRLKHRTPASSADVFNPRGGRITTVNSFNLPILQYLQLSAERGVLYNNAIYAPHWNMNAHSIVYITRGNGRIQIVSENGEAIFDEQVERGQVITVPQNHAVVKKAGRRGFEWIAFKTNANAKISQIAGRVSIMRGLPVDVLANSFGISREEAMRLKHNRQEVSVFSPRQGSQQ

SEQ ID NO: 51172 - protein, 408 aa, Sulfolobus solfataricus
MSTKSEHMITIGIIGKTNVGKSTFFAAATLKDVEIANRPFVTINPNEGIGYVKVKCAHTEFNVKCNPKNSICIEDYRFIPVKLVDVAGLIPGAHEGRGLGNKFLDDLRQADALIHVIDASGSTNEEGVPVEPGSRDPEEDIKFIESELDEWFYSIINKDWAKFARTSDLSGKDLVDALLSKLSGVSVNRSHIIETLKVTKLENLKLMQWTEQDLRVFAKTLRSVSKPMIIAANKSDLPQARNNIRRLKEKYKWAIPTSAASEMALRKAAKAGIISYIPGDSDFTILKPLNEKQKSALEYIRTSVLQVYGSTGVQQAINTAIFDALNMIVTYPVEDERKLTDKNGNVLPDAILLKKGSTPKDLANAIHTELAKGFLYAIDVKRKMRVGENYQLQNNDVIKIVSSTARPS

SEQ ID NO: 51173 - protein, 90 aa, Brassica napus
NPYSDRNFFLGEGAFRAPVPTQLGEPTNNLFGTHPKKGLRVLSKKSPWDLLIGAPLLKVKGGLVVCKGNTNPALGLPMDLFCLNLHNPAV

SEQ ID NO: 51174 - protein, 433 aa, Acidobacteria bacterium Ellin345
MFDITLVHAREILDSRGNPTVEAEVTLSGGAVGRAAVPSGASTGEHEAVELRDGDNARYLGKGVLKAVENVEGEIAQALGGMDASQQRDIDMRMLDLDGTENKGRLGANAILAVSMASARAVANQLDIPLYRYLGGVNGNILPVPMMNILNGGAHADNNVDFQEFMAMPVGAESFSEALRWGAEVFHTLKGVLKKRGYNTAVGDEGGFAPSLKSNVEAIEVILEAIQQAGYTPGEQIAIALDPAASEFFKDGKYIFKKSDKSEKTSEQMVRWWSDWANKYPIVSIEDGLAEDDWEGWKLLTDELGDKIQLVGDDLFVTNPERLARGIDNGVANSILIKVNQIGTLSETLDAIEMARRNGYTAVISHRSGETEDTFIADLAVATGAGQIKTGSASRTDRVAKYNQLLRIEEQLGAGARFLGIGALNYDGDLSAE

SEQ ID NO: 51175 - protein, 514 aa, Arabidopsis thaliana
MGEIMNVDFVNCLILILLCLLSILCYSFFFKKPKDGFNLPPSPPSLPIIGHLHHLLSLFMHRSLQKLSSKYGPLLYLHVFNVPILLVSSPSIAYEIFRAQDVNVSTRDFPTNEGSLFLGSFSFITAPYGEYWKFMKKLIVTKLLGPQALERSQRIRANEVERFYSNLLDKAMKKESVEIADEAMKLVNNIICKMIMGRTCSEENGEAERIRGLVTKSDALLKKFLLAAILRKPLKKIGITLFKKVFMDISLKFDEVLEKILVENEERLEENQQGTDIMDKLLEVYGDKTSEYKITRDHIKSLFVDLFFAGTDTATHTIEWTMAEIMNNSLILERLREEIDSVVGKTRLIQETDLPNLLYLQATVKEGLRLHPTIPLVLRTFQDGCTIGGFSIPKKTKLVVNGYAIMRDPDNWEDPLEFKPERFLASSRSSQKDAIKEEVLKYLSFGSGRRGCPGVNLAYVSVETAIGVMVQCFDWKIDGHKINMNEVAGKGTLSMAHPLKCTLVPRSVTPLTSK

SEQ ID NO: 51176 - protein, 78 aa, Erythrobacter sp. SD-21
MSDTADRVQKIVVEHLGVEADKVTQEASFIDDLGADSLDIVELVMAFEEEFGVEIPDDAAEKITTVGDATKYIEEHKG

SEQ ID NO: 51177 - protein, 498 aa, Arabidopsis thaliana
MNVDFQNCLILILLCLLSFLCYSFFFKKPKDGFNLPPSPPSLPIIGHLHHLLSLFMHRSLQKLSSKYGPLLYLHVFNVPILLVSSPSIAYEIFRTQDVNVSSRDFPTNEGSLLFGSFGFGTAPSSGLKHSRGHKKSVQRSYYLNLLDKAVKKESVEIAEEAMKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTWTHAIQWIMAEIINNSYILERLREEIDSVVGKTRLIQETDLPNLPCLQATVKEGLRLHPPVPLVLRTFKEGCTIGGFYVPEKTTLVVNGYAMMRDPEYWEDPQEFKPERFLASSRSSQNDEIRDELLKYLPFGNGRRACPGANLAYISVGTAIGVMVQCFDWEIKGDKINMDEAPGKITLTMAHPLNCTLVPRTLIPVTSTVQIPSS

SEQ ID NO: 51178 - protein, 193 aa, Glycine max
MDDSHNRKRLRHHSPKHPRLCSNSSDTHPLDSPQFQLSRVDPDLLNMLNDAENVTERDPTMQGLDSVIKSFEEEILSPLPNPNLASEAEVFNPNLGYLLEASDDELGLPPAVAPGEDATNPQTLDSGRVGSDGVDLTGFLGFEDDIVNCGGFGLTGYDDVEGDGGGYVTIDGLFDYAEPGADILWRSESLQAM

SEQ ID NO: 51179 - protein, 559 aa, Arabidopsis thaliana
MASRRILSSLLRSSSSRSTSKSSLIGSRNPRLLSPGPAHGAAPCGTLLGRVAEYSTSSPANSAAPSSAPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKESAA

SEQ ID NO: 51180 - protein, 486 aa, Pseudomonas sp. KL28
MRQIENFIAGEFVASASGKRFDKHSPLDNRIICSVSEAGRGEVDAAVRAARSALQGEWGGLTTEQRIELLYGVANEITRRFDDFVEAEMSDTGQPEHVMKHVFIPRGAANFKVFADVIKNVASESFQMDTPDGRGALNYSIRRPKGVIGVVCPWNAPFMLMTWKVGPALACGNTVVVKPSEESPQTAALLGEVMNAVGIPKGVYNVVHGFGPDSAGEFVTRHPQVDAITFTGETRTGTAIMKAASEGMRDVSFELGGKNAGIVFADADFEAAVESFSRSVFLNTGQVCLGTERVYVERPIFERFVQALKVKAEAVKYGRPDDHQANYGPLISQEHKQKVLSYYRKAVEEGATLVTGGGVPQMPGELAEGAWVQPTIWTGLPETAAVVQEEIFGPCCHISPFDSEDEVVEKANATDYGLSTTIWTSNLARAHRMAGRIDVGITWINSWFLRDLRTPFGGSKQSGIGREGGVHSLEFYTETRNVCVKL

SEQ ID NO: 51181 - protein, 454 aa, Arabidopsis thaliana
MSYLPKSQGAAAKKCGTMVMLGVLQLPCRLHHSLFYSSSQIASSRPQGVAKVVLKKGKTQLFKDGSPMVYSGAVDRIIGKPPPQTGDVVIVADGTENPIGWGLYNSVSMFCVRLMQLQHESTRDPSCALNIEKLLQTRIAEAVQLRKSLALPSANTNAYRLVNSEGDRLSGLIVDVFGDIAVVASSAAWLEKYRIEVESCLRSIDGINHINWRPSLDVLKEDGFDISSLKQTQSSTLPQRSMVVENGISYAISLEGQKTGFYTDQRENRHFISTISAGKRVLDLCCYSGGFALNAARGGATSVIGIDSSLPALELARENVILNNMDPEKVVFFKQDSTEFMKGALSREETWDIVILDPPKLAPRKKVLHNASGMYRNLNSLAMRLTRSGGLMMTCSCSGAMTQSGKFLGILQSAAAMSGRKITVVREAGAASDHPLDPSYPQGQYLSNLLLRVL

SEQ ID NO: 51182 - protein, 427 aa, Hordeum vulgare
MANKHLSLSLFLVLLGLSASLASGQVLFQGFNWESWKHNGGWYNFLMGKVDDIAAAGITHVWLPPASQSVAEQGYMPGRLYDLDASKYGNKAQLKSLIGALHGKGVKAIADIVINHRTAEHKDGRGIYCIFEGDTPDARLDWGPHMICRDDRPYADGTGNPDTGADFGAAPDIDHLNLRVQKELVEWLNWLKADIGFDGWRFDFAKGYSADVAKIYIDRSEPSFAVAEIWTSLAYGGDGKPNLNQDQHRQELVNWVDKVGGKGPATTFDFTTKGILNVAVEGELWRLRGTDGKAPGMIGWWPAKAVTFVDNHDTGSTQHMWPFPSDRVMQGYAYILTHPGTPCIFYDHFFDWGLKEEIDRLVSVRTRHGIHNESKLQIIEADADLYLAEIDGKVIVKLGPRYDVGNLIPGGFKVAAHGNDYAVWQKI

SEQ ID NO: 51183 - protein, 225 aa, marine gamma proteobacterium HTCC2143
MSDYLIAPSILSADFARLGEEVDAVLNAGADIIHFDVMDNHYVPNLTIGPMVCKALRDYGVTAPIDVHLMVSPVDALIADFADAGASYITFHPDATTHLDRSLAMIRDAGCKAGLVLNPAMGVESLKYVMDKLDMILLMSVNPGFGGQAFIPGTLDKLREVRQLIDASGFDIRLEVDGGVTADNIRDIAEAGADTFVAGSAIYNKPDYKEAINAMRDQLALTNNG

SEQ ID NO: 51184 - protein, 188 aa, Oryza sativa Japonica Group
MIIHLRTGGMYGRVEKEHLTGSVLVQKDRSRMMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSTQ

SEQ ID NO: 51185 - protein, 377 aa, Zea mays
MAPRGGREEASSGSEDEEEEAGFSRSYFLAKEKEPSSVKKRARAAAGKLSDLNLVDEQVLRASLAQIPPKHKEEVESLTRSYKDQYRNWLFELRCGFGLLMYGFGSKKQLLEDFASTTLTNFTVVVINGYLPAVNLKQVIATIAEMFWDQTKAKRRKRAGTRSQLSQQFPSQSTEGIISFLMRQTSDDVDDHVCLLIHNIDGPALRDTESQQCLAQISCCPQIRVVASIDHVNAPLLWDKKMVHKQFKWSWYHVPTFAPYKVEGVFYPLILASGGHAQTTKTALVVLQSLTPNAQSVFRVLAEYQLANEKEEGMPVSSLYTKCRERFLVSSQVTLNAHLTEFKDHDLVKVRKHSDGQDCLRIPLVSDALEKLLQELA

SEQ ID NO: 51186 - protein, 570 aa, Shewanella sp. ANA-3
MIKTIKSICTLVTVATAMSSSGVLAMDRITGKAFATRSEVYATHGMAATSQPLATQVAIDVLKQGGSAVDAAIAANAMLGLVEPTGAGVGGDLFAIVWSAKDKKLYGLNASGRSPKSLTLEKLKSLGLDYLPPFGPLPVSVPGAVDGWYELHDKFGKLPMADNLAPAIRYAREGFPVSELIAYYLNGSGKKLGQFPGFKETYMPNGKMPAVGEIFKNPALANTYEKIAKGGRDAFYKGDIAKSIDKYMKAQGGYLSYEDLASHTSDWVEPVSVNYRGYDVWELPPNGQGIAALQILKTMEPFDVAAMGFNSPEYVHLFVEAKKLAFADRAKFYADMAFNKVPVKELISQQYNYDRAKLIDLNKAAKSVDAGNPALQHGDTVYLTTADKDGNMVSLIQSNYRGMGSGMTPPDLGFVLQDRGQMFDLTEGRFNTYAPGKRPFHTIIPAFVTKDGKPWLSFGVMGGATQPQMHAQIIVNLIDFKMNLQEAGDAPRILHTGSTEPTGEVMNDGGYVSLESGFPVETRRELIKKGHVLRDGLGDFGGYQAIGFNAETGVYRGASESRKDGYAAGY

SEQ ID NO: 51187 - protein, 520 aa, Pisum sativum
MATKLLALSLSFCFLLLGGCFALREQPEQNECQLERLNALEPDNRIESEGGLIETWNPNNKQFRCAGVALSRATLQHNALRRPYYSNAPQEIFIQQGNGYFGMVFPGCPETFEEPQESEQGEGRRYRDRHQKVNRFREGDIIAVPTGIVFWMYNDQDTPVIAVSLTDIRSSNNQLDQMPRRFYLAGNHEQEFLRYQHQQGGKQEQENEGNNIFSGFKRDFLEDAFNVNRHIVDRLQGRNEDEEKGAIVKVKGGLSIISPPEKQARHQRGSRQEEDEDEDEERQPRHQRGSRQEEEEDEDEERQPRHQRRRGEEEEEDKKERRGSQKGKSRRQGDNGLEETVCTAKLRLNIGPSSSPDIYNPEAGRIKTVTSLDLPVLRWLKLSAEHGSLHKNAMFVPHYNLNANSIIYALKGRARLQVVNCNGNTVFDGELEAGRALTVPQNYAVAAKSLSDRFSYVAFKTNDRAGIARLAGTSSVINNLPLDVVAATFNLQRNEARQLKSNNPFKFLVPARQSENRASA

SEQ ID NO: 51188 - protein, 496 aa, Streptomyces avermitilis MA-4680
MADPKGFLTTPREEWPRRPVEERVRDWDEVYVPGALLPIISRQADRCMDCGVPFCHEACPLGNLIPEWNDLVSREDWRAASDRLHATNNFPEFTGRLCPAPCEAGCVLAINQPAVTIKNVEVAIADRAWADGFTPPCPPERLSGRTVAVVGSGPTGLAAAQQLTRAGHTVAVFERADRIGGLLRYGIPAFKMEKRHLNQRLEQMRDEGTKFRTSTAIGRDIGAEELRARYDAVVLAVGATAWRELDVPGRELAGIHQAMEYLPLADRVCEGDLEVSPLSAAGKHVIIVGGGDTGADCLGTAVREGAASVTQLDIYPLPEAERDEDIEPWPVYPKIYRMSPAHEEARDLKTAPAADADARLFAASTLRFAGDAAGHVRALHLVEVDARRRPLPGSGRTLPADLVLLALGFSGPDRDDGLVDQLGLALDPRGTITRDADFATNVPGVFAAGDAARGQSLIVWAIAEGRAVAAAVDRRLTGAASKLPAPIGPYDRPMRA

SEQ ID NO: 51189 - protein, 316 aa, Synechococcus sp. WH 7805
MAIAPNITTLVGRTPMVRLNRLPQAWGCTADIVAKLESFNPTASVKDRIAGAMVEAAENDGTIAAERTVLVEPTSGNTGIALAMVAAARGYRLILTMPDTMSTERRAMLRAYGAELQLTPGEQGMQGAIERARELVQEIPGAYLLQQFDNPANPAVHAASTAEEIWADTDGALDGLVAGVGTGGTITGCARVLKSRLPKLRVVAVEPAASPVLGGGVAGPHRLQGIGAGFIPPVLDMDLIDEVIAVSDDEAMEVGRRLAREEGLLCGVSSGAVVAAALQIGQRPVMEGRRIVVILASFGERYLSTPMFSAAGDPDA

SEQ ID NO: 51190 - protein, 484 aa, Vicia faba
MSKPFLSLLSLSLLLFTSTCLATSSEFDRLNQCRLDNINALEPDHRVESEAGLTETWNPNHPELRCAGVSLIRRTIDPNGLHLPSYSPSPQLIYIIQGKGVIGLTLPGCPQTYQEPRSSQSRQGSRQQQPDSHQKIRRFRKGDIIAIPSGIPYWTYNNGDEPLVAISLLDTSNIANQLDSTPRVFYLVGNPEVEFPETQEEQQERHQQKHSLPVGRRGGQHQQEEESEEQKDGNSVLSGFSSEFLAHTFNTEEDTAKRLRSPRDKRNQIVRVEGGLRIINPEGQQEEEEEEEEEKQRSEQGRNGLEETICSLKIRENIAQPARADLYNPRAGSISTANSLTLPILRYLRLSAEYVRLYRNGIYAPHWNINANSLLYVIRGEGRVRIVNSQGNAVFDNKVTKGQLVVVPQNFVVAEQAGEEEGLEYLVFKTNDRAAVSHVQQVFRATPADVLANAFGLRQRQVTELKLSGNRGPLVHPQSQSQSN

SEQ ID NO: 51191 - protein, 94 aa, Zea mays
MTSWGFPCRKALSKIAGNTLQMELVKWQLNIPAGFKHMVSNNLQTWVIEVTGAAGTVYATQTYQLHVDLPEHYPMEAPHVILLNPVPMHPHIYS

SEQ ID NO: 51192 - protein, 417 aa, Synechococcus sp. WH 7805
MDNGLSTYLVAFGGLLLVSVLLDDLAARVRVPGILMVLLLGLLINNQVDVSSTRELTLLSLDHAQQITQSSLVLVLFFGGLTTNWSEVRGVIRPAARLATIGVLITAALITAVGIGFDLARGGAALTQIVPRNLFIGAMVASTDASAVLALLRPLQGRLPQPLMDLIECESGFNDPMAVVLAGLALALVGGEGVGAGVLVTDLVRQFLLGILIGFLGGSLTVQLLGTRMGLNQASMLPVVSLALLMVLSGGTSLLGGSPLLAAYVAGLVLGNSDSLDQAVLEKAHSSYAKMAELLLFLCMGLVVAPQDVVYAAGMALLLFLVMQLVRLVMVHLLLWRTPFSPGERIFVCWAGLRGAVPIALAINAWSSGVSWGVLMPPLALAVVLYGLFIQGFALVPLARRMNLTLPDPGADPSSAA

SEQ ID NO: 51193 - protein, 677 aa, Kluyveromyces lactis NRRL Y-1140
MSDSTDKDRHNKNSSRGIVNTDIEDDNSPSPLDTTDKKGAPELQKPGNPSLFKESALKNSDQLQFRNSFNIPNAVGGTNGIVIPPNVQPLDQQRIPPSYTDHLQVKDTYLTGRTLLYFTSIFVSLGVFLFGYDQGVMSGIITGPYFKTYFNNPTAATIGTMVSILEIGALVSSLLVSNIGEKFGRRFTIKYGSLIFILGGLVQTFSWEMGHMIFGRIISGIGVGLLSTIVPIYQSEISPPHNRGKLACIEFTGNIVGYASSVWVDYACSYIESDTSWRLPLFIQCVMGLLLFLGSFVIVETPRWLLNHDHDIEGLVVIADLHSDGDVLHSKAHEEYKLIKETVLISRLEGEKKSLRFAFKRYRTRMLIAMSSQMFAQLNGINVISYYAPLVFEQAGWVGREALLMTGINSIIYILSTILPWKLVDKWGRKPILLSGALVMGTSLLAIAMSLWANVAATPRLVVVFVIIFNAFFGYSWGPIPWLYPVEIAPAMARSAMASASTATNWLFNWLVGIMTPILQEKIHWRMYLIHTVSCYLSFWCVLKVYPETAGLRLEDMDSVFDDRSSTFSFQSGTSAEIEQQSHLVSGGGEVAPSTRSRKSVYSNAQSMFNKDEIQPPTLTQVLQWKEERTQTKPLKKFIRRGSETVCLIYNKVRNLRSTNDTNQIEYGAVSNNQPPN

SEQ ID NO: 51194 - protein, 517 aa, Pisum sativum
MAKLLALSLSFCFLLLGGCFALREQPQQNECQLERLDALEPDNRIESEGGLIETWNPNNKQFRCAGVALSRATLQRNALRRPYYSNAPQEIFIQQGNGYFGMVFPGCPETFEEPQESEQGEGRRYRDRHQKVNRFREGDIIAVPTGIVFWMYNDQDTPVIAVSLTDIRSSNNQLDQMPRRFYLAGNHEQEFLQYQHQQGGKQEQENEGNNIFSGFKRDYLEDAFNVNRHIVDRLQGRNEDEEKGAIVKVKGGLSIISPPEKQARHQRGSRQEEDEDEEKQPRHQRGSRQEEEEDEDEERQPRHQRRRGEEEEEDKKERGGSQKGKSRRQGDNGLEETVCTAKLRLNIGPSSSPDIYNPEAGRIKTVTSLDLPVLRWLKLSAEHGSLHKNAMFVPHYNLNANSIIYALKGRARLQVVNCNGNTVFDGELEAGRALTVPQNYAVAAKSLSDRFSYVAFKTNDRAGIARLAGTSSVINNLPLDVVAATFNLQRNEARQLKSNNPFKFLVPARESENRASA

SEQ ID NO: 51195 - protein, 314 aa, Streptomyces avermitilis MA-4680
MNAPGAGALLVVGDVVTDVVARHRGPLASGTDTAAAIRTVPGGAGANVACWAAHWGWADVRLLGRVGADGAAWHERELTASGVRPRLVVDPDVPTGTVICLVDTGASAERTFLTDSGASLRLAPGDWSNALLDGVVRLHLSGYLLFSEQSRALVAAALESARARGVPVSLDPASAGFLAELGVDRFLALIEGVDVLLPSRDEACLLTGLPDPADAAAKLSRHVPLVVAKQGAEGALVAEAGAVRARVPATPATPRDTTGAGDAFTGAFLAALLVGVEPAQAAAEGCRAGAAAVAGVGGRPPSGTRQNRGAVKLD

SEQ ID NO: 51196 - protein, 228 aa, Staphylococcus epidermidis ATCC 12228
MPKLILCRHGQSEWNAKNLFTGWADVKLSKQGIEEAQSAGKKIYDNQIEIDIAFTSLLTRALETTQYILAGSDQQWIPVYKSWRLNERHYGGLQGLNKDDARKKWGEDQVHQWRRSYDVRPPRESEEQREAYLKNRRYQHIDHRMMPYCESLKDTLERVVPFWTDHISQHLLDDKTVLVSAHGNSIRALIKYLEGLSEEDIVGYEIKTGAPLVYELTDDLVVKDKYYL

SEQ ID NO: 51197 - protein, 295 aa, Bacillus halodurans C-125
MRSIKVEHYEAFSTVPSKGNPAGIVLDGKGLTDSDRQKIAKEVGFNETAFPLPSERADVNIRFFTPGHEINLCGHATMATIYALKTKGLLPDRDEITIETKAGILPIRLSIDVDRSMMITMKQAAPQLRAFSGSRSELAASLALEEKDLHEELPVVYGSTGTWTLLIPIKKLDAFKRMQPNNQHFPHILQEMPRASVHPFCLETYDQEADMHARHFSSPYSGTVEDPVTGTASGVMGAYYHKYIESSPSLQLIVEQGHEIGKDGRIAVTVTEQTDDVMIEISGNAVLIREFEVRI

SEQ ID NO: 51198 - protein, 259 aa, Brassica napus
  misc_feature (150)..(150): Xaa can be any naturally occurring amino acid
  misc_feature (238)..(238): Xaa can be any naturally occurring amino acid
  misc_feature (253)..(253): Xaa can be any naturally occurring amino acid
MEPMTPISCPTTPRWNQDRPFLTGRFHQETRASSRFDDSKRFTPDSSSNSGVDQAIGCYDTPVQELIVIDDLLSAMVGIEGRYISIKRFHGKEESIAFQVDPSMDLALQELAKRIFPLCECFLLIDQFVESSSQFKNGLVTHAFAAALRXALLLDYQAMVAQLEHQFRLGRLSLQGLLFYCQPMMGSMRALAAVIHQASAKNFVGSAVLNLLQSQAKAMAGDNSVRSLLEKMTECASXAYLSILERWVYEGIXDDPYGE

SEQ ID NO: 51199 - protein, 383 aa, Crocosphaera watsonii WH 8501
MIMAMAKGQPALLVLADGTTFEGLSFGAKGTTVGEVVFNTGMTGYQEVLTDPSYCGQIVTFTYPELGNTGVNPDDEESEKPQVKGVIARNITYRPSNWRSTESLPDYLIRHNIIGIYGIDTRALTRKIRSVGAINGIISTETLDKGELLRQVQSAPSMAGLNLVKEVTTREIYEWSTPTDSHWNFNTNNGETSQEGLTVVAIDFGVKRNILRRLASYGCKIIVVPADTPPEDILKYNPDGIFLSNGPGDPSAVTEGVSTVKALIEQGKPTFGICMGHQILGLSLGAETFKLKFGHRGLNQPCGLKEKVEITSQNHGFAVTEKSLDAEVEITHLNLNDRTVAGLSHKNLPFFSVQYHPEASPGPHDADYLFEKFVNLMKENKGQ

SEQ ID NO: 51200 - protein, 294 aa, Agrobacterium tumefaciens str. C58
MTSSESEIQARLLAQALPFMQKYENKTIVVKYGGHAMGDSTLGKAFAEDIALLKQSGINPIVVHGGGPQIGAMLSKMGIESKFEGGLRVTDAKTVEIVEMVLAGSINKEIVALINQTGEWAIGLCGKDGNMVFAEKAKKTVIDPDSNIERVLDLGFVGEVVEVDRTLLDLLAKSEMIPVIAPVAPGRDGATYNINADTFAGAIAGALHATRLLFLTDVPGVLDKNKELIKELTVSEARALIKDGTISGGMIPKVETCIDAIKAGVQGVVILNGKTPHSVLLEIFTEGAGTLIVP

SEQ ID NO: 51201 - protein, 390 aa, Rubrobacter xylanophilus DSM 9941
MRAVVYKGPFEVAVENVEDPKIQDPNDVVVRITSTCICGSDLHMYEGRTAAEPGIVFGHENLGIVEEVGPGVVSLRQGDRVVMPFNVACGFCKNCQRGYTGFCLTVNQGFAGGAYGYVAMGPYTGGQAEYLRVPFADFNCLKLPEGDEHEADFALLADIFPTGYHGTELADVQPGETVAVFGAGPVGLMAAYSAMIRGAERVFVVDRVKERLDKAEEIGCIPVNFDEVDPVEYIKEQTPGNRLSTLSVDNDANRGADKGIDAVGYQAHVRGGEREEPAIVLNTLIECVRPTGALGVPGLYVPSDPGAPDDASKKGQLLVSIGRMFEKGLRMGTGQCNVKRYNAYLRDLIIAGRARPSFVVSHEVPLDQAPEAYEKFDKRIEGYTKVILKP

SEQ ID NO: 51202 - protein, 83 aa, Glycine max
QRTRFKAIVVIGDSEGHIGLGIKTSMEVATAIRAAIIIAMLSVVPIRRGCWGTNLGEPHSLPTKESGKCGSVTVRLIPAPRGT

SEQ ID NO: 51203 - protein, 474 aa, Magnaporthe grisea 70-15
MARSRAKRRTHAGAKNPNQQKGPINTGNASIRDPKSMVIRIGAGEVGSSVSQLATDVRRVMEPGTASRLKERRANKLRDYLVMCGPLGVTHLLLFSRSESGNVNLRVALTPRGPTLHFRVEKYSLTKDVQKSQRRPKGQGKEFVTSPLLVMNNFSSSSADAPSKTPKHLESLTTTVFQSLFAPINPQKTSLKSIRRVLLMNREQSKEMDGSFIIDFRHYAITTKPTGISKPLKRLNAAEKLLSGKTGKKGGLPNLNKLQDIADYMIGGEDGSGYMTDGGTSGSEAETDAEVEVLEPTSRKVLNAKARAAMREAENGDEGSQAGTEQQNVEKRAVKLAELGPRMRLRLLKVEEGVCAGKVMWHEYINKSKEEIKAMEKKWEQKQREKEARKKVQKENVERKRKEKEEQKKNSKKSGENADGDDDDEDEMDVDYDSDDYEFDSEGMAGDAETLVNEKAEEDGEWEDEEEEIAAGAG

SEQ ID NO: 51204 - protein, 217 aa, Agrobacterium tumefaciens str. C58
MSETGTATEKPLFGRPWIFIRGVPAMKFLPPEGPPEIAFAGRSNVGKSSLINALVGHKGLARTSNTPGRTQELNYFVPEGYSGEPGDLPPMALVDMPGYGYAQAPKDHVDAWTKLVFDYLRGRATLKRVYVLIDSRHGIKKNDEEVLSLLDKAAVSYQVVLTKTDKIKDVGVPRLIGETLEKIRKRPAAYPEVLATSSEKSFGLDDLRAEIVRTVLL

SEQ ID NO: 51205 - protein, 360 aa, Mycobacterium leprae TN
MSGQQTTTHQPWPGVIAAYRDRLPVGDDWTPVTLLEGGTPLIAAPRLSEQTGCTIHLKVEGLNPTGSFKDRGMTMAVTDALARGQRAVLCASTGNTSASAAAYAARAGITCAVLIPQGKIAMGKLAQAVMHGAKIIQIDGNFDDCLELARKMAADFPMISLVNSVNPVRIEGQKTAVFEIVDALGTAPHVHALPVGNAGNITAYWKGYTEYHADGLIDRLPRMLGTQAAGAAPLVLGEPVSHPETIATAIRIGSPASWTSAVEAQQQSKGRFLAATDEEILAAYHLVARAEGVFVEPASAASIAGLLKAIDGGWVARGSTVVCTITGNGLKDPDTALKDMPSVSPVPVDAVAVVEQLGLV

SEQ ID NO: 51206 - protein, 465 aa, Desulfotalea psychrophila LSv54
MNRRSIMTQEAMKKVIAQNKKNCWHHLTQHSAYDKDGAAPMVVVEGKGMRIKDANGNEFLDAVSGGVWTVNVGYGRESIANAVRDQLVKLCYFAGSAGSVPGAQFAEALLDKMPGMDRVYYSNSGSEANEKCFKIIRQLAHLEGDGKKNKIIYRDRDYHGTTIGALSSTGQFERKAQYGPFAPGFVELTNCCCYRCPFGKKYGECNIECAHALEDLIQAEGPETVGGIILEPITAGGGVIVPVPEYFPIIREICDRHGVLLHIDEVVCGLGRTGKWFGYQHFDVVPDMVTMAKGVASGYAGISCTTTTEAVFDRFKADPSDKMHYFRDISTFGGCTAGPAAALENMAIIIRENLLDNVVKMGDYFSDRLFELKDKYEIIGDVRGKGLFQGLELVKDRTTKEPVDESVAAGVAGHCAAKSRVIIGRTNRSFEKHNNTLAFSPALISSKTEIDEVINALDLAFADQK

SEQ ID NO: 51207 - protein, 339 aa, Oryza sativa Indica Group
MDHEADAYRTDLMTITRYVLNEQSRNPEARGDLTILLSHIVLGCKFVASAVNKAGLAKLIGLAGETNVQGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQAK

SEQ ID NO: 51208 - protein, 531 aa, Rubrobacter xylanophilus DSM 9941
MSESIRPSGTYRTLAEQREVLTPAEERFERARQTIGLFLGPIVFLVMYLAPLPLEPNQQTLAAILSFTIVYWLSEAIPIPATAVLALALCVVLNVPGVGVNAEDSPGDIVYGAFGSDTIFLFIGAFIIAQAMITHGLDRRFAFRILSLPGVSRSTYGVIVAFGFIAAAISAFISNTATAAMLLPIGLGMMGALGGFVKEQSGTERDISRLRFGTALMLMISYGAGVGGLLTPIGTPPNLIGIGFIEEETDTTITFFSWVVAAFPVCLLMFIALCVILILLNRPEVRRLSGAEEYVAEQRRSLGPLSRGERNTLIAFATAVFLWMLPGFVALVLGEESRLYSLILSRLDEGTVAILAAALLFVLPVDWSERRFTLNWNEAVRIDWGTIVLFGSGIVLGTLLSDTGLAEVMGTGIAEALGFSSLLAISAVSALIAILISETTSNTASATIVVPIVIPIAAAAGVNPVIPALCAVFGASFGFMMPVSTPQNAVVYGSGLIPITKMVRSGIAFDIIGLILIVLLIPVMARLVGFV

SEQ ID NO: 51209 - protein, 481 aa, Aspergillus oryzae
MSANGTDSKGVIPLIINNESLVTETVFDVHNPATGEVIDRCASASVDDVNRAVEAAKAAFPAWSKTKPYDRRDILMRAADIMLSRREELIKYQMEETGAGRMFVEKTFELGAGFIKDFAARIPSIEGSVPSVSEEGECAMVFKEPYGVVLGIAPWNAPYILGTRAIALPLAAGNTAILKGSELSPKCFWAIGDIFREAGLPAGCLNVVYHRPSDAAPVTTALIAHPAVRKISFTGSTQVGSIIASTAGKYVKPVVLELGGKASAIVLDDANLERAAMCCSLGAFMHSGQICMSTERIIVQQSVADRFRTMLADASEKVFGKHTPAPVLVASPAVKKNKQLVSDALSKGAELVYGERNDSEASGNSLRPVIVGNVTKDMDLYSAESFGPTVSLMVVDTEEDAVALANDTEYGLTSAVFTDNLFRGLRVAKQIESGAVHINSLTVHDEPVLPHGGWKSSGYGRFGGPAAYDEWLQTKTVTWVQ

SEQ ID NO: 51210 - protein, 465 aa, Desulfotalea psychrophila LSv54
MNRRSIMTQEAMKKVIAQNKKNCWHHLTQHSAYDKDGAAPMVVVEGKGMRIKDANGNEFLDAVSGGVWTVNVGYGRESIANAVRDQLVKLCYFAGSAGSIPGAQFAEALLDKMPGMGRVYYSNSGSEANEKCFKIIRQLAHLEGDGTKNKIIYRDRDYHGTTIGALSATGQFERKAQYGPFAPGFVELTNCCCYRCPFGKKYGECNIECAHALEDLIQAEGPETVGGIILEPITAGGGVIVPVPEYFPIIREICDRHGVLLQIDEVVCGLGRTGKWFGYQHFDVVPDMVTMAKGVASGYAGISCTTTTEAVFDRFKADPSDKMHYFRDISTFGGCTAGPAAALENMAIIVRENLLDNVVKMGDYFQDRLFELKDKYEVIGDVRGKGLFQGLELVKDRTTKEPVDESVAAGVAGHCAAKSRVIIGRTNRSFEKHNNTLAFSPALISSKTEIDEVINALDLAFADQK

SEQ ID NO: 51211 - protein, 359 aa, Pediococcus pentosaceus ATCC 25745
MADRYLILEDGSVFKGKAFGSRATTFGEVVFTTVMTGYQQVITNQIYHNQIIVFSEPTIGAVGIDRASYESVDPTCKGVIVRDVAAVSINRRRRLSLDEYLKRQNIPGISGIDTRALIKKLRSTGTIKGSIIDPVKDLEHAFDQLRAIVLTNQQVNQVSTPKAFPNPGNGKNVVVVDLGLKYGILRQLSQRDCNVTVLGYSATADSIFSLDPDGVIISTGPGNPRDLPPEVIEMIQIVERNIPLFAIGLGHEAFAIANGCEIMELSSEHHGSNHPILSVITDEIMYASHGQGFTVDPNSVDRNDLIVTHYDLIDHSVQGLRHRDFPAFSVQFFPDSSPGPTEATELFDEFMEMMTRGGR

SEQ ID NO: 51212 - protein, 505 aa, Desulfotalea psychrophila LSv54
MAAQFWERILMDKKAAVTERAELKKSIKPVQAWALALGAILGWGAFVLPGLRFLPQAGPLASCIGFVLGGVMLFSVAISYGNMVSKYKVTGGAFAFSFVGFGPTVAFICGWALVLGYICIIALNATAVSLLTRFVFPGVFEVGMLYSIVGWDVYAGEIAMLVGILCLCGFLNFRGADLVGKIQVFLAFALCASVFIVFGGSVSHETAAVSNLSPLFADNKSPLASIMAIVAIAPWLYVGFDTIPQAAEEFDFPHKRAEKLMLSAIGWGIVLYAMVTIAVACIMPYKELLAMNSPWATGTVANMALGRVGSVILATAVLAAIFTGINGFFIASSRLLFAMGRATILPSWFADIHPKYQTPHKAILFVLAIAVTAPFFGREVLNWVVDMSAVGTVIAYLISCLSAYKVMKHAQNKRGVMHAVLGSISSVVCILLLTVPGSPGAIGMQSWVALCLWVILGAWFYNARMGDFKALTTEEQSTLILGSSRRVFFGKGKKAPAQQPASKEA

SEQ ID NO: 51213 - protein, 534 aa, Arabidopsis thaliana
  misc_feature (497)..(497): Xaa can be any naturally occurring amino acid
MATKLDTSSLLLALLSKCSLLTQTNLALSLLVASLASLALSLFFWSHPGGPAWGKYFLHRRRQTTVIPGPRGLPFVGSMSLMSNTLAHRCIAATAEKFRAERLMAFSLGETRVIVTCNPDVAKEILNSPVFADRPVKESAYSLMFNRAIGFAPYGVYWRTLRKIASNHLFSPKQIKRSETQRSVIANQIVKCLTKQSNTKGLCFARDLIKTASLNNMMCSVFGKEYELEEEHEEVSELRELVEEGYDLLGTLNWTDHLPWLSEFDPQRIRSRCSNLVPKVNRFVNRIISDHREQTRDSPSDFVDVLLSLDGPDKLSDPDIIAVLWEMIFRGTDTVAVLIEWILARMVLHPDIQSTVHNELDQIVGRSRAVEESDVVSLVYLTAVVKEVLRLHPPGPLLSWARLAITDTIIDGRRVPAGTTAMVNMWAIAHDPHVWENPLEFKPERFVAKEGEVEFSVLGSDLRLAPFGSGRRVCPGKNLGLTTVTFWTATLLHEFEXLTPSDEKTVDLSEKLRLSCEMANPLAAKLRPRRSFSV

SEQ ID NO: 51214 - protein, 438 aa, Bacillus anthracis str. Ames
MHHDEKNKIGLTVALSIVVGTIIGSGVFMKPGSVLDYSGSSNMAILAWVIGGLLTLASGLTVAEIGAQIPKNGGLYTYLEEIYGSFWGYLSGWMQTIVYGPAIIGTLGLYFSSLMINFFYLDKVWNLPIAIGTVVFLGVVNSMGTKYGGIVQTITTIGKMIPIVLIVVLGFWKGNSDIFNVVVPISENQSIGMAILATLFAYDGWILLASIGGEMKNPTKLLPKAMTVGILIVTAAYVLINLALLNVLPATQIVELGENATATAAGMLLGEYGGKIISIGIIVSIFGCLNGKILTFPRIPMSMAERGQLPFAKFIAKESPRFKTPANAITVEIILGIILMIISDPNKLSEISVFIIYIFYVMTFIGVFILRKRNKNKERAYSVPLFPIVPIVAILGSLFVIGSAIINDPLSCFLSIGIVFTGLPVYWYLNKKNKTEVS

SEQ ID NO: 51215 - protein, 568 aa, Chlamydomonas reinhardtii
MTSVDEEPTQPHDPVEEEEEPDEIQWNLGFVEEPEKPHLLMRHRFPSKVGGRPAWLDPLRLPSTDMLTCKASGKPLDFLLQVYAPVDANPDEGFHRALFLFISPEGSRLKEPGAVRLFRCQMPRRNAFYSSDPPRDKDKFPNPLSASDADASRARDPWRSVDAERPASATSSGGPASTSSPAAAKRKGKGKGGAAPTAAANGAAAEGSVAAAPLPREGVRGPGGLYPELELIVEPEEDYMDEWEEEEDGAAEGGKEAEKNEKKEDDGRVDDAKTETDAGEAPATEAGAGAAAGAAEKGSARGGVEAEVRRALEEYRRRVATEGELNDEELPPDVMEALEANAAPEQRCFVDFQARVSWAPEQVIRYCFQDGAQPLWPAPHCRPKPGDVPACSRCGAARKPEFQVLPQLLHYLRLDEEDPASPDWSTLVAYTCSASCSLPPAEVESSQCAYTEEVVWVQPRCRRLHSRSTCVDATAQGVRALERDNFNMLRAIQNLQKIKPGGPRLRQSLAPRPLGGGAAGVTGGSGAASMPPHQQQQQQQQQQQLLHQSLAPRPLGGGAAGATGSMAS

SEQ ID NO: 51216 - protein, 461 aa, Salmonella enterica subsp. enterica serovar Typhi str. CT18
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 51217 - protein, 252 aa, Ostreococcus tauri
  misc_feature (10)..(16): Xaa can be any naturally occurring amino acid
MRALGVGLIXXXXXXXFCEQLLVAVRYVHSLGLVHTDLKPENVLLMSNSYRENATHRVPVDHTIRLIDFGSTTFIDRHHSAVVSTRHYRAPEIILGLGWSYPCDMWSIGCMMIELLTGEALFQTHDNLEHLAMMQHALSRTIPNAVVKRVPKDKLRDLFNRNGALNWPNEKTDAESYAALGNTGVVRQLLEKHLSGEVLSLFADLVGKLLDFDPKRRITSKSAVNHAFFSLDLKIDWRIMRNGDGRVLGVKK

SEQ ID NO: 51218 - protein, 420 aa, Salmonella enterica subsp. enterica serovar Typhi str. CT18
MSFTTISVIGLGYIGLPTAAAFASRQKQVIGVDINQHAVDTINRGEIHIVEPALGNVVKMAVEGGFLRATTTPVEADAYLIAVPTPFKGDHDPDMAYVEAAAKSIAPVLKKGALVILESTSPVGATEQMAGWLAGMRPDLTFPQQAGEQADVNIAYCPERVLPGQVMVELIKNDRVIGGMTPVCSARASALYKIFLEGECVVTNSRTAEMCKLTENSFRDVNIAFANELSLICAEQGINVWELIRLANRHPRVNILQPGPGVGGHCIAVDPWFIVAQNPQQARLIRTAREVNDGKPHWVVDQVKAAVADCLAATDKRASEVKIACFGLAFKPNIDDLRESPAMGIAQSIARWHSGETLVVEPNIRQLPKKLDGLCTLAKLDAALAAADVLVMLVDHDEFKAIPGDAVHQRYVVDTKGVWR

SEQ ID NO: 51219 - protein, 323 aa, Corynebacterium glutamicum
MSLPIDEHVNAVKTVVVPAAGLGTRFLPATKTVPKELLPVVDTPGIELIAAEAAELGATRLAIITAPNKAGVLAHFERSSELEETLMERGKTDQVEIIRRAADLIKAVPVTQDKPLGLGHAVGLAESVLDDDEDVVAVMLPDDLVLPTGVMERMAQVRAEFGGSVLCAVEVSEADVSKYGIFEIEADTKDSDVKKVKGMVEKPAIEDAPSRLAATGRYLLDRKIFDALRRITPGAGGELQLTDAIDLLIDEGHPVHIVIHQGKRHDLGNPGGYIPACVDFGLSHPVYGAQLKDAIKQILAEHEAAERIADDSQVKLEHHHHHH

SEQ ID NO: 51220 - protein, 393 aa, Synechococcus sp. RS9916
MKAMILAAGKGTRVQPITHVIPKPMIPILQKPVMEFLLELLKEHGVKEVMVNVSHLAEEIENYFRDGQRFGVEIAYSFEGRIEDGELIGDALGSAGGLKKIQDFQPFFDDTFVVLCGDALIDLDLSEAVRRHREKGAIASIVTKRVPRDQVSSYGVVVTDDAGRISAFQEKPTVDEALSDTINTGIYIFEPEIFAHIPSGQAFDIGSDLFPKLVEQDAPFYALPMDFEWVDIGKVPDYWQAIRSVLLGEVRQVGIPGKEVRPGVFTGLNVAANWDKINVQGPVYVGGMTKIEDGATLIGPAMIGPSCSICEGAVIDNSIIFDYSRIGPGVQLVEKLVFGRYCVGKDGDHFDLQEAALDWLITDARRADLIEPSPQQKAMAELLGTDLTPTPGG

SEQ ID NO: 51221 - protein, 466 aa, Pseudomonas putida
MKSYDVVIIGGGPGGYNAAIRAGQLGLTVACVEGRSTLGGTCLNVGCMPSKALLHASELYEAASGDEFAHLGIEVKPTLNLAQMMKQKDESVTGLTKGIEYLFRKNKVDWIKGWGRLDGVGKVVVKAEDGSETALQAKDIVIATGSEPTPLPGVTIDNQRIIDSTGALSLPQVPKHLVVIGAGVIGLELGSVWRRLGSQVTVIEYLDRICPGTDTETAKTLQKALAKQGMVFKLGSKVTQATASADGVSLVLEPAAGGTAESLQADYVLVAIGRRPYTKGLNLESVGLETDKRGMLAQRTPPTSVPGVWVIGDVTSGPMLAHKAEDEAVACIERIAGKPHEVNYNLIPGVIYTRPELATVGKTEEQLKAEGRAYKVGKFPFTANSRAKINHETEGFAKVIADAETDEVLGVHLVGPSVSEMIGEFCVAMEFSASAEDIALTCHPHPTRSEALRQAAMNVDGMAMQI

SEQ ID NO: 51222 - protein, 523 aa, Pseudomonas aeruginosa PAO1
MHVSKVFPSLRDTLPRDLMASVVVFLVALPLCMGIAIASGMPPAKGLLTGIVGGLVVGFLAGSPLQVSGPAAGLAVLVFELVRTYGVAMLGPILLLAGAIQLLAGRLRLGCWFRVTSPAVVYGMLAGIGILIVLSQLHVMLDLAPKASGLDNLLAFPQAAFAALGSLGMDSGLDAALLGLGTIAVMWGWDKLRPQRLRFLPGALLGVSLATLASLWLALDVRRVEVPANLGEAIVWLRPADLLALADPSLLLAAVVVAFIASAETLLSAAAVDRLHDGPRSDMDRELSAQGVGNMLCGLLGALPMTGVIVRSSANVNAGARTRASAIFHGLWLLAFVLLLGSLLRQIPVASLAGVLVYTGVKLVDFKALGNLSRYGRMPMLVYAATALAIVFTDLLTGVLVGFALTLLKLVLKAARLKIALRYTGEHEAELRLSGAATFLKVPALSRVLDEVKPGTTLHVPMDNLSYVDHACMELLEDWGRMAPVQGSRLVIEPRALKRRLEGRLRGSVGLGGARNGGAVSPG

SEQ ID NO: 51223 - protein, 365 aa, Schizosaccharomyces pombe 972h-
MALDLRIGNKYRIGRKIGSGSFGDIYLGTNVVSGEEVAIKLESTRAKHPQLEYEYRVYRILSGGVGIPFVRWFGVECDYNAMVMDLLGPSLEDLFNFCNRKFSLKTVLLLADQLISRIEFIHSKSFLHRDIKPDNFLMGIGKRGNQVNIIDFGLAKKYRDHKTHLHIPYRENKNLTGTARYASINTHLGIEQSRRDDLESLGYVLVYFCRGSLPWQGLKATTKKQKYEKIMEKKISTPTEVLCRGFPQEFSIYLNYTRSLRFDDKPDYAYLRKLFRDLFCRQSYEFDYMFDWTLKRKTQQDQQHQQQLQQQLSATPQAINPPPERSSFRNYQKQNFDEKGGDINTTVPVINDPSATGAQYINRPN

SEQ ID NO: 51224 - protein, 688 aa, Saccharomyces cerevisiae
MGEKRTIIKALKNSAASHFIKKLTADTSLSSIQEAINVVQQYNATDPVRLKLFHTPRMVSQGAHFAFCLPTKKPHYKPLLLSQNALDEFNLVQDQDLEKILSGEKVYYSDSIFPYSTVYSGFQFGSFAAQLGDGRVVNLFDLKDKCSGQWQTFQLKGAGMTPFSRFADGKAVLRSSIREFIMSEALHSIGIPSTRAMQLTLLPGTKAQRRNQEPCAVVCRFAPSWIRLGNFNLFRWRHDLKGLIQLSDYCIEELFAGGTQFEGKPDFNIFKRDFFPDTETKIDEQVEKDETEVSTMTGDNISTLSKYDEFFRHVVSLNANTVAHWQAYGFANGVLNTDNTSIMGLTIDYGPFAFLDKFEPSFTPNHDDTAKRYSFANQPSIIWWNLQQFAKDLACLLGPEARDLELLLKGELNSVDDALEKTMIERVQKLVELSANEYKYVFTTRYAQIMSQRLGVDLDLEKCMSSTNLKDIEHAAEKAKEFCDVIVEPLLDILQATKVDYNNFFIHLQNYKGPFFIKDKSDTATLFGAFDEEYLGMFFNSKQLQQMAETEEAFAAGEKVFDANGELRLLNEKLQEIRNWTQDYLTLVPPTETAARASLAKKANPLFVPRSWVLEEVVDDLMYSQRDGLQDPSSELDTSALKKLYLMSVNPYDRTKWDVTLRPELETKWADLSHQDDAKFMMQASCSS

SEQ ID NO: 51225 - protein, 458 aa, Staphylococcus epidermidis ATCC 12228
MAKQLQRELNNRHIQLIAIGGAIGTGLFLGSGQTISLTGPSLLFTYMLIGIVLFAFMRALGELLLSNSKFNSFVDIANEYLGPFGGFVIGWTYWVCWIVSSMSDLTAMGQYFAYWYPQVPHWLTVLFIVLLLISFNLLGARLFGELEFWFSIIKVVTIITMVIVGLVLIFLSFKTEYGHASFGNLIHHGGMFPHGAAGFLMSFQIAVYSFIGIELIGVTAGETKNPEKTIPKAINNVPIRILLFYIGGLLVIMSVIPWFKVDPDSSPFVKLFTLIGVPFAAGIVNFVVLTAAASATNSGIYSNSRILFGLAKQGLGPKVLTKTNSNGVPYLSMLVSSITLLIAALLNFIFPDAIKLFIYVTTLSTVLFLVVWGMIIVSYIAYVKKNPEQHQSSAFKLWGGKIIAYIVLSFFIFIFILLFFSKDTRVAIFISPLWFIFLFFYYKKYKNNAESLADRQRH

SEQ ID NO: 51226 - protein, 356 aa, Zea mays
MAHAKAGASLPVPNVQALAQTWHGSGEPVPFRYVRTEEIVAGEVVAGCAIPVVDLSRLLDPRSSEEELANLGSACQHWGFFQLINHGVPDEVIQDTKKDMVEFFKLPVEAKKVHAQVPGGIEGYGQAFVFSETQKLDWADMIYLMISPKESRDLRFWPTRPPSFRDSIERYSAETAKVTACLLRFMAKDLGVEPERLLEEFRGLPQSMRTTYYPPCRLAADVLGLSPHTDATGLTLLLHVNDVQGLQIRRDGKWLAVDPLDGALVVSIGDILEILSNGRYRSIEHRAIVHPDKERISAAMFHQTCPNTTVGPLQELVERDSGGARYRSMDYMDFMKGFFAAKLDGRRSHMDALRIY

SEQ ID NO: 51227 - protein, 258 aa, Bacillus subtilis subsp. subtilis str. 168
MNAISLAVDQFVAVLTIHNPPANALSSRILEELSSCLDQCETDAGVRSIIIHGEGRFFSAGADIKEFTSLKGNEDSSLLAERGQQLMERIESFPKPIIAAIHGAALGGGLELAMACHIRIAAEDAKLGLPELNLGIIPGFAGTQRLPRYVGTAKALELIGSGEPISGKEALDLGLVSIGAKDEAEVIEKAKALAAKFAEKSPQTLASLLELLYSNKVYSYEGSLKLEAKRFGEAFESEDAKEGIQAFLEKRKPQFKGE

SEQ ID NO: 51228 - protein, 228 aa, Brassica napus
  misc_feature (138)..(138): Xaa can be any naturally occurring amino acid
  misc_feature (148)..(148): Xaa can be any naturally occurring amino acid
  misc_feature (157)..(157): Xaa can be any naturally occurring amino acid
  misc_feature (171)..(171): Xaa can be any naturally occurring amino acid
  misc_feature (184)..(184): Xaa can be any naturally occurring amino acid
  misc_feature (196)..(197): Xaa can be any naturally occurring amino acid
  misc_feature (205)..(205): Xaa can be any naturally occurring amino acid
  misc_feature (207)..(207): Xaa can be any naturally occurring amino acid
  misc_feature (215)..(217): Xaa can be any naturally occurring amino acid
  misc_feature (220)..(225): Xaa can be any naturally occurring amino acid
  misc_feature (227)..(227): Xaa can be any naturally occurring amino acid
MSNDKDNFNLADLTDALKDEDRIGLMHALKNKLMAGQHSDVLESLTPQVRNRVEALKEIQGKYDELEAKFRAERAVLEAKYEMLYQPFYTKRYEIVNGVTEVETTPEDTKMDQEGEKPAEEKGVPSFWLTGLEKTIDXDFPRRPQSRXEEALKYLKXDIKWYKTEEPKGFXKLEFFFDSNPYFXRTLVLTKSYHMXXDEDEPLLXKXIGTENRLXXXGKXXXXXXLXK

SEQ ID NO: 51229 - protein, 350 aa, Schizosaccharomyces pombe 972h-
MSYEKHSDAKASRYAWNQPWNPFEVTLSDPTYPMNLEEKNQIPYRFQSVPDDVPEVPHIESRYKNLPGNNIYLCCGRLQMSSQYKAFLISLFALILPGVLFFIFSAFWLWHHVSPAVPITFAYLYALAVVSMFKCSTADPGILPRNAYSLTYNPAHPWSVIPEDRKVLVGSTRSDSVFVNTVYCHTCHLYRPPRASHCHLCDNCVEYLDHHCIWLNTCIGRRNYRYYFIFLLSVVLSALYLTGLGFYTSIGSFHESTDTNFAAHLRRPWAGVSFFLGIYGALGAILPGILFCYQCYLISVGQNVHEYLRAKSTETEDVHPFHDSIWLNFLVVLCRPKNVSYVRPTRKSYV

SEQ ID NO: 51230 - protein, 368 aa, Oryza sativa
MAAATAAAETPPTLLEYMGQAGAADDLVVLVAHVQSACKRIAALVASPGNAELSRGKAGGGVAVAAGRDAPKPLDELSNEIILSSLRRSGKVAVMASEENHLPIWVSNDSPYVVVTDPLDGSRNIEVSIPTGTIFGIYNRLAELDHLPEEERAQLNSLQSGTHLVASGFGAGTHGFTLDHLTGEFVLTHPSIQIPPRGQIYSVNDARYFDWPEGLRKYIDTIRQGKGQHPKKYSARYVCSLVADFHRTLIYGGVAMNPRDHLRLVYEANPLSFLAEQAGGRGSDGKSRILSIQPVKLHQRLPLFLGGMEDMLELESYGDVQQKVNPGYESVHFSAMWSGRLADGTIKTRGHFRTCDCDETCCNIQTSG

SEQ ID NO: 51231 - protein, 482 aa, Aspergillus oryzae
MNENDENRPSTRLTRAKAAALSAGDVSTAATKKPLESKKAATSTATAGTTRKRAALGDVSNVTKGENGAAKEGKKPAGAKVGLTSKATMQAGGVAKLTRTNSSRTTALTNKTTNTKKPTEDKEKRSGPGSIKDSAQKRQKTTKDNALVEEPPRKKVEVEKKLTEKKLVAEEAPAKENVEAPVEPKTLQKPSQDLVEDLDTEDLDDPLMVAEYVVEIFEYMKDLELETLPNPHYIDHQPDLEWKMRGILVDWLIEVHTRFRLLPETLFLAVNIIDRFLSAEVVALDRLQLVGVAAMFIASKYEEVLSPHVANFSHVADETFTDKEILDAERHILATLEYNMSYPNPMNFLRRISKADNYDIQTRTLGKYLMEISLLDHRFMAYRQSHVSAAAMYLARLILERGPWDATLAYYAGYDEEQIDPVFRLMIDYLHRPVCHEAFFKKYASKKFLKASILTRQWAKKYHHLYIDSSLSEPYNYIKDHE

SEQ ID NO: 51232 - protein, 321 aa, marine gamma proteobacterium HTCC2143
MAAFNDNSLAIGQTPLVRLNRIGDGNIFAKVESRNPANCVKCRIGSNMIWEAEKSGLLKPGMEIVEPTSGNTGIALSFVGAARGYKVTLVMPHTMSLERRQLMKALGANVVITDAAKGIKLCIDTAQQLVAEAPDQRWMPSQFDNPANPAIHEQTTGPEIWEDTDGGVDVLICGVGTGGTLTGISRYLKNTRGKAITSVAVEPMSTTMITAAKAGEEPVHGPHKVQGIGAGFVPANLDLDMVDQVEQVSDEDAIEYAHRLMKEEGILAGISSGAAAAIAHRVSQQPEHKGKTIVVILPDSAERYLSTPLFEGQFSDNETVQ

SEQ ID NO: 51233 - protein, 147 aa, Pediococcus pentosaceus ATCC 25745
MNSNNWSKAELKKKLSPEEYEVTQNAATEHPFTGKYDNFYQKGIYVDVVSGEPLFSSTDKYDAHCGWPSFTKPIDPKLVVNHRDSSYGMERVEVRSKDANSHLGHVFDDGPLDQGGNRYCINSAALKFIAYDDLEAHNLGYLKKLFN

SEQ ID NO: 51234 - protein, 493 aa, Mycobacterium avium subsp. paratuberculosis K-10
MSDIQTQAKTEYDKLFIGGKWTEPSTSEVIEVHCPATGEYVGKVPLAAAADVDAAVAAARAAFDNGPWPTTPPKERAAVIANALKVMEERKDLFTGLLAAETGQPPTSVETMHWMSSIGALNFFAGPAVDQVKWKEVRTGGYGQSIVHREPIGVVGAIVAWNVPLFLAVNKLGPALLAGCTVVLKPAAETPLSANALAEAFAEAGLPEGVLSVVPGGIETGQALTSNTDVDIFSFTGSSAVGREIGRRGADMLKPCTLELGGKSAAIVLDDVDLPSALPMLVFSGIMNSGQACVAQTRILAPRSRYDEIVDAVSTFVQSLPVGLPSDPAAQIGSLISEKQRARVEGYIAKGIEEGARLVCGGGRPEGLDSGFFVQPTVFADVDNKMTIAQEEIFGPVLSIIPYDTEEDAIKIANDSVYGLAGSVWTADVQRGIAVSEKIRTGTYAINWYAFDRCCPFGGYKNSGIGRENGPEGVEHFTQQKSVLMPMGYTLEG

SEQ ID NO: 51235 - protein, 408 aa, Rubrobacter xylanophilus DSM 9941
MYDVLKVRRDFPILEREVNGRPLVYLDNAATSQKPLQVIRTLSRYYERHNANIHRGVHRLAEEATGLYEEARGKVARFIGAPDPRGLVFTRGTTESINLVAHAWGRKNLREGDEVVLTEAEHHSNLVPWQLAARDTGARLRFIPVLDDGTLDMEAAEHLIGPRTRLVGCVHASNVLGTVNPVERLAELAHEAGALMLVDGAQSAPHLPVDVTSLGCDFFAASGHKMLGPTGVGFLWARPELLEEMEPFLGGGEMIREVRLERSTWNEIPYKFEAGTMNIAQAIGLGAAVDYLGSLGMESVREHERRLGAYAYRRLAGVEGITLYGPAENRTGVVAFNLPEVHPHDLSQLLDQEGVAIRSGHHCCQPLMRRLGVVATARASLYLYNTEEEVEALVEAIARAREFFEAPA

SEQ ID NO: 51236 - protein, 190 aa, Cryptococcus neoformans var. neoformans JEC21
MPTRVIPGVTMVDDGPSVVVPPINFSLVAPGIYRSGHPNRKNFPFLKRLNLKGIIYVEGSDPYRQDSLDFVQSQNLELYRFDFSNESDLYTPEGQERMEALLKVLLDKRNYPLLVHDDTGKGSCTLVCALIRRFQSWSLTGLFAEGDMFAGPAGGAEGVGLGETGMEFIAAFQPKLVAYDRTWRPDWADY

SEQ ID NO: 51237 - protein, 932 aa, Ostreococcus tauri
MSNDGETASPASVSPASFAQSLSPRRVDAVDVRTTRDEAAGVELVMEEGSLVAGVERGYFDEPSTSEPTFDPVLVSLRRLGADFTVEDLSKEEERLSELADRVSSALNREIMAHGEDFEKGMENITKIYDTLEAAGVLLKNSRRSLQRVGSDVKSALRVQGSHTTKGSIIETLRILEDIKFCQTCEIKIRSRLDASDYAEAMTLYSKAWSILEGMHGLKCTYTLREDFVALRWELATCVDNVLIDLCGTFDAEKFAKLYEQYPKLGHEVKHLADKIQDAFLKAVEVQTEGMLRLHAMLAQDEEIEAKRKSRMGYKQLCSQLSSMQFVPCLRKTLESLHEIFLSSYRMTAWCQAAMQDTIDLSNAEAINTCSALIAALQINRKPIVEMASVRLAALLQSSGPPSNAAFREVFDLCRVFITCAEAFCGEESQTLRAQLERIGDRYFESLHSARLDASKTIFESERWIPVSMDAVKRVRDDLRSAMQRKKATINGLGKTLGDTAITTFNSDQILDSESFVRFIHQPNPFIATGQSNESVATNAEASRADNGVDAVDMSTSVSTEDFASNGEHEHACDGDDVGLDRAGVKITASSLYILQGIVEYTVLMQVMRPSVPVIFNGICQLFELALVKTFNAFGRTEGLLPDSYDMTPRLRGTLSRLGNSGGVMAIRVTAPSQGDEDILSSGNLYGLKERGIAIESLARVADEFKRIKSRVKRSLPLKDAASADRFYSHTVAAVEDLREHVYKNVASLLLNIGFCAEAIGDGDPNFALVNSTFAGKYNLREAPKRQSKWVDDVSAELLQFTTKLAVADVAPEALAVLWGQAASLLEHVLVDGFSRVKKCTDAGRALMSLDIQTLRAEFTKLAPSGTSTEWLFVTAYIDAFFIPEHDFPKWLVIHPEYTKSQKLSLVHQASAGRRWSAKLRADSIAAIEADP

SEQ ID NO: 51238 - protein, 630 aa, Cryptococcus neoformans var. neoformans JEC21
MEIPSTVARQSSRTRLIPENQHGPHLSKEITPGARAMSLERLIPFRNGWSAVERRRAGVFATSVVVGLASGSNYGYSAYAPQLASQLVISATLVNLIGLAGNFGMYTSGPVWGKIVDSKGQKIPLLAGGLCCLLGYGITHAFYTHIIPLRSPSSDDPSYLRLSLLLFAMFLTGCGGSAGLTSGVNAVAKSFPDSTRASATGAVLAGFGLSAFLFSALGHLFWPGDSGGLLALLTVGTGGPMLFAAFIVRAMPPEGEQSLGPPLYEQVEQDEDGDGMGVEVAVGDYGSPTFSRSSSFELSRSMEFSRSRSPAARGRHIHPDPDHPQPHAHFGALPPSHNATHKPPRSRSSSLSSLPPTLLTHSPVDLIKTVDFWLLFIILAVLSGTGLMYINNAGTVVLALAREGKRVYNKEKIGGWQAKQVGLVSIWNCAGRILGGVYSDFCKTHFQIRRIWALPLVACLFIVSQLSALSTTHAQSLWIVSSLLGLAYGALFNVMPMLILEWFGMRHFSQNWGWTAVAPIIGSNTFNVLFGSVYDANSVGRIGSFDPEGTDVSGVMGMMDFIKRGGVALPDDGSHDCLMGEECYGLAFKLSFLGCILALVLSVLAGVRREKMSKERRGAILARRTSSDEV

SEQ ID NO: 51239 - protein, 353 aa, Rhodococcus sp. RHA1
MLALRLYREHDARLEEVPEPELRPGAVKVKVAWAGICGSDLSLFETAPVPLDYSNPIMQETGPHTLGHEFSGYVTEVAEGVTTVQVGDLVAVRPNFADGTCPSCQAGHPNMCDNFAFIGINGWGGGFSESVVVPADHAYVLPPGFNAQIAALIEPLTVAWHAVKLAEIPKDGTALVVGAGPIGLSTVLALRAQGISKIIVSEPSEARKKLAAEVGADLVIDPRETDVVAAVRDATGGRGADVSFEASGIGKATLQPAIDALCTAGRAVILASFHGDVPTDVMPFLTKEKVLTGSFAYTAQDFSDVRDAVVDGRITPDALISSRIQLSDVLDSGIKHLLGEGRTTEVKILVSPS

SEQ ID NO: 51240 - protein, 289 aa, Photobacterium sp. SKA34
MWQAISHQLSDVLGRPFKIVERQTLEGGDVNECYCVSDGEQRFFLKLNDKEQLVVFETESESLRILNEANCVQVPQYVHVGTCRDKSFLTLNYLPTKQIDDNAGYQLGQQLAKLHLWGEQAEYGFDFDNYVGLTPQPNRWHRRWCRFFAEQRIAWQLQLCEEKGILFGNIDTITSNVIKRLVNHQPKPSLLHGDLWHGNTALTVSGPIIFDPATYWGDRECDIAMTELFGGFPNSFYEGYNSVYPLTSEYQERKELYNLYHILNHCILFGGEYMGQAEYIITKLNLLDE

SEQ ID NO: 51241 - protein, 205 aa, Oryza sativa
  misc_feature (176)..(176): Xaa can be any naturally occurring amino acid
KTPYDNVDIVTIRENTEGEYSGIEHTIVPGVVQSIKLITEHASLRVCEYAFLYAKQHKREKVTVVHKANIMRLSDGLFLKSARQVAEKYPDIKFEEMYLDTVCLKMVQDPTQFDCLVMPNLYGDILSDLCAGLIGGLGLTPSGNIGENGAAIFEAVHGTAPDIAGQDKANPTALLXSAVMMLRHLHMFDKADRIEKACFDTVRDG

SEQ ID NO: 51242 - protein, 403 aa, Zea mays
MADYVYGPGRTHLFVPGPVNIPDPVIRAMNRQNEDYRSPAVPALTKVLLEDVKKIFKTTTGTPFMIPTTGTGAWESALTNTLSPGDRVVSFLIGQFSLLWIDQQRRLGFDVDAVESEWGQGADLAALERRLRDDAPRHAIKAVAIVHNETATGVTNDLAAVRALLDKHAHPALLLVDGVSSICALDFRMDEWGVDVALTGSQKALSMPTGMGIVCASPRALEASKTARSVRVFFDWKDYLRFYDMGTYWPYTPSIQLLYGLRTALDLIFEEGLDNVVRRHNRLGTATRLAVEAWGLSNCCQKEEWFSDTVTAAVVPPNIDSAEVVRHAWKRYNLSLGLGLNKVAGKVFRIGHLGNLNELQLLGCLSGVEMVLKDVGYPVKLGSGVAAAAAYLSNSTPLIPSRI

SEQ ID NO: 51243 - protein, 691 aa, Zea mays
MASSAFLPELGTQVVVPVAAVVGIAFAVLQWVLVSKVKLSPEPRRGDGSAGKSGAGAGASEYLIEEEEGLNEHNVVVKCAEIQNAISEGATSFLFTEYKYVGLFMGIFAVLIFLFLGSVESFSTKSQPCHYSKGKTCKPALANAIFSTIAFVLGAVTSLVSGFLGMKIATYANARTTLEARKGVGKAFITAFRSGAVMGFLLAASGLFVLYIAINLFGIYYGDDWEGLYEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTAVMTVGIALVSWLGLPYTFTIFNFGVQKTVYNWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAEISTVDVLTPKVFIGLIVGAMLPYWFSAMTMKSVGSAALKMVEEVRRQFNTIPGLMEASSSNGFRGRMEDGWVVYFCRGRALDICHREVSVYPYGALHPFLFRLYCVAVLLNLSAVVSPSFWV

SEQ ID NO: 51244 - protein, 235 aa, Pseudomonas syringae pv. syringae B728a
MRTHPNETDTSCRTPCRQVFTGNHMQLKNPILGLCQQATFMLSAAKVDQCPDDEGFEVAFAGRSNAGKSSALNTLTHASLARTSKTPGRTQLLNFFGLDEDRRLVDLPGYGYAKVPIPLKLHWQRHLEAYLGSRESLKGLILMMDIRHPMTDFDVLMLDWAIASNMPMHILLTKADKLTYGAAKNTLLKVQAEIRKGWGDAVSIQLFSAPKRMGLEEAYTVLADWMELEDKAPAE

SEQ ID NO: 51245 - protein, 490 aa, Ipomoea batatas
MRINPTTSGSEVSTVEKKNLGRIVKIIGPVLDVAFPPGKMPNIYNALVVQGRGNEQTNVTCEVQQLLGNNRVRAVAMSDTDGLMRGMEVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGYLQERITSTKEGSITSIQAVYVPADDLTDPAPATTFAHLDATTVLSRGLAAKGIYPAVDPLDSTSTMLQPRIVGEEHYETARGVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 51246 - protein, 877 aa, Schizosaccharomyces pombe 972h-
MSFIKKIKHYFADPADLPQDEAPDSVPGLVPPPSNFVPVYPEPTYSDTVSKKGTIVRVVRHTASKLTKHGDSSQSLSTLPNNDISVGEYVEPLPSVPGWLKQNIFSHFGTRLLHYLRSLFPIMNWLPRYNWNWLVYDFIAGITVGCVVVPQGMSYAKVATLPAQYGLYSSFVGVAIYCIFATSKDVSIGPVAVMSLVTSKVIANVQAKDPNYDAAQIGTTLALLAGAITCGLGLLRLGFIIEFIPVPAVAGFTTGSALNIMAGQVSSLMGYKSRVHTNAATYRVIIQTLQNLPHTKVDAAFGLVSLFILYLVRYTCQHLIKRYTKFQRVFFLTNVLRSAVIIIVGTAISYGVCKHRRENPPISILGTVPSGFRDMGVPVISRKLCADLASELPVSVIVLLLEHISIAKSFGRVNDYKVIPDQELIAMGATNLIGVFFHAYPATGSFSRSAINAKSGVRTPLGGIFTAGVVVLALYCLTGAFYYIPNAVLSAVIIHSVFDLIIPWRQTLLFWRMQPLEALIFICAVFVSVFSSIENGIYTAVCLSAALLLFRIAKPSGSFLGILKIANKFDDDENSIDVVRDIYVPLNQKGMNPNLTVRDPPAGVLIFRLQESFTYPNAGHVNSMLTSKAKTVTRRGNANIYKKASDRPWNDPAPRKKKNAPEVEDTRPLLRAIILDFSAVNHIDTTGVQALVDTRKELEIYAGDEVEFHFTDINNDWIKRTLVAAGFGKARDATKYTSRSIEVGSAAPLRDIETPMAPGNSRIVMPSSVRVRPFDEEEAIESSIPAIVSEDGADSDTISVSDDKDKKVEGHRPSQDPTFSHHEYYPVISTTYPFFHVDVTSAVVDIQYRHVLDVNYKPKIVTNEVENENIEHSDGAA

SEQ ID NO: 51247 - protein, 367 aa, Saccharomyces cerevisiae
MQRNSLVNIKLNANSPSKKTTTRPNTSRINKPWRISHSPQQRNPNSKIPSPVREKLNRLPVNNKKFLDMESSKIPSPIRKATSSKMIHENKKLPKFKSLSLDDFELGKKLGKGKFGKVYCVRHRSTGYICALKVMEKEEIIKYNLQKQFRREVEIQTSLNHPNLTKSYGYFHDEKRVYLLMEYLVNGEMYKLLRLHGPFNDILASDYIYQIANALDYMHKKNIIHRDIKPENILIGFNNVIKLTDFGWSIINPPENRRKTVCGTIDYLSPEMVESREYDHTIDAWALGVLAFELLTGAPPFEEEMKDTTYKRIAALDIKMPSNISQDAQDLILKLLKYDPKDRMRLGDVKMHPWILRNKPFWENKRL

SEQ ID NO: 51248 - protein, 303 aa, Streptomyces avermitilis MA-4680
MIVVAGEALIDLVPQGAGALAGLKPALGGGPYNTAVALGRLGSPTAFCSRTSRDAFGEALLDGLRTAGVDVSAVQRGAEPTTLAVATIDEHGSAAYSFYVDGTADRQFAAPDRLPGATRAVSFGTCSLVLEPGASAYEELLRSAAAQGLFTTLDPNIRAGLIPDPDAYRARFKSWLASVTLLKLSEDDATWLGGSPREWLASGPSAVVLTRGGDGLTVFTRDGAEHSVPGEPVDVVDTIGAGDTVNAALLHGLAARDALSPEGLAGLDAEGWTELLRFAARAAAITCSRAGAEPPYASELGAF

SEQ ID NO: 51249 - protein, 264 aa, Streptococcus pyogenes M1 GAS
MENMFSLQGKIALITGASYGIGFEIAKAYAQAGATIVFNDIKQELVDKGLAAYRELGIEAHGYVCDVTDEAGIQQMVSQIEDEVGAIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPQTAPLRERQADGSRHPFDQFIIAKTPAARWGTTEDLAGPAVFLASDASNFVNGHILYVDGGILAYIGKQP

SEQ ID NO: 51250 - protein, 333 aa, Streptococcus pyogenes M1 GAS
MSKLLLVGEPLIRVSPNQFQPLTNACEAQLFFGGSEVNIARTLGGFGLEARLFTALPDNPVGHAFHQFLKQSGVDMSLTAWQGHRVGLYYLENGFGCRASQVYYDRCGSSFSALDKDSLDLAAIFEGISHFHFSGISLALGKKTQDLIEVLVREAKKRDICISFDLNFRSSMIAVADAKRLFSHFAQYADIIFGMEPLLLDSDDFDMFDRKKADTTTIRERLAGLYQRYQLQAIYHTERSNDAQGSNHFKAYAYDRQFYESCEVTTPVLQRVGSGDAFVAGLLYQLLEGNEKQRNLDFAVATASLKCTVAEDQLYHSVQQVEAVLANQRDIQR

SEQ ID NO: 51251 - protein, 541 aa, Agrobacterium tumefaciens str. C58
MQATIEKLKATASSTAATDLRAAFAADDQRFSRFSVKFDDLLMDYSKCAVNEEIVTLLEQLAREGGVEAKREEMFSGKAINFTEDRAVLHTALRNRSNTPVLVDDKDVMPDVNGVLAAMGKFADAIRSGSLKGATGKKITDVVNIGIGGSDLGPVMATLALAPFHDGPRAHFVSNIDGAHIADTLKLLDPETSLFIIASKTFTTIETMTNAATARRFIAEKLGEGAVKHHFAAVSTALDKVAAFGIESDRIFGFWDWVGGRYSIWSAIGLPLMIAIGPDNFGKFLDGAHAMDRHFREAPIRENLPMLLGLIGFYNRNVLDYPTRAILPYDQRLSRFPAYLQQLDMESNGKGVTIDGTPVEGQSGPVVWGEPGTNGQHAFYQLIHQGTSVIPAEFMIAANGFEPELRHQHQLLIANCLAQSEALMKGRTLAEAKAQLTSKGMEDSQADFIAPHRVFTGNRPSITFVYDKLTPFALGRLIALYEHRVFVEGVLFRINSFDQWGVELGKELATGLLPVVEGKESAAGHDSSTQGLVKALAGLAG

SEQ ID NO: 51252 - protein, 559 aa, Staphylococcus epidermidis ATCC 12228
MKNNSKSKSNKISLSQLVLLGLGSLIGSGWLFGAWEASSMAGPAAIISWVIGFLVIGTIAYNYIEIGTMFPQSGGMSNYAQYTHGSLLGFIAAWANWVSLVTIIPIEAVSAVQYMSSWPWDWAKPMGSLMKDGSISTYGLIAVYIIIAIFSLLNYWSVKLLTSFTSLISVFKLGVPILTIIMLLVSGFDTGNYGHSIGTFMPYGSAPIFAATTTSGIIFSFNAFQTIINMGSEIKNPEKNIARGIVISLTLSAILYIVLQSTFITSMPSSMLHEHGWSGINFNSPFADMAILLGLNWLAILLYMEAVVSPFGTGVSFVAVTGRVLRAMEENGHIPKFLGKINKKYNIPRVAIAFNAIISMVMVTLFRDWGTLAAVISTATLVAYLTGPTTVISLRKMAPKMTRPFKANILKFMAPLSFVLASLAIYWAMWPTTAEVILIIILGLPIYFFYEYKMNWKNTKKQIGGSLWIIIYLIVLAFLSFIGSKEFKGLNWIHYPWDFLVIVIVALIFYQLGTTSYFESIYFKRANKLNKKMGDKLRKTRKKARHKDWKERDRQEQNQ

SEQ ID NO: 51253 - protein, 480 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTNAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKRCRLDLKFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 51254 - protein, 401 aa, Cucumis sativus
MDYVYGPGRNHLFVPGPVNIPEQVLRAMNRNNEDYRSPAVPALTKTLLEDVKKIFKTSSGTPFLFPTTGTGAWESALTNTLSPGDRIVSFLIGQFSLLWIDQQQRLNFKVDVIESEWGEGAKLDVLAAKLAADTDHTIKAVCIVHNETATGVTNDLSLVRRILDEYRHPALFLVDGVSSICALDFRMDDWGVDVALTGSQKALSLPTGIGIVCASPRALEASKTAKSLRVFFDWKDYLKFYNLGTYWPYTPSIQLLYGLRAALDLVFEEGLENVIARHKRLGQATRLAVEAWGLKNCTQKEEWHSDTVTAVVVPPYIDSAEIVRRAWKRYNLSLGLGLNKVAGKVFRIGHLGNLNELQLLGCLAGVEMILKDVGYPVKLGSGVAAASSYLQNNIPLIPSRI

SEQ ID NO: 51255 - protein, 156 aa, Oryza sativa Indica Group
GTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTGKMF

SEQ ID NO: 51256 - protein, 472 aa, Mycobacterium avium subsp. paratuberculosis K-10
MPIATINPATGETVKTFTPASDAEVDAAIARAYERFLDYRHSTTFAQRAQWANATADLLEAEADEVAAMMTLEMGKTLKSAKAEALKCAKGFRYYAQNAEQLLADEPADAGKVGAARAYIRYQPLGVVLAVMPWNFPLWQAVRFAAPALMAGNVGILKHASNVPQSALYLADVITRGGFPEGCFQTLLVPSSAVERILRDPRVAAATLTGSEPAGQSVAAIAGDEIKPTVLELGGSDPFIVMPSADLDEAVKTAVTARVQNNGQSCIAAKRFIVHTDIYDAFVDKFVEQMKALKVGDPTDPATDVGPLATESGRDEIAKQVDDAVAAGATLRCGGKPLDGPGWFYPPTVVTDITKDMALYTEEVFGPVASMYRAADIDEAIEIANATTFGLGSNAWTNDAAEQQRFIDDIEAGQVFINGMTVSYPELGFGGVKRSGYGRELAGLGIRAFCNAKTVWIGSSKSGDAGGGSKVE

SEQ ID NO: 51257 - protein, 1501 aa, Saccharomyces cerevisiae
MSNIKSTQDSSHNAVARSSSASFAASEESFTGITHDKDEQSDTPADKLTKMLTGPARDTASQISATVSEMAPDVVSKEESFADALSRHTTRSGAFNMDSDSDDGFDAHAIFESFVRDADEQGIHIRKAGVTIEDVSAKGVDASALEGATFGNILCLPLTIFKGIKAKRHQKMRQIISNVNALAEAGEMILVLGRPGAGCSSFLKVTAGEIDQFAGGVSGEVAYDGIPQEEMMKRYKADVIYNGELDVHFPYLTVKQTLDFAIACKTPALRVNNVSKKEYIASRRDLYATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGKQIYFGLIHEAKPYFAKMGYLCPPRQATAEFLTALTDPNGFHLIKPGYENKVPRTAEEFETYWLNSPEFAQMKKDIAAYKEKVNTEKTKEVYDESMAQEKSKYTRKKSYYTVSYWEQVKLCTQRGFQRIYGNKSYTVINVCSAIIQSFITGSLFYNTPSSTSGAFSRGGVLYFALLYYSLMGLANISFEHRPILQKHKGYSLYHPSAEAIGSTLASFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCANTLVPSGGDYDNLSDDYKVCAFVGSKPGQSYVLGDDYLKNQFQYVYKHTWRNFGILWCFLLGYVVLKVIFTEYKRPVKGGGDALIFKKGSKRFIAHADEESPDNVNDIDAKEQFSSESSGANDEVFDDLEAKGVFIWKDVCFTIPYEGGKRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLRKGGQTVYFGDIGKNSATILNYFERNGARKCDSSENPAEYILEAIGAGATASVKEDWHEKWLNSVEFEQTKEKVQDLINDLSKQETKSEVGDKPSKYATSYAYQFRYVLIRTSTSFWRSLNYIMSKMMLMLVGGLYIGFTFFNVGKSYVGLQNAMFAAFISIILSAPAMNQIQGRAIASRELFEVRESQSNMFHWSLVLITQYLSELPYHLFFSTIFFVSSYFPLRIFFEASRSAVYFLNYCIMFQLYYVGLGLMILYMSPNLPSANVILGLCLSFMLSFCGVTQPVSLMPGFWTFMWKASPYTYFVQNLVGIMLHKKPVVCKKKELNYFNPPNGSTCGEYMKPFLEKATGYIENPDATSDCAYCIYEVGDNYLTHISSKYSYLWRNFGIFWIYIFFNIIAMVCVYYLFHVRQSSFLSPVSILNKIKNIRKKKQ

SEQ ID NO: 51258 - protein, 222 aa, Oryza sativa Japonica Group
MATASSLFLASPVATAPTARARSTPSASPARPSLRLRRPSTLAAAAVQAEHQPAVAAAPKPPALPFRVGHGFDLHRLEPGLPLIIGGIDIPHDRGCDAHSDGDVLLHCVVDAILGALGLPDIGQIFPDSDPRWKGADSSVFMREAVKLMHEAGYELGNLDATLILQKPKISPFKETIRSNLCDLLGADPSVVNLKAKTHEKVDSLGENRSIAAHTVVLLMRK

SEQ ID NO: 51259 - protein, 306 aa, Francisella tularensis subsp. holarctica
MYKAGSLSINDILEKEPAFGKLANIKSEQFYNIDSVDMTMAMRIKLAEYVQKLIDDPNVNAVIITHGTDSMVQTAFFLNQVLDVKNPVILVGAMRAFTLLSSDALMNLYDALVTAVNKQSIGKGILVVMNEEILNANDVAKTNTTNVDAFKAPNYGKLGTVIINDVDYYQSPRVVGNILSVDDLQKITALPKVEVIYESADISPEFLDSVLTIKGLEGIVLAGLGDGNILSNQGDFLKKARAKGIVVVRSSYVGSGKVTHNYNNLDDKFDLVSSATLSPEKARIFLQLCLIKTHDIKKIQKLFDRF

SEQ ID NO: 51260 - protein, 1112 aa, Oryza sativa
MAPAMALRLLVVVAVAAVVSCAVAADEGSVVEVWPMPATASKGGQTLHVSRELRMTAEGSKYADGEAILKDAFQRMVTLIELDHVINGSSQGLPLLAGVNVVVHLPGDELNFGVDESYNLSVPATGSPIYAQIEAQTVFGALHALETFSQLCNFDFASRLIELQSAPWSITDMPRFPYRGLLIDTSRHYLPVPVIKSVIDSMTYSKLNVLHWHIVDEQSFPIEIPSYPKLWNGAYSYSERYTMDDAIDIVQYAERRGVNVLAEIDVPGHALSWGVGYPSLWPSATCKEPLDVSSESTFQVINGILSDFSKVFKFKFVHLGGDEVNTSCWTSTPRVKAWLAQHGMKESDAYRYFVLRAQKIAKSHGYEVINWEETFNNFGDKLDRRTVVHNWLGGGVAEKVVAAGLRCIVSNQDKWYLDHLEVTWDGFYMNEPLRNIKNPAQQKLVLGGELTPNNLDYNNPKLKETCLTGRPIDRALAQVASVAGGHAARERSNPRSRHYVNMDNARKFYNLKRRLYSSEEAISASLHEDHSSARLKNSFVFSSGYLIVSMFYLQATTNMELTSSSAMWLAMAILAITAALTKIALGGGRRRCLSESSDLTCKTPPPPPVVNCIALLGLLPALFRGDVPATMQQLYAKFGSVFTVSVAGLLKATFLVGPEVSAHFFQGLESEVSHGDLFEFTVPMFGKEVGHGVDNATRIEQGRFFAEALKPVRLRIHVDPMVQEVEDYFAKWGQHGTVDLKHELEQLLLLISGRCLLGKEVMGTKFDEVCNLFRDIEGGVNLMSVFFPYTPLIPSNRRRDMARERLHAIFSDIVRSRKQQQGDQEEVNDKDVLQSFIDSRYKADGRATTEAEVAGLITGVLFAAKHTSTHTSVWTGARLLTHEKFLAAAVDEQDQIVRKHGIINGRIVTDHYGFLMEMHMLHICIKETLRLHPPAPMIVRTALRQFTVRTREGHEYCVPAGHTMASPIVISNRVPYIYKDAHLYDPDRFGPRREEDKVGGKFSYTSFGGGRNSCVGENYAYMQIKAIWSHLLRNFELKLLSPFPKTDWSKLVPEPQGKVMEKKRKYNSEELARYTLLKEGNGGGSESARLPHHQVYVIFSYHLILMYFYITR

SEQ ID NO: 51261 - protein, 399 aa, Bacillus anthracis str. Ames
MDTLIFEVGTALVLVAIAAVIAGKFKFSVIPFLIVLGMLVGPHAPTIGVIDFKFIESASVISFLGRIGVLFLLFYLGLEFSMKKLIKSGRSIAIGGTIYILINFSLGLLYGFIMGFPLLEILIIAGIITISSSAIVAKVLVDLRRTGNNETELILGIIMFEDIFLAVYLSVVSGLVLGDHASFLGALTSIGIALGYMLLFFIVARKATPLLNKLLNISSDEIFIIVVFASLFFIAGFSETIHVAEAIGALLLGLVFSETEHSDRIEHLVVPFRDFFGAIFFFSFGLSIDPFSLGGAIWLTLGAVLLTIIGNFVAGMIAGRQAGLSHKASTNIGLTIVSRGEFSIIMANIGIAGGLMSVLKPFSALYVLILSILGPLLTKESKNVYKLLNKIFKWDMKKS

SEQ ID NO: 51262 - protein, 311 aa, Thermotoga maritima MSB8
MKVALRKTIGERLLELAKQDEKIVVVTSDARGSAAIADFFKVFPERSIEVGIAEQTAAGVAAGLALCGKKAWVFGPACFYSARNLEQIKNDIAYSDANVKIVAVSGGVSYGPLGSTHHALHDVAVMRAIPNLKVLLPSDAVLAAAILEQLLKDEKPVYMRTGRNPVPVIYSRDEKFEVGRAITLKEGNDITIIATGEVVWRALEAAKILEKEGISARVIDMFTVKPLDEEAVFRAARETGRIVTVEEHSIFGGLGGAVAEFLSQNLPTPMKILGIPDEYPVTGTQDEVLKHYGLAPEGIAKTVLEWFKEGN

SEQ ID NO: 51263 - protein, 557 aa, Arabidopsis thaliana
MVGGGNRRDEGSMPIQNTNLFAALDTSRKKKKSDKAGKSKASSKREDSQKEPEPQVFWAPTPLKAKAWADIDSDDEDDDYYATTAPPQSLWSTSEASHSDAKDVPAEEIESEEDTLDDGDDDDVEEDHEQGTETQVHPEAEPEVKKAPEVRAPPKEAERQLSKKERKKKELAELEALLADFGVATKDENGQQDSQDKGEKKEVNDEGEKKENTTGESKASKKKKKKDKQKELKESQSEVKSNSDAASESAEQEESSSSIDVKERLKKIASMKKKKSSKEVDGASTAAAKEAAARKAKLAAAKKKEKKNYNQQPVRQFVVLLATLDDGEVEMWRRVIGNVAVRHQLQRALSSKAGGSGKSANVSAAVDSMLLRSLKEHYLEVSKMTPPPKVSPPSPFEIVKGSLEGSTGAVLKKSVGNEEINLFVMRLAHGGDEEDDGGINQLFLHVAVSKPNQPDSLHFLCGLYPDALGIHSVSMRPKLEALEMSDDPTQYTGPSFEELDEKMRDVFHGFLEERGVNESLFPFLQAWLYVKDHRNLLRWFKSVGTFVHENPSAENTA

SEQ ID NO: 51264 - protein, 1639 aa, Shewanella sp. ANA-3
MLTMNKVAVMVATALYVGSGVASTTTVAPSNELNAVWATQPADYAPKPLAEETFTWENQVNKTIKKQREIFIAEDDVHGVQKYIVQLNDAPIATYEGGIAQLAATQPTVAKVRGTSSPLNLNQPQLKAYNNYLAEKRANFVAQAQALQGVDVKVSRAFSVALNGFVTEMTQEQAQRLAKVPGVKRITREKIYDLKTFSTPAQTGATSVWNTSALNTLSNKGEGMVVGIIDTGINYDHPSFAAVGGDGYKHINPLAGKYLGDCADSPEYCNDKLIGIYSYPEITQAYTDPVFSETRPAVGVDYNNHGSHVAGTVAGNILNNVAHTTTDFIAQSKGTETGLKFDQVSGMAPHANIIAYQVCWPGGSGDPYAGCPSSAIIAAIEQSAIDNVDVINASLGSLEEDPWLDPMEQAFLNAAASGVFVAVAAGNSGPDLMTADHSSPWVTTVAAHTADQVVGFKKNTVENMSGGATAAPADIVGATRNFNSVTGLMVDASKFKNANEPVASYVKNCDKPFPEGTFDLADNPDTEVDESAQDVIVLCSRSSFPLMTKAANVQAGGAEGIVISNLSSVQDSSAPEIPYAVPGSLIKYADGAKLRTWLASGSGHMATITAGAAEIKEVDKERVANFSGRGPSYFGIDTLFVDIAAPGVDIFAAASDDQPFTKNPSTGDWATLSGTSMASPHVAGAAALLRQSHPDWSPMQVQSALLMTASNDLTSAGFLDNYSDYGDMSALQDVGAGRMHVELADKVGLVLDESMDNMAAANPNAGGRPKNLNTAYMVDNECPTECSFVRTFTATEDATWTVSTETWIGNFDVSVSPQSFTIKAGETQSIVVTAKTKKNVAGTTVIDLTGNQGQVVLTSDVPNSPVLELPVWTYEGETGLPEYLKINAHRKSSTLNVGPFNTAEITDFTARSFGLVKGEDKTVHLYTDKTGGDPFDTVEVDGKQVVNANHVEWTDVPEGAKLLAASVGGSEYARVLVFMGQDTDGDGLPSMDETLCMSTTYTIANFCTITNPQAGRYFTVYMNLATISTGQTDMGRDVTFSTAVVTGDNGNLTVKAPSQIPGYEEYNVELAYHLPEMEVGNTYFGGFDIGTNANDAGNVGFVPVIVNQVDKDVTFTANRETAHAGEVVEFQVNVIANNEAAARDFAIKTQFPDSIQIIPDSIVASNATPGSAVFENNNFSVSGVQETTKDVVRNYKITNNQNDPMCSLKAANSPYPGYLELKEGLGWRTLEGVQGTYRNQFTYSLKDLMNTSQDISFPLFNKYFVDTITLSPAGIISFNSARRLPFMHVEFPKDVAGLPMPEYAIAPYWVGDNTIPARYDGGYGQYHLNAGITPTYTSSREWLVLEWDNVERTGTPGQLVDFEMFLRMNVNFEPGKYEMLFAYDNLQMVDGQGAIGFKAADGRILVDGDMPVDINLGASVAYNNLDKVLSDEYVVCMDYTGPEESQFNVKFTAYVSEKAAGTTQTLKVENHLVGADSEVLELQLEVAGNIQLAAITNKTVKENESISFDVLYSDENQVSNVIEVMGDNFTVTVNGNNVTLTPTANFHGETLVTVRVKDRVNPEDAASTSFSLMVKSDGIEYGCTNSSATNYDASANTDDGSCKLPVVTIEPEAKSSGGALGWLALGLLPLAYRRTRKIH

SEQ ID NO: 51265 - protein, 514 aa, Salmonella enterica subsp. enterica serovar Typhi str. CT18
MAESQPLSVAPEGAEYLRAVLRAPVYEAAQVTPLQKMEKLSSRLDNVILVKREDRQPVHSFKLRGAYAMMAGLTEEQKAHGVITASAGNHAQGVAFSSARLGVKSLIVMPKATADIKVDAVRGFGGEVLLHGANFDEAKAKAIELAQQQGFTWVPPFDHPMVIAGQGTLALELLQQDSHLDRVFVPVGGGGLAAGVAVLIKQLMPQIKVIAVEAEDSACLKAALEAGHPVDLPRVGLFAEGVAVKRIGDETFRLCQEYLDDIITVDSDAICAAMKDLFEDVRAVAEPSGALALAGMKKYIAQHNIRGERLAHVLSGANVNFHGLRYVSERCELGEQREALLAVTIPEEKGSFLKFCQLLGGRMVTEFNYRFADAKHACIFVGVRVSQGLEERKEIITQLCDGGYSVVDLSDDEMAKLHVRYMVGGRPSKPLQERLYSFEFPESPGALLKFLHTLGTHWNISLFHYRSHGTDYGRVLAAFELGDHEPDFETRLHELGYECHDESNNPAFRFFLAG

SEQ ID NO: 51266 - protein, 564 aa, Ostreococcus tauri
MRHDEELRARFPDAALDDSTMVDDVSIALVRAAIKATTSGRGTVACAARRLETDADRALAAADEKDSARSSISADGSVSREAHELAMLTAAIARSGIRTKGDVSYRIVCASADSRGTLAQSSTAIEQCSMTVRDANCCVDVAGWTLCFFTATGWEGEGENDLEAALQDALDADKVFNQLGKRTRTVVHRRSRLKHEGSPTTSNGDGASRVALRRMNSAEAGESSELSEDDSFNGSRERETSSVERVGSPSLDDCTNIVSDINGRELNIGEKVSSGSFGALYRGTYSTRSDDGTLNRRVVALKYLKSVDNGGNFDARRDFFQEVRILRKINHENVIGYVGSVIEGQDLCLITEFAGNGNLIDYMAAKNRPFGTREVARITLGIARGMNFIHEGLKMMHRDLKASNVLLDDSLTPKICDFGLARVMAKNPGQMTAETGTYRWMAPEVIGHMQYDYSADVYSFAILFWEILTGGQVPFAELNPLQAAVAVVQRGMRPEIPRNCDPYLVEIMRKCWKTAPSARPTFRVLVAMFEAYLDVLPEREQAEEKKQRPFSKFFRWKQKKKSCN

SEQ ID NO: 51267 - protein, 383 aa, Ostreococcus tauri
  misc_feature (1)..(1): Xaa can be any naturally occurring amino acid
XGRGAFGEVRLVRQKDTGEIFAMKKLKKSEMVRRGQVDHVKAERNLLAEVNSRAVVKLYYSFQDDQFLYLVMEFLPGGDVMTLLIRRDTLTEEETRFYLAQTVAALETIHRHNFIHRDIKPDNLLLDKDGHMKLSDFGLCKPIDPTYQQAVLPEILENESMGPSDPPPRTDEDSKRAEEVANWQKSRRRLAFSTVGTPDYIAPEVLLKKGYGLECDWWSVGAIAFEMLMGYAPFYSDEPLTTCRKIVHWRHHLRIPDDSPISPEARDLIERLLCDADQRLGTHGGVEEIKSHKFFKGLDWNALYTMTPPYRPVVSHRLDTRNFEDFEEDDSMRKKSGTVEGEGAPKDENFIGYTYKNVEIVGEEVKKLNIARPSLTSVFPTSK

SEQ ID NO: 51268 - protein, 165 aa, Zea mays
  misc_feature (91)..(91): Xaa can be any naturally occurring amino acid
  misc_feature (120)..(120): Xaa can be any naturally occurring amino acid
MEDGIGPVNRFPCNANFVRFFMFPIPVGMVPLRRFYVASVYAPISFPSLPLIVLKNRDGEQSAIAAVGSLKSMDPNRIILKKIVLTMYPQXSNLKSIVLYMFHDPNDVKWFKASIYACHXISNLSIFDATTMLFLQPIERWTKHGRRGRIMETVGTHVAHCQWCV

SEQ ID NO: 51269 - protein, 269 aa, Thermus thermophilus HB8
MIVVKVGGAEGINYEAVAKDAASLWKEGVKLLLVHGGSAETNKVAEALGHPPRFLTHPGGQVSRLTDRKTLEIFEMVYCGLVNKRLVELLQKEGANAIGLSGLDGRLFVGRRKTAVKYVENGKVKVHRGDYTGTVEEVNKALLDLLLQAGYLPVLTPPALSYENEAINTDGDQIAALLATLYGAEALVYLSNVPGLLARYPDEASLVREIPVERIEDPEYLALAQGRMKRKVMGAVEAVKGGVKRVVFADGRVENPIRRALSGEGTVVR

SEQ ID NO: 51270 - protein, 494 aa, Saccharomyces cerevisiae
MDLRVGRKFRIGRKIGSGSFGDIYHGTNLISGEEVAIKLESIRSRHPQLDYESRVYRYLSGGVGIPFIRWFGREGEYNAMVIDLLGPSLEDLFNYCHRRFSFKTVIMLALQMFCRIQYIHGRSFIHRDIKPDNFLMGVGRRGSTVHVIDFGLSKKYRDFNTHRHIPYRENKSLTGTARYASVNTHLGIEQSRRDDLESLGYVLIYFCKGSLPWQGLKATTKKQKYDRIMEKKLNVSVETLCSGLPLEFQEYMAYCKNLKFDEKPDYLFLARLFKDLSIKLEYHNDHLFDWTMLRYTKAMVEKQRDLLIEKGDLNANSNAASASNSTDNKSETFNKIKLLAMKKFPTHFHYYKNEDKHNPSPEEIKQQTILNNNAASSLPEELLNALDKGMENLRQQQPQQQVQSSQPQPQPQQLQQQPNGQRPNYYPEPLLQQQQRDSQEQQQQVPMATTRATQYPPQINSNNFNTNQASVPPQMRSNPQQPPQDKPAGQSIWL

SEQ ID NO: 51271 - protein, 347 aa, Oryza sativa Japonica Group
MCSCARFPHPALQPAPAPAPPPPNLKPKPAPTTRGPCPSPRTLVARAAPRRDDSTAPPPPPPSTFDFLALKRELEEEEEEEVVAVEPRDGGGGDGLASEDDGDGEAKRSGGGGESSGGRKRRQMARRSGLLAKQVISVSSARSLGFVSQLWVDAASWIVALVEVRPSLLSGEAEKFLFEDIYQVGDVVLVEDETVVENEFKLVGLHSLVGYSVVTSRRRNVGKVRGFTFDINTGAMESLELDSFGISIVPSSLVSTYCLFVEDVLDIVSDTIVVHEDAISRVQRLTQGIWGTQNIQGPGGQMDDNGRYRRRKARRVQRQNGLRNSSGRKLHRKMRDRDGDWELPMDY

SEQ ID NO: 51272 - protein, 426 aa, Schizosaccharomyces pombe 972h-
MASAIFVLNLKGKVIISRDYRADIPMSVVEKFLPLKSEVEEEQGFSTPCLTHEGINYIYIHHNDVYLLALSKMNSDAMEMLVFLRKMADVFIDYFKELQEESIRDNFVLVYELLDEIMDFGFPQTTETKILQEYITQTSNTVKKHAPPPIAMTNAISWRSEGIHYRKNEVFLDVIESVNLIAAADGTVIQSEILGKVRLKCYLSGMPELRLGLNDKVLFEAAGRTIKGNTVEMEDVKFHQCVRLARFENDRTISFIPPDGEFDLMSYRMSSNVRPLIWVECESIVHSGSRIEFMVKAKAQFKKRCIANNVQIIIPVPEDADSPRFQTSNGHVQYAPEQAAMVWNIKKFAGGKEFFMRAEMGLPSVKNEDIQVQKKRPVQLKFAIPYFTTSGIQVRYLKITEPKLNYHAMPWVRYVTQNGTEYSIRQ

SEQ ID NO: 51273 - protein, 366 aa, Bacillus caldotenax
MGNYRIAVLPGDGIGKEVTSGAVEVLKAVGIRFGHEFTFEYGLIGGAAIDEAGTPLPEETVRLCRESDAVLLGAVGGPKWDDNPPHLRPEKGLLAIRKQLDLYANLRPVVCYDSLVSRSPLKPDLVQGVDFVIVRELTGGIYFGQPSAVVENGEEKAVDTLLYKKEEIERIVRMAFELARGRRKKVTSVDKANVLSSSRLWREVAEEVANEFPDVTLEHMLVDMRMQLIRAPKQFDVIVTENMFGDILSDEASMLSGSLGMLPSASLSASGPSLYEPVHGSAPDIAGMNKANPIAAILSAAMMLRLSFGLTAEAGGRARVWQALALGSGSRLGQRRPHLSTNEMVEEIKAAVLDYTAIAQIMTVYA

SEQ ID NO: 51274 - protein, 548 aa, Hypocrea jecorina
MPIGNIYVIAGVSVVGGALFGFDISSVSAQLAEQSYLCYFNQDENPPTTVDGTCGGPRSLVQGGITASMAAGSWLGALISGPLSDRLGRKYSIMVGCIIWVIGSTLSCASQNIGMLIVARIINGLSVGIESAQVPVYIAEISPPSKRGRFIGMQQWAITWGILIMYYISYGCSFIGKQNPLEYNTASWRIPWGLQMIPAFFLFFMMMPLPESPRWLARKDRWEDCRAVLTLVHGKGDPNHPFVAYELQDIKDMCEFERRHADVTYLDLFKPNMLNRTFIGLFTQIWSQLTGMNVMMYYIANIFSMAGYSGNANLLASSIQYIINVLMTIPALLWVDKWGRRPTLLVGSVLMALWMYANAGILATYGEVVPGGIDHVAAQSMRVSGAPAKGLIACTYLFVASFAPTWGPVSWTYPPELFPLRLRGKGVALATSGNWAFNTALGLFTPVAFANIKWKSYLIFAIFNTVAFFHVFFVFPETAGKTLEETEAMFEDPNGIKYLGTPAWKTRVATSLTERAEHGDIEAKIGHDTEKPPVHTHEEEKASTPPPQ

SEQ ID NO: 51275 - protein, 366 aa, Bacillus coagulans
MKMKLAVLPGDGIGPEVMDAAIRVLKTVLDNDGHEAVFENALIGGAAIDEAGTPLPEETLDICRRSDAILLGAVGGPKWDHNPASLRPEKGLLGLRKEMGLFANLRPVKAYATLLNASPLKRERVENVDLVIVRELTGGLYFGRPSERRGPGENEVVDTLAYTREEIERIIEKAFQLAQIRRKKLASVDKANVLESSRMWREIAEETAKKYPDVELSHMLVDSTSMQLIANPGQFDVIVTENMFGDILSDEASVITGSLGMLPSASLRSDRFGMYEPVHGSAPDIAGQGKANPLGTVLSAALMLRYSFGLEKEAAAIEKAVDDVLQDGYCTGDLQVANGKVVSTIELTDRLIEKLNNSAARPRIFQ

SEQ ID NO: 51276 - protein, 447 aa, Schizosaccharomyces pombe 972h-
MCLPTIRKIAIIGAGPSGLVTAKALLAEKAFDQVTLFERRGSPGGVWNYTSTLSNKLPVPSTNPILTTEPIVGPAALPVYPSPLYRDLQTNTPIELMGYCDQSFKPQTLQFPHRHTIQEYQRIYAQPLLPFIKLATDVLDIEKKDGSWVVTYKGTKAGSPISKDIFDAVSICNGHYEVPYIPNIKGLDEYAKAVPGSVLHSSLFREPELFVGESVLVVGGASSANDLVRHLTPVAKHPIYQSLLGGGDIQNESLQQVPEITKFDPTTREIYLKGGKVLSNIDRVIYCTGYLYSVPFPSLAKLKSPETKLIDDGSHVHNVYQHIFYIPDPTLAFVGLALHVVPFPTSQAQAAFLARVWSGRLKLPSKEEQLKWQDELMFSLSGANNMYHSLDYPKDATYINKLHDWCKQATPVLEEEFPSPYWGEKERSIRENMWSIRAKFFGIEPPK

SEQ ID NO: 51277 - protein, 425 aa, Triticum aestivum
  misc_feature (79)..(79): Xaa can be any naturally occurring amino acid
MGLGGMRGGIGGGGAGSGERWRWILFLSLVSVSFLLSFLFLFLSAYSSPTRLRLPGLTTARAAAGVRRGPDALPCLAYXLLLGGRGDGHRLLRLLRAVYHPRNRYILHLSADASHEERRDLAAGVAAAAPAAVSFDNVALVGTPTAGTPVGSSGLAGTLRAAAVLLRLHPDWDWFLTLNAADYPLVTQDDLIHALSYVPREFNFIDHTSDIGRKESEKVQSMIVDAGIYLSGRTNFFRATQKRPSPDAFKFFTGSPWVILNRRFIEYCVLGWENLPRLLLMYFNNVMLPQEGYFHSVICNSLDFRNSTVNNDLRYKVWDDPPQTEPLFLSMAHYDKMVDSGQPFARRFQANGPLLDKIDEKLLKRPGHGPVPGAWCAGRKSWFIDPCSQWSDVNVVKPGPQALKLQKYINRTLEEADSGAKSCRL

SEQ ID NO: 51278 - protein, 335 aa, Streptomyces avermitilis MA-4680
MTIRVGINGFGRIGRNYFRALLEQGADIEIVAVNDLGDTATTAHLLKYDTILGRLKAEVTHTADTITVDGKTIKVFSERNPADIPWGELNVDIVIESTGIFTKKADAEKHIAGGAKKVLISAPASDEDITIVLGVNEDKYDPAKHNVISNASCTTNCVAPMAKVLDENFGIVKGLMTTIHAYTNDQRILDFPHKDLRRARAAAENIIPTTTGAAKATALVLPQLKGKMDGISMRVPVPTGSATDLVVEVSREVTKDEVNAAFKKAAEGELQGYLSYTEDPIVSSDIVGDPSSCTFDSAMTMVMEGTSVKILGWYDNEWGYSNRLVDLTVFVGNQL

SEQ ID NO: 51279 - protein, 403 aa, Streptomyces avermitilis MA-4680
MKTIDELLAEGVDGKRVFVRADLNVPLADGLITDDGRIRAVLPTVKALAEAGAKVVVASHLGRPKGAPDPAFSLLPAAERLGELLGAPVAFAQDTVGPAAHDAVNGLQPGQVAVIENLRFNAGETSKDDAERGAFADRLAALADIYVGDGFGAVHRKHASVYDLPARLPHYAGYLIATEVNVLKKLTEDVKRPYVVALGGAKVSDKLAVIDQLLGKADRLLIGGGMAYTFLKAKGYEVGISLLQEDQIPTVKEYMERAEKNGVELVLPVDVLVSTEFPDLKTKAPANPTTVAADAIPADQEGLDIGPETRKLYASKLADAATVFWNGPMGVFEHPDYAEGTKAVAQALVDSQAFTVVGGGDSAAAVRILGFDETAFGHISTGGGASLEYLEGKTLPGLAALED

SEQ ID NO: 51280 - protein, 401 aa, Cucumis melo
MDYVYGPGRNHLFVPGPVNIPEQVLRAMNRNNEDYRSPAVPALTKTLLEDVKKIFKTTSGTPFLFPTTGTGAWESALTNTLSPGDRIVSFLIGQFSLLWIDQQQRLNFKVDVIESEWGEGAKLDVLAAKLAADTDHTIKAVCIVHNETATGVTNDLSLVRRILDEYRHPALFLVDGVPSICALDFRMDDWGVDVALTGSQKALSLPTGIGIVCASPRALEASKTAKSLRVFFDWKDYLKFYNLGTYWPYTPSIQLLYGLRAALDLVFEEGLENVIARHKRLGQATRLAVEAWGLKNCTQKEEWHSDTVTAVVVPPYIDSAEIVRRAWKRYNLSLGLGLNKVAGKVFRIGHLGNLNELQLLGCLAGVEMILKDVGYPVKLGSGVAAASSYLQNNIPLIPSRI

SEQ ID NO: 51281 - protein, 475 aa, Pseudomonas aeruginosa PAO1
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQASGQPIEFRMWLYPWLTWAVILFIVAALSIMLIMPEHRHEVFATALLTIFTVCLGLLNARRKPRLGEDYAGKTARV

SEQ ID NO: 51282 - protein, 215 aa, Oryza sativa
  misc_feature (147)..(147): Xaa can be any naturally occurring amino acid
  misc_feature (172)..(172): Xaa can be any naturally occurring amino acid
MAGEADGKAPLGSRYPPAALNERILSSMSQKHVAAHPWHDLEIGPGAPAVFNCVVEIPRGSKVKCELDKATGLIKVDRVLYSSVVYPHNYGFIPRTLCEDGDPMDVLVLMQEQVVPGCFLRARAIGLMPMIDQGEKDDKIIAVRADXPEYRHFRDIKEIPLHRFQEIRRFFXEDYKKNENKEVAVNEFFPAEDAINAIKYSMDFYGAHIIESSRK

SEQ ID NO: 51283 - protein, 497 aa, Pseudomonas aeruginosa PAO1
MGTLHHLINGEMVADNGRSADVFNPSTGEAIHKVPLADGKTLQKAIDAARAAFPAWRNTPPAKRAQVLYRFKQLLEQNEARISKLISEEHGKTLEDAAGELKRGIENVEYACAAPEILKGEYSRNVGPNIDAWSDFQPIGVVAGITPFNFPAMVPLWMYPLAIACGNTFILKPSERDPSSTLLIAELFHEAGLPKGVLNVVHGDKEAVDGLLQAPEVKAISFVGSTPIAEYIYAEGTKRGKRVQALGGAKNHAVLMPDADLDNAVSALMGAAYGSCGERCMAISVAVCVGDQVADALIAKLVPQIKALKIGAGTSCGLDMGPLVTAAAQAKVTGYIDSGVAQGAELVVDGRGYQVAGHENGFFLGGSLFDRVTPEMTIYKEEIFGPVLCVVRVNSLEEAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 51284 - protein, 91 aa, Synechococcus sp. WH 5701
MGATADLRMAVKKAGPVVTDQGNLVLDLKFAGGITDPAALEQAINNLPGVLENGLFVGLTDPVAGAVADERPLRSDHIGCDGTGEGHERFG

SEQ ID NO: 51285 - protein, 401 aa, Cucumis sativus
MDYVYGPGRNHLFVPGPVNIPEQVLRAMNRNNEDYRSPAVPALTKTLLEDVKKIFKTTSGTPFSFPTTGTGAWESALTNTLSPGDRIVSFLIGQFSLLWIDQQQRLNFKVDVIESEWGEGAKLDVLAAKLAADTDHTIKAVCIVHNETATGVTNDLSLVRRILDEYRHPALFLVDGVSSICALDFRMDDWGVDVALTGSQKALSLPTGIGIVCASPRALEASKTAKSLRVFFDWKDYLKFYNLGTYWPYTPSIQLLYGLRAALDLVFEEGLENVIARHKRLGQATRLAVEAWGLKNCTQKEEWHSDTVTAVVVPPYIDSAEIVRRAWKRYNLSLGLGLNKVAGKVFRIGHLGNLNELQLLGCLAGVEMILKDVGYPVKLGSGVAAASSYLQNNIPLIPSRI

SEQ ID NO: 51286 - protein, 466 aa, Sulfitobacter sp. EE-36
MTKDVSTTPDQDGEKTELKRVMGPGLLLLFVVGDVLGTGIYALTGEVAAKVGGIVWLPFLVAFVLATVTACSYLELVTKYPKAAGAALYTQKAFGVHFLTFLVAFAVMSSGITSASTASQAFAENFGKSFGLGDGAFLITAISIGFMVLLGLINLRGVGESVKANVVLTCIELTGLLIIIMIGAAALMGGQGDFGRAFDFSSAGEQGLFWPVIAATTLAFFAMVGFEDSVNMAEEAKNPSRIFPKVLLGGLLITGVIYLLVSITAIALVDAEALGEGATPLLKVVEAGAPWFPLSVFGIITMCAVANSALINMLMASRLLYGMAQEKVLPSILGKVLPKRRTPYTAIVFTTGLAIALITFVGAVPDLGGTTALLLLAVFTLVNIAVLVLRSDTVDHDHFTSPLGLPYIGAISCAFFVGPWTGRDSVQYLIAAVLIGLGVVLWGATVFYMKSKGQDPLASDMDKLSE

SEQ ID NO: 51287 - protein, 447 aa, Pediococcus pentosaceus ATCC 25745
MADKTSGKGLPTLSKNLIWMINFGFLGVQTAFTLQSSQMSRIFQTIGADPNNLGWFFILPPLAGLIVQPIVGYYSDRTWKPRLGGRRLPYLILGTLIAVIVMLLLPNSGSFGFGYGSLMALWFGAITVAFLDLSSNVAMQPFKMMIGDMVNDKQKSYAYGIQSFLSNTGAVLAAIFPFLLTWLGIANTANKGVVPQSVVISFYAGAILLIITSLFTVFRVKEYDPATYAMYHGISEKENSEGGNWITLLKNAPKAFWTVTLVQFFCWFAFQYLWTYSAGAIAQNVWHTANASSAAYQAAGNWYGVLAAVQSIAAVACSYVLAKLPNRFHKSGYAVSLILGALGFVSVFFVHNQYILIVSYILVGIAWAGMNTYPLTIVTNALSGNHMGTYLGLFNGSICLPQIVASLLSFGLFPLLGSSQANMFLLAGAVMLLGAFAVGTIKETFAE

SEQ ID NO: 51288 - protein, 397 aa, Streptococcus pyogenes M1 GAS
MPKLSKRVLEMKESVTLAAGARAKALKAQGRDVLNLTLGEPDFFTPKHIQDKAIESIQNGTASFYTNASGLPELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAVRRLHVFMESNEIN

SEQ ID NO: 51289 - protein, 401 aa, Cucumis melo
MDYVYGPGRNHLFVPGPVNIPEQVLRAMNRNNEDYRSPAVPALTKTLLEDVKKIFKTTSGTPFLFPTTGTGAWESALTNTLSPGDRIVSFLIGQFSLLWIDQQQRLNFKVDVIESEWGEGAKLDVLAAKLAADTDHTIKAVCIVHNETATGVTNDLSLVRRILDEYRHPALFLVDGVSSICALDFRMDDWGVDVALTGSQKVLSLPTGIGIVCASPRALEASKTAKSLRVFFDWKDYLKFYNLGTYWPYTPSIQLLYGLRAALDLVFEEGLENVIARHKRLGQATRLAVEAWGLKNCTQKEEWHSDTVTAVVVPPYMDSAEIVRRAWKRYNLSLGLGLNKVAGKVFRIGHLGNLNELQLLGCLAGVEMILKDVGYPVKLGSGVAAASSYLQNNIPLIPSRI

SEQ ID NO: 51290 - protein, 247 aa, Triticum aestivum
  misc_feature (164)..(164): Xaa can be any naturally occurring amino acid
MEKEPSSSSDVSASHVGRVRSRRRPNEVTTDGNRTNGPTLLVSDRNKYKSMLIRTYSTVWMIGGFAFLVYMGHLYIWAMVVVIQIFMATELFNLLRKSSEEKQLPGFRLPNWHFFFTAMLFTYGRFLTRELVNTVSSDHLLYKPVSGLIKYQMVICYFLYISGXFVWVILTLEEKDIQIPRSNRMPWTHMIPFKRFLDKSSFTAGKYFLKGIFWVSFYLALIHWGSNGLGPPNLFWGSFLRGEPQCH

SEQ ID NO: 51291 - protein, 502 aa, Vitis vinifera
MAMALARRSKNLYSCGVLRYSLSLTSFSRGFASAGSDENDVVVIGGGPGGYVAAIKAAQLGLKTTCIEKRGTLGGTCLNVGCIPSKALLHSSHMYHEAKHSFASHGVKFPSVEVDLPAMMGQKDKAVANLTRGIEGLFKKNKVNYVKGYGKFISPSEVSVDTIEGGNAVVKGKNIIIATGSDVKSLPGITIDEKRIVSSTGALALSEIPKKLVVVGAGYIGLEMGSVWARLGSEVTVVEFAPDIVPTMDGEIRKQFQRALEKQKMKFMVKTKVAGVDTSGDLVKLTLEPAAGGEQSTLEADVVLVSAGRSPFTAGLGLDKIGVETDKIGRILVNEKFSTNVSGVYAIGDVIPGPMLAHKAEEDGVACVEMIAGKAAHVDYDMVPGVVYTHPEVASVGKTEEQVKALGVEYCVGKFPLLANSRAKAIDDAEGLVKILAEKETDKILGVHIFGPNAGELIHEAVLALHYGASSEDIARTCHAHPTMSEALKEAAMATYDKPIHI

SEQ ID NO: 51292 - protein, 127 aa, Rubrobacter xylanophilus DSM 9941
MSEEMNSAGQGPPSVKVDKPWGKFEQYTHNLPCTVKIITVAPGGTLSRQYHHKRDELWVVLDPGARVELDDQILHPEPEEKVFIPRQTVHRLSCEGERPVRILEISFGEFDEEDIVRLEDVYGRVGP

SEQ ID NO: 51293 - protein, 359 aa, Oryza sativa Indica Group
MAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQRSKNGKLRLLYECAPMSFIVEQAGGKGSDGHQRILDIMPTEIHQRVPLYIGSVEEVEKVEKFLA

SEQ ID NO: 51294 - protein, 397 aa, Glycine max
GSRSTCVRKSFFIKLHTSVPPKDRKLFPDETTTTTNQTQDCYGFCDPACPYNCYNNPDYFFSPPPPSISHSSQVNHISSYLIILVTLFTVIFVVVGFYVIKVKCYATWCGWRFSGSVPSSDTTTEEFLNENQVDHPVWLIATVGLQESIINSITVCKYKKNEGLVEGTECSVCLNEFQEEETLRLLPKCNHAFHVPCIDTWLRSHTNCPLCRAGIVSNSVNSEAPAPVSNSEQENANLGRNQDTLLDNSRINEGGLSSNMVAGESSEAIDESNSKDRVNDETQNNGVLMNIEIQTEMGSVSTTECESHRVVDDHKHDDDTMLHTDNLGKQDQDGDYYYSKTCKTVRRSSIEECLHLSPVSMKRSFSSCNGRTLTSRGYMSLNSKLNSSLLEFSFYER

SEQ ID NO: 51295 - protein, 424 aa, Arabidopsis thaliana
SRTAHSLHFTPPLSLFNNSKKKQKQKKREMEKKLKRRESMSTTAAESPPAKRRRTVTGNENSALIEGLPDHISEICLSLVHRPSLLSAVCTRWRRLLYSPEFPSFPSLYALFVDSTSDTGRVNPSVRFMCFNPVSSKWYPLPPPPPDPPLHRILYRHPSFISFNLPIQCVSAAGKLILIAGSNQQLSPAISHPLIFDPISSSWSSGPRIGSPRRWCATGACDGAIYIASGISSQFSSTVAKSVEKLDLTEQNRNNHRFNWEKLRDMRDLRFSREAIDAVGYRRKLLMVNVKGDAVKEGAIYDVVKDDWEPMPEEMLVGWRGPVAAMEEEILYSVDERRGTVRKYDDEKREWREVVVVEGGEEMLKGATQVTADSGKLCVVTGDGKIVVVDVAAEPAKIWNVEIPDGLEPVSVHVLPRMSQPNFC

SEQ ID NO: 51296 - protein, 209 aa, Francisella tularensis subsp. holarctica
MKVTLYTTKYCPYSLRARIALAEKKMSTNIVEAGDLEPAMIKKIAPNGVFPILMEKDYSINNRKALLIYIDERFPAPSLLPNVVNERIKIRLSLDKIDNEWYPVLDQIRKHRSDQKMLESMFKDLKESLLAMEKAFTGSEFFISSGFTLADCYIAALIICLEAEGFIIDDEYGAIYEYKKRLFARDSVKKANIKGGAGESLLKTLRTHR

SEQ ID NO: 51297 - protein, 496 aa, Oryza sativa
MTSVQLETPHSGKYGQPTGLFINNEFVKGQEGKTFDVINPSDESVITQVHEATEKDVDIAVAAARKAFEGSWRQETPENRGKLLTNLANLFEKNIDLLAAVESLDNGKAISMAKVDISMCVGCLRYYGGWADKITGKVIDTTPDTFNYVKKEPIGVCGQIIPWNFPLLMWAWKIGPAIACGNTVVLKTAEQTPLGGLVAARLVKEAGFPPGVINVISGFGKVAGAALSSHMDVDKVAFTGSTVVGRTILKAAAASNLKKVTLELGGKSPNIVFEDADIDNAISWVNFGIFFNHGQCCCAGSRVYVQESIYDKFVQKSKERAQKNVVGDPFAADTFQGPQVSKVQFDRIMEYIQAGKDAGATIETGGKRKGDKGYFIEPTIFSNVTEDMKIVKEEIFGPVCSIAKFKTKEDAIKLGNASTYGLAAAVHTKNLNTAIEVSNALRAGTVWVNTYNTLHHQMPFGGYKESGIGRELGEDALANYTQTKTVSIRLGDALFG

SEQ ID NO: 51298 - protein, 578 aa, Hyphomonas neptunium ATCC 15444
MEHAAHGPSPTLIKDLLVFLIAAGILVPAMRWLKMPTIIAFMLAGVGLGPYALGHFAEDYPVLTFFSITEPEAALPLAELGVLFLLFLLGVEFSFQRLWALRKVVLGAGGMQTLLSAAVIAVAGWALGLDPAVSLILGLALALSSTAIVMQVLVEEKRAAQPVGRTSLGVLLFQDIMVAPILIFVGFVGLKSDANLGGVLLDALIRGLIAIAVIWVIGNFLLGRVFRLAAASGGRDFLMALTLLTVVGAAAITYSAGLSVALGAFLAGLLVGETEFKHQTEVDLEPFKGLLLGLFFMTVGMSLDLPAIAGQLGPILAVLAGLIVAKVGIAYLACRLFAGGHPISIEAALLLAPAGEFAFIILTAAQAGNAVTREVATFAAAVAGLSMLLTPLLGQLGRKLAARRPAKVDPEGMQLTDPSEMENHVVLAGYGRVGRAVARVLKDEEVSILAIDRDPEKVHQARLDGLTAYVGDAARPEILTLTGIAKAEQFIVTVDDPNRARDMVSSARSLHRDILILARAHDGEHAAELEKAGAAHVVPEAVESGLQMAGMALEGFGYETETVRDILAVVRDEEYRRA

SEQ ID NO: 51299 - protein, 156 aa, Helicobacter pylori 26695
MQIIEGKLQLQGNERVAILTSRFNHIITDRLQEGAMDCFKRHGGDEDLLDIVLVPGAYELPFILDKLLESEKYDGVCVLGAIIRGGTPHFDYVSAEATKGIAHAMLKYSMPVSFGVLTTDNIEQAIERAGSKAGNKGFEAMSTLIELLSLCQTLKG
